United States Patent
Creelman et al.

(10) Patent No.: US 10,047,372 B1
(45) Date of Patent: Aug. 14, 2018

(54) NITROGEN UPTAKE IN PLANTS

(71) Applicant: Koch Biological Solutions, Inc., Hayward, CA (US)

(72) Inventors: Robert A. Creelman, Castro Valley, CA (US); Suqin Cai, Fremont, CA (US); Hans E. Holtan, Emeryville, CA (US); T. Lynne Reuber, San Mateo, CA (US); Oliver J. Ratcliffe, Oakland, CA (US)

(73) Assignee: Koch Biological Solutions, LLC, Hayward, CA (US)

( * ) Notice: Subject to any disclaimer, the term of this patent is extended or adjusted under 35 U.S.C. 154(b) by 261 days.

(21) Appl. No.: 14/645,030

(22) Filed: Mar. 11, 2015

Related U.S. Application Data

(60) Provisional application No. 61/951,934, filed on Mar. 12, 2014.

(51) Int. Cl.
*C12N 15/82* (2006.01)

(52) U.S. Cl.
CPC ..... *C12N 15/8261* (2013.01); *C12N 15/8227* (2013.01)

(58) Field of Classification Search
None
See application file for complete search history.

(56) References Cited

U.S. PATENT DOCUMENTS

2007/0033671 A1* 2/2007 Jiang .................. C07K 14/415 800/278

OTHER PUBLICATIONS

Engelbrecht et al 2004 (BMC Genomics 5:39 p. 1-17).*
K.G.Cassman, A. Dobermann, D.T. Walters. Agroecosystems, Nitrogen-use Efficiency, and Nitrogen Management. 2002. Ambio 31:132-140.
C. Diaz et al. Nitrogen Recycling and Remobilization Are Differentially Controlled by Leaf Senescence and Development Stage in *Arabidopsis*. 2008. Plant Physiol. 147:1437-1449.
A.D.M. Glass et al. The regulation of nitrate and ammonium transport systems in plants. 2002. J. Exp. Bot. 53:855-864.
A.G. Good et al. Can less yield more? Is reducing nutrient input into the environment compatible with maintaining crop production? 2004. Trends Plant Sci. 9:597-605.
A. Hodge, D. Robinson, A. Fitter. Are microorganisms more effective than plants at competing for nitrogen? 2000. Trends Plant Sci. 5:304-308.
D.W.Lawlor. Carbon and nitrogen assimilation in relation to yield: mechanisms are the key to understanding production systems. 2002. J. Exp. Bot. 53:773-787.
F.I.M. Maathuis. Physiological functions of mineral macronutrients. 2009. Curr. Opin. Plant Biol. 12:250-258.
C.M. Masclaux-Daubresse et al. Nitrogen uptake, assimilation and remobilization in plants: challenges for sustainable and productive agriculture. 2010. Ann. Bot. 105:1141-1157.
B.E. Maust, J.G. Williamson. Nitrogen Nutrition of Containerized Citrus Nursery Plants. 1994. J. Amer. Soc. Hort. Sci., 119:195-201.
I.C. Oliveira et al. Overexpression of Cytosolic Glutamine Synthetase. Relation to Nitrogen, Light, and Photorespiration. 2002. Plant Physiol. 129:1170-1180.
I. Rajcan, M. Tollenaar. Source:sink ratio and leaf senescence in maize: II. Nitrogen metabolism during grain filling. 1999. Field Crops Res. 60:255-265.
S. Schiltz et al. Proteome Reference Maps of Vegetative Tissues in Pea. An Investigation of N Mobilization from Leaves during Seed Filling. 2004. Plant Physiol. 135:2241-2260.
S. Schiltz et al. Dynamics of Exogenous N Partitioning and N Remobilization from Vegetative Organs in Pea Revealed by 15N in vivo labeling.. 2005. Plant Physiol. 137:1463-1473.
R.H. Socolow. Nitrogen management and the future of food: Lessons from the management of energy and carbon. 1999. Proc. Natl. Acad. Sci. USA 96:6001-6008.
G. Xu, X. Fan, A.J. Miller. Plant Nitrogen Assimilation and Use Efficiency. 2012. Annu. Rev. Plant Biol. 63:153-182.

* cited by examiner

*Primary Examiner* — Matthew R Keogh

(57) ABSTRACT

This disclosure provides transgenic plants, including crop plants and methods for their production. The transgenic plants comprise recombinant DNA constructs for the expression of polypeptides encoded by the DNA constructs. The polypeptides are capable of conferring improved traits to the transgenic plants when expressed under the control of a tissue-enhanced promoter. This disclosure also pertains to transgenic plants and their progeny plants, wherein the transgenic or progeny plants comprise the recombinant DNA constructs and are selected for having enhanced nitrogen use efficiency and/or nitrogen uptake. Seed of the transgenic plants that can be grown into a plant that comprise the disclosed recombinant DNA constructs and exhibits having enhanced nitrogen use efficiency, and which may be selected for this trait, are also envisioned.

4 Claims, No Drawings

NITROGEN UPTAKE IN PLANTS

FIELD OF THE INVENTION

The present description relates to compositions and methods for improving nitrogen use efficiency in plants, for example, by improving nitrogen uptake or assimilation efficiency.

BACKGROUND

Nitrogen is a critical limiting nutrient for plants. Nitrogen fertilizer is a significant contributor to the yield increases obtained in the last several decades. However, these yield benefits have monetary and environmental costs, and nitrogen-based fertilizer represents a significant fraction of a farmer's input costs. Furthermore, crops only use a fraction of applied nitrogen. For example, it has been estimated that 50-70% of the nitrogen provided to the soil is lost (Masclaux-Daubresse et al., 2010, *Ann. Bot.* 105: 1141-1157; Hodge et al., 2000, *Trends Plant Sci.* 5: 304-308). Maize production in the US is reported to have a nitrogen fertilizer recovery efficiency of 37% (Cassman et al., 2002, *Ambio* 31: 132-140), and increased fertilizer application rates are subject to diminishing returns. A hectare of corn, for example, retains 39% of the first 100 kilograms of nitrogen applied as fertilizer, but only 13% of the second 100 kilograms of nitrogen applied (Socolow, 1999, *Proc. Natl. Acad. Sci. USA* 96: 6001-6008). As a consequence, nitrogen fertilizer that is not taken up by plants is generally lost as runoff or converted to nitrogen gases by microbial action, contributing to water and air pollution.

Thus, improving their efficiency of a crop plant's nitrogen use (i.e., its Nitrogen Use Efficiency, or N Use Efficiency, or NUE) would have the benefit of improving yield and agricultural sustainability while reducing negative environmental impact. NUE has been defined as increased grain yield per unit nitrogen available from the soil (Masclaux-Daubresse et al., 2010, supra), and thus it is judicious to identify means to increase the grain yield that may be obtained per unit nitrogen available from the soil.

Plants obtain nitrogen through the processes of uptake and assimilation (Buchanan et al., 2000, *Biochemistry and Molecular Biology of Plants*, American Society of Plant Physiologists, Rockville, Md.; Masclaux-Daubresse et al., 2010, supra). Uptake refers to the transport of nitrogen into the plant, and assimilation is the conversion of nitrate and ammonia to amino acids. Plants generally take up nitrogen from the soil in the form of nitrate or ammonium. Plants contain both low affinity and high affinity transport systems for these ions. In the case of nitrate, there is both a constitutive and an inducible high affinity transport system (Glass et al., 2002, *J. Exp. Bot.* 53: 855-864). Once nitrate crosses the plasma membrane, it is either metabolized in the cytoplasm of root cells or transported to the shoot via the xylem. For example, in wheat, up to 80% of the absorbed nitrate is reduced within the leaves (Ashley et al., 1975, *Plant Physiol.* 55: 1102-1106). Nitrate is reduced to ammonia through the action of nitrate reductase and nitrite reductase. Assimilation of ammonia takes place through the glutamine synthetase/glutamine-2-oxoglutarate aminotransferase (GS/GOGAT) pathway. Glutamine synthetase (GS) adds an amino group to glutamate to make glutamine, and GOGAT transfers the amino group to α-ketoglutarate to make a second molecule of glutamate. Photosynthesis provides the fixed carbon, energy, and reductant necessary for assimilation.

Plant nitrogen use efficiency could conceivably be increased by several mechanisms (Lawlor 2002, *J. Exp. Bot.* 53: 773-787). One mechanism could be increasing nitrogen uptake (which can be defined as the percentage of applied nitrogen taken up by plants (Maust and Williamson, 1994, *J. Amer. Soc. Hort. Sci.*, 119: 195-201), through higher root surface area, deeper penetration into the soil, or more high affinity nitrate or ammonium transporters. A second mechanism could be increased assimilation, possibly by increased activity of assimilatory enzymes or removal of negative regulation. Nitrogen utilization or assimilation efficiency, NUtE, is the fraction of plant-acquired nitrogen to be converted to total plant biomass or grain yield; (Xu et al., 2012, *Annu. Rev. Plant Biol.* 63:153-182). A third mechanism could be increased capacity to store nitrogen when it is available. Nitrogen is stored in the form of nitrate in cell vacuoles, but stored nitrate supplies are exhausted in a matter of days (Glass et al., 2002, supra). Nitrogen is also stored in the form of amino acids and protein, and this storage is dependent upon sufficient carbon availability. Control of nitrogen losses is also possible. Nitrate and ammonia exit as well as enter root cells. Photorespiration is another source of ammonia loss Ammonia released through photorespiration is recycled through the GS/GOGAT pathway, but this process may not be fully efficient. Overexpression of cytosolic glutamine synthetase in tobacco increased biomass produced, presumably through increased efficiency of ammonia recycling (Oliveira et al., 2002, *Plant Physiol.* 129: 1170-1180). The intrinsic nitrogen use efficiency (defined as biomass produced per unit N) could be changed by changing the plant's fundamental carbon/nitrogen ratio. Improving the NUE of crop plants has the potential to reduce fertilizer application rates, providing both cost savings and environmental benefits.

In spite of the apparent advantages of improved NUE, decades of research have not produced significant improvements in NUE in crops, and improved NUE is largely an unmet need in agriculture today.

The present description relates to methods and compositions for producing transgenic plants with modified traits, particularly traits that address agricultural and food needs by improving nitrogen use efficiency. In addition to reducing the demand for nitrogen application, it is expected that improving nitrogen use efficiency will improve yield and may provide significant value by allowing the plant to thrive in hostile environments, where, for example, low nutrient availability may limit yield or diminish or prevent growth of non-transgenic plants.

In this description, the expression levels of certain polynucleotide and polypeptide sequences identified herein may be manipulated to produce improved yield in commercially valuable plants and crops as well. Other aspects and embodiments of the description are described below and can be derived from the teachings of this disclosure as a whole.

SUMMARY OF THE DISCLOSURE

The present disclosure is directed to a method for producing a plant that has improved or enhanced nitrogen uptake and/or assimilation in the plant or in a part of the plant (for example, in roots or leaves;) relative to a control plant or its corresponding or analogous part. In this method, a plant is grown in a medium that contains either a limiting concentration of nitrogen that limits growth of the plant (for example, 2 mM total nitrogen in the medium) or an ample concentration of nitrogen that does not limit growth of the plant (for example, 10 mM total nitrogen in the medium).

Expression analysis of the plant may then reveal the presence of one or more polypeptides (the "instant polypeptides") that have a higher level of expression when the plant is grown in the limiting nitrogen medium as compared to plants grown in the medium with ample nitrogen. Genes may also be identified that, when overexpressed, produce changes in growth (e.g. enhanced root growth) or appearance (e.g. darker green leaves) in plate based assays using media with altered nitrogen or carbon content, or increased growth, biomass, nitrogen content, or photosynthetic capacity in soil-grown plants, and tested for the ability to confer enhanced nitrogen uptake and/or assimilation. The expression of a polypeptide identified in this manner may be regulated by a developmentally-regulated promoter. For example, expression of the promoter may be enhanced in root, root cap, root meristem, root vasculature, vascular, and/or green tissue; that is, the activity of the promoter is enhanced in one or more of these tissues relative to other plant tissues). It is anticipated that transformed plants that comprise one or more nucleic acid constructs that contain the tissue-enhanced promoter and a polynucleotide that encodes one of the instant polynucleotide will have greater nitrogen uptake and/or assimilation, as measured by such parameters as Nitrogen Uptake Efficiency (NUpE) or Usage Index (UI) relative to a control plant and as a result of the expression of the polynucleotide. The one or more nucleic acid constructs may be introduced into the plant by, for example, transformation or breeding. In this method, a regulator of gene expression may be identified that can enhance nitrogen uptake when expression of the regulator is enhanced in root, root cap, root meristem, root vasculature, vascular, and/or green tissue of the plant or a part of the plant. In this method, a transformed plant may be selected that has greater nitrogen uptake than the control plant.

The converse observation, in which expression analysis of the plant identifies one or more endogenous polypeptides that have a higher level of expression when the plant is grown in the ample nitrogen medium as compared to plants grown in the medium with limiting nitrogen, may be used to identify one or more endogenous polypeptides that may enhance nitrogen uptake and/or assimilation when expression of the endogenous polypeptide(s) is/are down-regulated. Down-regulation of expression may be accomplished with a means that suppresses transcription or translation of the endogenous polypeptide. Of some interest are suppressors of gene expression such as, for example, an RNAi molecule, an siRNA molecule, an antisense molecule, a ribozyme molecule, a deoxyribosyme molecule (a "DNAzyme") or a triple helix molecule that decreases the expression of the endogenous polypeptide. Gene expression suppressors may be introduced into a plant by breeding plants with a parental line that contains an instant gene expression suppressor, or by direct application or, in a desirable embodiment, by way of a nucleic acid construct that encodes the suppressor. It is anticipated that plants that comprise nucleic acid constructs encoding one or more of the instant suppressors will suppress or inhibit the activity of an instant polypeptide in the plant and thereby enhance nitrogen uptake in the plant. In this manner, a regulator of gene expression that can suppress protein expression or protein activity of the plant or a part of the plant may be identified.

The instant disclosure is also directed to a method for enhancing nitrogen uptake in a crop plant relative to a control plant by providing a transformed crop plant that comprises at least one of the instant recombinant nucleic acid constructs, and the construct or constructs comprise a tissue enhanced promoter that preferentially drives expression in root, root cap, root meristem, root vasculature, vascular, and/or green tissue, and in the same construct or a separate construct, an operably-linked polynucleotide the expression of which is regulated by the promoter. In this context, "providing" may refer to, for example, any one of the art-recognized means to introduce a nucleic acid construct into a plant or plant cell, such as by transformation or breeding where at least one parent line comprises at least one of the instant nucleic acid constructs (two parental lines may each contain an instant nucleic acid construct, as in the case when one plant line comprises a tissue-enhanced promoter that regulates expression of a polynucleotide comprised within a second promoter comprised within a different parental plant line). The polynucleotide encodes a polypeptide that is at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 90%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95% or 96%, at least 97%, at least 98%, or at least 99%, or about 100% identical to SEQ ID NO:2n, where n=1 to 1131, or alternatively expressed as any of SEQ ID NOs: 2, 4, 6, 8, or any even integer to 2262. The tissue-enhanced promoter preferentially enhances expression of the polynucleotide in root, root cap, root meristem, root vasculature, vascular, and/or green tissue in the transformed plant or in a part of the transformed plant, and the preferential enhancement of expression results in increased nitrogen uptake in the transformed plant relative to the control plant.

Another aspect of the instant disclosure is a method of producing a crop plant with enhanced nitrogen uptake by providing a crop plant that has a stably-integrated, recombinant DNA construct comprising a promoter that is functional in plant cells and operably linked to DNA that encodes or suppresses a polypeptide presented in the Sequence Listing, or any of SEQ ID NOs: 2n, where n=1 to 1131, wherein the expression and activity of the polypeptide confers enhanced nitrogen uptake relative to a control plant. The methods further comprise producing seed and a progeny plant from the crop plant with enhanced nitrogen uptake, wherein the seed or progeny plant comprise the stably-integrated, recombinant DNA construct and the progeny plant or a plant grown from the seed exhibit enhanced nitrogen uptake relative to a control plant.

The instant disclosure also pertains to a recombinant nucleic acid construct comprising a root, root cap, root meristem, root vasculature, vascular, and/or green tissue-enhanced promoter that regulates expression of a polynucleotide, wherein the polynucleotide encodes a polypeptide is at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 90%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95% or 96%, at least 97%, at least 98%, or at least 99%, or about 100% identical to any of SEQ ID NOs: 2, 4, 6, 8, or any even integer to 2262.

The instant disclosure also pertains to a transformed crop plant produced by any of the above described, methods, wherein the crop plant has enhanced nitrogen uptake relative to a control plant when the expression of an introduced or endogenous polypeptide provided in the sequence listing is enhanced or inhibited, respectively.

BRIEF DESCRIPTION OF THE SEQUENCE LISTING

The Sequence Listing provides exemplary polynucleotide and polypeptide sequences of the instant description. The traits associated with the use of the sequences are included in the Examples.

Incorporation of the Sequence Listing.

The Sequence Listing provides exemplary polynucleotide and polypeptide sequences. The copy of the Sequence Listing, being submitted electronically with this patent application, provided under 37 CFR § 1.821-1.825, is a read-only memory computer-readable file in ASCII text format. The Sequence Listing is named "MPS-0231P_ST25.txt," the electronic file of the Sequence Listing was created on Mar. 5, 2014, and is 8,181,555 bytes in size (7.80 megabytes in size as measured in MS-WINDOWS). The Sequence Listing is herein incorporated by reference in its entirety.

DETAILED DESCRIPTION

The present description relates to polynucleotides and polypeptides for modifying phenotypes of plants, particularly those associated with increased photosynthetic resource use efficiency and increased yield with respect to a control plant (for example, a wild-type plant). Throughout this disclosure, various information sources are referred to and/or are specifically incorporated. The information sources include scientific journal articles, patent documents, textbooks, and internet entries. While the reference to these information sources clearly indicates that they can be used by one of skill in the art, each and every one of the information sources cited herein are specifically incorporated in their entirety, whether or not a specific mention of "incorporation by reference" is noted. The contents and teachings of each and every one of the information sources can be relied on and used to make and use embodiments of the instant description.

As used herein and in the appended claims, the singular forms "a", "an", and "the" include the plural reference unless the context clearly dictates otherwise. Thus, for example, a reference to "a host cell" includes a plurality of such host cells, and a reference to "a plant" is a reference to one or more plants, and so forth.

Definitions

"Upregulation" or "up-regulation" refers to a process in which a cell or an organism (e.g., a plant) increases the quantity of a cellular component, such as RNA or protein, in response to an internal or external signal. Upregulation may result in a greater activity of interest occurring in the cell or organism, for example, an increase in nitrogen uptake. Conversely, "downregulation" or "down-regulation" refers to a process by which a cell decreases the quantity of a cellular component, such as RNA or protein, in response to an internal or external signal. An internal or external signal may refer to, for example, an environmental variable such as a particular stress or a developmental marker such as molecule that signals the onset or occurrence of germination, root establishment, seedling growth, leaf production and canopy development, leaf senescence, reproduction (fertilization and seed development) or an environmental stress such as low environmental nitrogen, phosphorus, sulfur, iron, or potassium, salt stress, water stress, heat stress.

Tissue-specific, tissue-enhanced (that is, tissue-preferred), cell type-specific, and inducible promoters constitute non-constitutive promoters. Promoters under developmental control include promoters that preferentially initiate transcription in certain tissues, such as xylem, leaves, roots, or seeds. Such promoters are examples of tissue-enhanced or tissue-preferred promoters (see U.S. Pat. No. 7,365,186). Tissue-enhanced promoters can be found upstream and operatively linked to DNA sequences normally transcribed in higher levels in certain plant tissues or specifically in certain plant tissues, respectively. "Cell-enhanced", "tissue-enhanced", or "tissue-specific" regulation thus refer to the control of gene or protein expression, for example, by a promoter, which drives expression that is not necessarily totally restricted to a single type of cell or tissue, but where expression is elevated in particular cells or tissues to a greater extent than in other cells or tissues within the organism, and in the case of tissue-specific regulation, in a manner that is primarily elevated in a specific tissue. Tissue-enhanced or preferred promoters have been described in, for example, U.S. Pat. No. 7,365,186, U.S. Pat. No. 7,619,133, and by Noh and Amasino, 1999. *Plant Molec. Biol.* 41:181-194. Generally, root-specific, root cap-specific, root meristem-specific, root vasculature-specific, vascular-specific, and/or green tissue-specific promoters are transcriptionally active entirely or almost entirely in root, root cap, root meristem, root vasculature, vascular, and green tissue, respectively. Root-preferred or -enhanced, root cap-preferred or -enhanced, root meristem-preferred or -enhanced, root vasculature-preferred or -enhanced, vascular-preferred or -enhanced, and green tissue-preferred or -enhanced promoters are transcriptionally active predominantly in one or more of these tissues, but are not necessarily expressed only in these tissue. A root-specific, enhanced or preferred promoter may be preferentially active during root development and/or during germination. Examples of tissue-enhanced promoters are found in the present Sequence Listing, in Table 3, or have been taught in, for example, US patent publication U520130305414 or by Qing Qu and Takaiwa, 2004. *Plant Biotechnol. J.* 2:113-125).

An "inducible promoter" initiates transcription in response to an environmental stimulus such as a an external physical stimulus, for example, abiotic stimuli including energy or a particular chemical or class of chemicals, or a biotic stimulus, for example, a pathogen, or an internal stimulus such as one or more markers that signal a stage of development. Examples include "pathogen-inducible" promoters that initiate transcription in response to the presence of various pathogenic organisms or their products, and developmentally-induced promoters that are activated when a plant or plant part is at a particular growth stage, for example, "senescence-enhanced" (also referred to as "senescence-inducible") promoters. Senescence-enhanced promoters are active late in the life cycle of a plant during or near the time of senescence (Noh and Amasino, 1999. supra), and preferentially regulate expression of one or more genes (and any encoded polypeptides) during senescence of a plant cell from a leaf, flower, fruit, or other organ or plant part with respect to the level of expression of that gene in a non-senescing, i.e., a growing or mature (but pre-senescent) cell.

In the instant description, "endogenous" refers to a molecule that naturally originates from within a plant, plant tissue, or plant cell. The term "endogenous polypeptide" refers to a natural or native polypeptide that is encoded by a plant's native gene and thus it originates from within the plant, plant tissue, or plant cell upon its translation.

A "recombinant polynucleotide" is a polynucleotide that is not in its native state, e.g., the polynucleotide comprises a nucleotide sequence not found in nature, or the polynucleotide is in a context other than that in which it is naturally found, e.g., separated from nucleotide sequences with which it typically is in proximity in nature, or adjacent (or contiguous with) nucleotide sequences with which it typically is not in proximity. For example, the sequence at issue can be cloned into a vector, or otherwise recombined with one or more additional nucleic acids. An expression vector or cassette is an example of a "recombinant nucleic acid construct".

A plant refers to a whole plant as well as to a plant part, such as seed, fruit, leaf, or root, plant tissue, plant cells or any other plant material, e.g., a plant explant, as well as to progeny thereof, and to in vitro systems that mimic biochemical or cellular components or processes in a cell.

A "recombinant polypeptide" is a polypeptide produced by translation of a recombinant polynucleotide. A "synthetic polypeptide" is a polypeptide created by consecutive polymerization of isolated amino acid residues using methods well known in the art. An "isolated polypeptide," whether a naturally occurring or a recombinant polypeptide, is more enriched in (or out of) a cell than the polypeptide in its natural state in a wild-type cell, e.g., more than about 5% enriched, more than about 10% enriched, or more than about 20%, or more than about 50%, or more, enriched, i.e., alternatively denoted: 105%, 110%, 120%, 150% or more, enriched relative to wild type standardized at 100%. Such an enrichment is not the result of a natural response of a wild-type plant. Alternatively, or additionally, the isolated polypeptide is separated from other cellular components with which it is typically associated, e.g., by any of the various protein purification methods herein.

"Conserved domains" are recurring units in molecular evolution, the extents of which can be determined by sequence and structure analysis. A "conserved domain" or "conserved region" as used herein refers to a region in heterologous polynucleotide or polypeptide sequences where there is a relatively high degree of sequence identity between the distinct sequences. Conserved domains contain conserved sequence patterns or motifs that allow for their detection in, and identification and characterization of, polypeptide sequences. A DNA-binding domain is an example of a conserved domain.

"Identity" or "similarity" refers to sequence similarity between two polynucleotide sequences or between two polypeptide sequences, with identity being a more strict comparison. The phrases "percent identity" and "% identity" refer to the percentage of sequence similarity found in a comparison of two or more polynucleotide sequences or two or more polypeptide sequences. "Sequence similarity" refers to the percent similarity in base pair sequence (as determined by any suitable method) between two or more polynucleotide sequences. Two or more sequences can be anywhere from 0-100% similar or identical, or any integer value between 0-100%. Identity or similarity can be determined by comparing a position in each sequence that may be aligned for purposes of comparison. When a position in the compared sequence is occupied by the same nucleotide base or amino acid, then the molecules are identical at that position. A degree of similarity or identity between polynucleotide sequences is a function of the number of identical, matching or corresponding nucleotides at positions shared by the polynucleotide sequences. A degree of identity of polypeptide sequences is a function of the number of identical amino acids at corresponding positions shared by the polypeptide sequences. A degree of homology or similarity of polypeptide sequences is a function of the number of amino acids at corresponding positions shared by the polypeptide sequences. The fraction or percentage of components in common is related to the homology or identity between the sequences. An alignment may suitably be determined by means of computer programs known in the art, such as MACVECTOR software, 1999 (Accelrys®, Inc., San Diego, Calif.).

"Nitrogen use efficiency (NUE)" refers to the amount of nitrogen used to produce biomass or grain produced by a plant. Several methods have been developed to estimate NUE. Depending on the plant, either biomass or grain yield is measured. Likewise, estimates of the nitrogen used by the plant include determination of the amount of nitrogen taken up into the plant from soil or the nitrogen content of the plant.

Uptake" refers to the acquisition of nitrogen (in the form of nitrate, ammonium, or amino acids) from the soil by plant roots in plants. Generally, plants adapted to low pH and reducing soils as found in mature forests or arctic tundra tend to take up ammonium or amino acids, whereas plants adapted to higher pH and more aerobic soils prefer nitrate (Maathuis, 2009, *Curr. Opin. Plant Biol.* 12:250-258). Uptake occurs at the root level primarily (although some uptake can occur on the leaf surface in the case of atmospheric deposition) and specific transport systems exist for nitrate, ammonium, and amino acids.

"Assimilation" refers to the reduction of nitrate to ammonium, followed by ammonium assimilation into amino acids. Nitrate reduction to nitrite takes place in both roots and shoots but is spatially separated between the cytoplasm where the reduction takes place and plastids where nitrite reduction to ammonium occurs Ammonium (from nitrate reduction, photorespiration or amino acid recycling) is assimilated into amino acids via GS/GOGAT cycle. Glutamine synthetase (GS) fixes ammonium with glutamate to form glutamine. This glutamine reacts subsequently with 2-oxoglutarate to form two molecules of glutamate catalyzed by the glutamine 2-oxoglutarate amino transferase (or glutamate synthase, GOGAT).

"Usage index (UI)" refers to an estimate of nitrogen use efficiency (NUE). In measuring NUE, several definitions and evaluation methods have been developed (Good et al., (2004) *Trends Plant Sci.* 9:597-605). The "usage index" factors the absolute amount of biomass produced as well as for the ratio of biomass per unit nitrogen (tissue dry weight/nitrogen content). A plant is considered to have a higher usage index when the same amount of biomass is produced with less nitrogen or when more biomass is produced with the same amount of nitrogen compared to control plants.

"Nitrogen uptake efficiency (NupE)" is the ability of the plant to extract nitrogen from soil and fertilizer.

"Limiting nitrogen" refers to growth conditions which include a level (e.g., concentration) of nitrogen is applied which is below the level needed for normal plant metabolism, growth, reproduction and/or viability. Conversely, "ample nitrogen" refers to growth conditions which include a level (e.g., concentration) of nitrogen is applied which in excess of the level needed for normal plant metabolism, growth, reproduction and/or viability.

A "transgenic plant" or "transformed plant" refers to a plant that contains genetic material not found in a wild-type plant of the same species, variety or cultivar. The genetic material may include an expression vector or cassette, a transgene, an insertional mutagenesis event (such as by transposon or T-DNA insertional mutagenesis), an activation tagging sequence, a mutated sequence, a homologous recombination event or a sequence modified by chimeraplasty. Typically, the foreign genetic material has been introduced into the plant by human manipulation, but any method can be used as one of skill in the art recognizes.

A transgenic line or transgenic plant line refers to the progeny plant or plants deriving from the stable integration of heterologous genetic material into a specific location or locations within the genome of the original transformed cell.

An expression vector or cassette typically comprises a polypeptide-encoding sequence operably linked (i.e., under regulatory control of) to appropriate inducible, tissue-enhanced, tissue-specific, developmentally-enhanced, or constitutive regulatory sequences that allow for the controlled expression of the polypeptide. The expression cassette can be introduced into a plant by transformation or by breeding after transformation of a parent plant. A plant refers to a whole plant as well as to a plant part, such as seed, fruit, leaf, or root, plant tissue, plant cells or any other plant material, e.g., a plant explant, as well as to progeny thereof, and to in vitro systems that mimic biochemical or cellular components or processes in a cell.

It is anticipated that a transgenic or transformed plant of the instant disclosure may have enhanced or greater nitrogen uptake relative to a control plant when the transgenic plant is transformed with a recombinant polynucleotide encoding any of the listed sequences, or when the transgenic plant contains or expresses a listed polypeptide, and as a consequence of the expression of the listed polypeptide within the transgenic or transformed plant.

A "seed-bearing structure", as used herein, refers to a plant part that comprises a developing or mature seed, and may include, but is not limited to, an achene, berry, capsule, caryopsis or grain, circumcissile capsule, cypsela, drupe, ear, fruit or ripened pericarp, follicle, grain, kernel, legume, loculicidal capsule, lomentum, nut, pistil, pod, poricidal capsule, samara, schizocarp, seed capsule, septicidal capsule, septifragal capsule, silicula, siliqua, silique or strobilus.

The term "overexpression" as used herein refers to a greater expression level of a gene in a plant, plant cell or plant tissue, compared to expression in a wild-type plant, cell or tissue, at any developmental or temporal stage for the gene. Overexpression can occur when, for example, the genes encoding one or more transcription factors are under the control of a strong expression signal, such as one of the promoters described herein (for example, the cauliflower mosaic virus 35S transcription initiation region). Overexpression may occur throughout a plant or in specific tissues of the plant, depending on the promoter used, as described below.

Overexpression may take place in plant cells normally lacking expression of polypeptides functionally equivalent or identical to the present transcription factors. Overexpression may also occur in plant cells where endogenous expression of the present transcription factors or functionally equivalent molecules normally occurs, but such normal expression is at a lower level. Overexpression thus results in a greater than normal production, or "overproduction" of the transcription factor in the plant, cell or tissue.

A "control plant" as used in the present disclosure refers to a plant such as a cell, seed, plant component, plant tissue, plant organ or whole plant used to compare against an altered or experimental plant such as a transgenic or genetically modified plant for the purpose of identifying an enhanced phenotype in the altered or experimental plant. A control plant may in some cases be a transgenic plant line that comprises an empty vector or marker gene, but does not contain the recombinant polynucleotide of the present description that is expressed in the transgenic or genetically modified plant being evaluated. In general, a control plant is a plant of the same line or variety as the experimental or altered plant being tested. A suitable control plant would include a genetically unaltered or non-transgenic plant of the parental line used to generate a transgenic plant herein.

"Wild type" or "wild-type", as used herein, refers to a plant cell, seed, plant component, plant tissue, plant organ or whole plant that has not been genetically modified or treated in an experimental sense. Wild-type cells, seed, components, tissue, organs or whole plants may be used as controls to compare levels of expression and the extent and nature of trait modification with cells, tissue or plants of the same species in which a polypeptide's expression is altered, e.g., in that it has been knocked out, overexpressed, or ectopically expressed.

A seed-bearing structure or organ refers to a organ of a plant that comprises a seed such as, for example, achene, berry, capsule, caryopsis or grain, circumcissile capsule, cypsela, drupe, ear, fruit or ripened pericarp, follicle, grain, kernel, legume, loculicidal capsule, lomentum, nut, pistil, pod, poricidal capsule, samara, schizocarp, seed capsule, septicidal capsule, septifragal capsule, silicula, siliqua, silique, strobilus, etc.

The term "overexpression" as used herein refers to a greater expression level of a gene in a plant, plant cell or plant tissue, compared to expression of that gene in a wild-type plant, cell or tissue, at any developmental or temporal stage. Overexpression can occur when, for example, the genes encoding one or more polypeptides are under the control of a strong promoter (e.g., the cauliflower mosaic virus 35S transcription initiation region). Overexpression may also be achieved by placing a gene of interest under the control of an inducible or tissue enhanced promoter, or may be achieved through integration of transposons or engineered T-DNA molecules into regulatory regions of a target gene. Other means for inducing overexpression may include making targeted changes in a gene's native promoter, e.g. through elimination of negative regulatory sequences or engineering positive regulatory sequences, though the use of targeted nuclease activity (such as zinc finger nucleases or TAL effector nucleases) for genome editing. Elimination of micro-RNA binding sites in a gene's transcript may also result in overexpression of that gene. Additionally, a gene may be overexpressed by creating an artificial transcriptional activator targeted to bind specifically to its promoter sequences, comprising an engineered sequence-specific DNA binding domain such as a zinc finger protein or TAL effector protein fused to a transcriptional activation domain. Thus, overexpression may occur throughout a plant, in specific tissues of the plant, or in the presence or absence of particular environmental signals, depending on the promoter or overexpression approach used.

Overexpression may take place in plant cells normally lacking expression of polypeptides functionally equivalent or identical to the present polypeptides. Overexpression may also occur in plant cells where endogenous expression of the present polypeptides or functionally equivalent molecules normally occurs, but such normal expression is at a lower level. Overexpression thus results in a greater than normal production, or "overproduction" of the polypeptide in the plant, cell or tissue.

"Yield" or "plant yield" refers to increased plant growth, increased crop growth, increased biomass, and/or increased plant product production (including grain), and is dependent to some extent on temperature, plant size, organ size, planting density, light, water and nutrient availability, and how the plant copes with various stresses, such as through temperature acclimation and water or nutrient use efficiency. Increased or improved yield may be measured as increased seed yield, increased plant product yield (plant products include, for example, plant tissue, including ground or otherwise broken-up plant tissue, and products derived from one or more types of plant tissue), or increased vegetative yield.

DESCRIPTION OF THE SPECIFIC EMBODIMENTS

Improving a plant's ability to take up and utilize nitrogen from the soil is an important agronomic goal. Two important measures of this ability are the nitrogen uptake efficiency (NUpE), defined as the amount of nitrogen taken up per unit of plant biomass, and the Usage Index (UI), defined as plant biomass/% nitrogen. Usage index is accepted as a measurement of nitrogen use efficiency (NUE) for vegetative stage plants. NUpE and UI are controlled both by genetic and environmental factors. Genetic variability in these parameters exists among crop plants. However, genetically identical plants grown on limiting nitrogen have higher NUpE than plants grown under ample nitrogen. Improving NUpE and UI either in limiting or ample nitrogen conditions is expected to improve crop yield. Potential strategies to improve UI or NUpE with the instantly listed sequences or other clade member sequences include increased expression of regulators (or effectors) of nitrogen uptake in roots, leaves, or whole plants.

Polypeptides and Polynucleotides of the Present Description.

The present description includes increased or ectopic expression of putative regulatory polypeptides (i.e., regulators or effectors of nitrogen uptake) and isolated or recombinant polynucleotides encoding the polypeptides, or novel sequence variant polypeptides or polynucleotides encoding novel variants of polypeptides derived from the specific sequences provided in the Sequence Listing. The polynucleotides of the instant description may be incorporated in expression vectors for the purpose of producing transformed plants.

Because of their relatedness at the nucleotide level, the claimed sequences will typically share at least about 40% nucleotide sequence identity, or at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95% or at least 96%, at least 97%, at least 98%, at least 99%, or about 100% sequence identity to one or more of the listed sequences or to the full-length listed sequences (e.g., any of SEQ ID NO: 2n–1, where n=1 to 1131), or to a listed sequence within or outside of the region(s) encoding a known consensus sequence or consensus DNA-binding site, or to a listed conserved domain sequence, or within or outside of the region(s) encoding one or all conserved domains. The degeneracy of the genetic code enables major variations in the nucleotide sequence of a polynucleotide while maintaining the amino acid sequence of the encoded protein.

Because of their relatedness at the protein level, the claimed nucleotide sequences will typically encode a polypeptide that is at least at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 90%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95% or 96%, at least 97%, at least 98%, or at least 99%, or about 100% identical in its amino acid sequence to any of, or the entire length of any of, SEQ ID NOs: 2n, where n=1 to 1131, or 2, 4, 6, 8, or any even integer to 2262.

Also provided are methods for modifying yield from a plant by enhancing the nitrogen use efficiency or a plant's nitrogen uptake of a plant by controlling a number of cellular processes by, for example, introducing into a target plant a gene that encodes a polypeptide that confers enhanced nitrogen uptake. These methods are based on the ability to alter the expression of critical regulatory molecules that may be conserved between diverse plant species. Related conserved regulatory molecules may be originally discovered in a model system such as *Arabidopsis* and homologous, functional molecules then discovered in other plant species. The latter may then be used to confer increased yield or photosynthetic resource use efficiency in diverse plant species.

Sequences in the Sequence Listing, derived from diverse plant species, may be ectopically expressed in overexpressor plants. The changes in the characteristic(s) or trait(s) of the plants may then be observed and found to confer increased yield and/or increased nitrogen use efficiency and/or nitrogen uptake. Therefore, the polynucleotides and polypeptides can be used to improve desirable characteristics of plants.

The polynucleotides of the instant description are also ectopically expressed in overexpressor plant cells and the changes in the expression levels of a number of genes, polynucleotides, and/or proteins of the plant cells observed. Therefore, the polynucleotides and polypeptides can be used to change expression levels of genes, polynucleotides, and/or proteins of plants or plant cells.

The data presented herein represent the results obtained in experiments with polynucleotides and polypeptides that may be expressed in plants for the purpose of increasing yield that arises from improved nitrogen use efficiency and/or nitrogen uptake.

The polynucleotides and polypeptides of the instant description, that, when expressed in plants or crop plant have the capacity to enhance nitrogen uptake in a plant or a part of a plant relative to a control plant or a corresponding part of the control plant, include:

SEQ ID NOs:1 and 2, AT2G24570.1 (G866) and clade member sequences SEQ ID NOs:3-74;

SEQ ID NOs:75 and 76, AT2G37430.1 (G355) and clade member sequences SEQ ID NOs:77-134;

SEQ ID NOs:1 and 136, AT1G07900.1 (G4083) and clade member sequences SEQ ID NOs:137-198;

SEQ ID NOs:199 and 200, AT1G74080.1 (G2340) and clade member sequences SEQ ID NOs:201-204;

SEQ ID NOs:205 and 206, AT1G62300.1 (G184) and clade member sequences SEQ ID NOs:207-286;

SEQ ID NOs:287 and 288, AT1G18860.1 (G2110) and clade member sequences SEQ ID NOs:289-358;

SEQ ID NOs:359 and 360, AT3G23250.1 (G233) and clade member sequences SEQ ID NOs:361-426;

SEQ ID NOs:427 and 428, AT2G26150.1 (G266) and clade member sequences SEQ ID NOs:429-456;

SEQ ID NOs:457 and 458, AT3G15500.1 (G773) and clade member sequences SEQ ID NOs:459-490;

SEQ ID NOs:491 and 492, AT1G16150.1 and clade member sequences SEQ ID NOs:493-538;

SEQ ID NOs:539 and 540, AT1G51800.1 and clade member sequences SEQ ID NOs:541-758;

SEQ ID NOs:759 and 760, AT1G61440.1 and clade member sequences SEQ ID NOs:761-950;

SEQ ID NOs:951 and 952, AT4G11470.1, SEQ ID NOs: 953 and 954, and AT4G11480.1 and clade member sequences SEQ ID NOs:955-1212;

SEQ ID NOs:1213 and 1214, AT5G14640.1 and clade member sequences SEQ ID NOs: 1215-1374;

SEQ ID NOs:1375 and 1376, AT5G06740.1 and clade member sequences SEQ ID NOs: 1377-1400;

SEQ ID NOs:1401 and 1402, AT2G19190.1 and clade member sequences SEQ ID NOs:1403-1672;

SEQ ID NOs:1673 and 1674, AT1G57560.1 (G1319) and clade member sequences SEQ ID NOs: 1675-1752;

SEQ ID NOs:1753 and 1754, AT2G46510.1 (G1665) and clade member sequences SEQ ID NOs: 1755-1786;

SEQ ID NOs:1787 and 1788, AT5G54900.1 (G1940) and clade member sequences SEQ ID NOs: 1789-1920;

SEQ ID NOs:1921 and 1922, AT3G05200.1 (G2239) and clade member sequences SEQ ID NOs: 1923-2026;

SEQ ID NOs:2027 and 2028, AT2G34450.2 (G2898) and clade member sequences SEQ ID NOs:2029-2054;

SEQ ID NOs:2055 and 2056, AT5G26930.1 (G348) and clade member sequences SEQ ID NOs:2057-2090;

SEQ ID NOs:2091 and 2092, AT4G20380.1 (G347) and clade member sequences SEQ ID NOs:2093-2166;

SEQ ID NOs:2167 and 2168, AT1G09030.1 (G486) and clade member sequences SEQ ID NOs:2169-2242; and SEQ ID NOs:2243 and 2244, AT2G43260.1 (G1466) and clade member sequences SEQ ID NOs:2245-2262.

Variants of the Disclosed Sequences.

Also within the scope of the instant description is a variant of a nucleic acid provided in the Sequence Listing, that is, one having a sequence that differs from the one of the polynucleotide sequences in the Sequence Listing, or a complementary sequence, that encodes a functionally equivalent polypeptide (i.e., a polypeptide having some degree of equivalent or similar biological activity). The variant nucleic acid may, for example, encode the same polypeptide but differ in sequence from the sequence in the Sequence Listing due to degeneracy in the genetic code. Included within this definition are polymorphisms that may or may not be readily detectable using a particular oligonucleotide probe of the polynucleotide encoding polypeptide, and improper or unexpected hybridization to allelic variants, with a locus other than the normal chromosomal locus for the polynucleotide sequence encoding polypeptide.

Differences between presently disclosed polypeptides and polypeptide variants are limited so that the sequences of the former and the latter are closely similar overall and, in many regions, identical. Presently disclosed polypeptide sequences and similar polypeptide variants may differ in amino acid sequence by one or more substitutions, additions, deletions, fusions and truncations, which may be present in any combination. These differences may produce silent changes and result in functionally equivalent polypeptides. Thus, it will be readily appreciated by those of skill in the art, that any of a variety of polynucleotide sequences is capable of encoding the polypeptides and homolog polypeptides of the instant description. A polypeptide sequence variant may have "conservative" changes, wherein a substituted amino acid has similar structural or chemical properties.

Conservative substitutions include substitutions in which at least one residue in the amino acid sequence has been removed and a different residue inserted in its place. Such substitutions generally are made in accordance with the Table 1 when it is desired to maintain the activity of the protein. Table 1 shows amino acids which can be substituted for an amino acid in a protein and which are typically regarded as conservative substitutions.

TABLE 1

Possible conservative amino acid substitutions

| Amino Acid Residue | Conservative substitutions |
|---|---|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Pro | Gly |
| Ser | Thr; Gly |
| Thr | Ser; Val |
| Trp | Tyr |
| Tyr | Trp; Phe |
| Val | Ile; Leu |

The polypeptides provided in the Sequence Listing have a novel activity, such as, for example, a regulatory activity. Although all conservative amino acid substitutions (for example, one basic amino acid substituted for another basic amino acid) in a polypeptide will not necessarily result in the polypeptide retaining its activity, it is expected that many of these conservative mutations would result in the polypeptide retaining its activity. Most mutations, conservative or non-conservative, made to a protein but outside of a conserved domain required for function and protein activity will not affect the activity of the protein to any great extent.

Deliberate amino acid substitutions may thus be made on the basis of similarity in polarity, charge, solubility, hydrophobicity, hydrophilicity, and/or the amphipathic nature of the residues, as long as a significant amount of the functional or biological activity of the polypeptide is retained. For example, negatively charged amino acids may include aspartic acid and glutamic acid, positively charged amino acids may include lysine and arginine, and amino acids with uncharged polar head groups having similar hydrophilicity values may include leucine, isoleucine, and valine; glycine and alanine; asparagine and glutamine; serine and threonine; and phenylalanine and tyrosine. More rarely, a variant may have "non-conservative" changes, e.g., replacement of a glycine with a tryptophan. Similar minor variations may also include amino acid deletions or insertions, or both. Related polypeptides may comprise, for example, additions and/or deletions of one or more N-linked or 0-linked glycosylation sites, or an addition and/or a deletion of one or more cysteine residues. Guidance in determining which and how many amino acid residues may be substituted, inserted or deleted without abolishing functional or biological activity may be found using computer programs well known in the art, for example, DNASTAR software (see U.S. Pat. No. 5,840, 544).

Conserved Domains.

Conserved domains are recurring functional and/or structural units of a protein sequence within a protein family (for example, a family of regulatory proteins), and distinct conserved domains have been used as building blocks in molecular evolution and recombined in various arrangements to make proteins of different protein families with different functions. Conserved domains often correspond to the 3-dimensional domains of proteins and contain conserved sequence patterns or motifs, which allow for their detection in polypeptide sequences with, for example, the use of a Conserved Domain Database (for example, at www.ncbi.nlm.nih.gov/cdd). The National Center for Biotechnology Information Conserved Domain Database defines conserved domains as recurring units in molecular evolution, the extents of which can be determined by sequence and structure analysis. Conserved domains contain conserved sequence patterns or motifs, which allow for their detection in polypeptide sequences (Conserved Domain Database; www.ncbi.nlm.nih.gov/Structure/cdd/cdd.shtml). A "conserved domain" or "conserved region" as used herein refers to a region in heterologous polynucleotide or polypeptide sequences where there is a relatively high degree of sequence identity between the distinct sequences. A 'Myb DNA binding domain 1' is an example of a conserved domain.

Conserved domains may also be identified as regions or domains of identity to a specific consensus sequence (see, for example, Riechmann et al., 2000, *Science* 290, 2105-2110; Riechmann et al., 2000, *Curr Opin Plant Biol* 3: 423-434). Thus, by using alignment methods well known in the art, the conserved domains of the plant polypeptides, for example, for the first or second Myb DNA binding domain proteins may be determined. The polypeptides in Table 2 have conserved domains specifically indicated by amino acid coordinate start and stop sites. A comparison of the regions of these polypeptides allows one of skill in the art (see, for example, Reeves and Nissen, 1990. *J. Biol. Chem.* 265, 8573-8582; Reeves and Nissen, 1995. *Prog. Cell Cycle Res.* 1: 339-349) to identify domains or conserved domains for any of the polypeptides listed or referred to in this disclosure.

Conserved domain models are generally identified with multiple sequence alignments of related proteins spanning a variety of organisms. These alignments reveal sequence regions containing the same, or similar, patterns of amino acids. Multiple sequence alignments, three-dimensional structure and three-dimensional structure superposition of conserved domains can be used to infer sequence, structure, and functional relationships (Conserved Domain Database, supra). Since the presence of a particular conserved domain within a polypeptide is highly correlated with an evolutionarily conserved function, a conserved domain database may be used to identify the amino acids in a protein sequence that are putatively involved in functions such as binding or catalysis, as mapped from conserved domain annotations to the query sequence. For example, the presence in a protein of a DNA binding domain that is structurally and phylogenetically similar to one or more domains found in the sequence listing would be a strong indicator of a related function in plants (e.g., the function of regulating and/or improving nitrogen use efficiency, nitrogen uptake, and/or yield, i.e., a polypeptide with such a domain is expected to confer enhanced nitrogen use efficiency, nitrogen uptake, and/or yield when its expression level is increased under the regulatory control of a tissue-enhanced promoter). Sequences herein referred to as functionally-related and/or closely-related to the sequences or domains provided in the Sequence Listing, including polypeptides that are closely related to the polypeptides of the instant description, may have conserved domains that share at least at least nine base pairs (bp) in length and at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 90%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95% or 96%, at least 97%, at least 98%, or at least 99%, or about 100% amino acid sequence identity to the sequences provided in the Sequence Listing, and have similar functions in that the polypeptides of the instant description, where the presence of the listed or claimed domains in said polypeptides is positively correlated or associated with the function(s) of said polypeptides in plants. Said polypeptides may, when their expression level is altered and confer at least one regulatory activity selected from the group consisting of enhanced nitrogen uptake and/or assimilation, as measured by such parameters as Nitrogen Uptake Efficiency (NUpE) or Usage Index (UI), increased nitrogen use efficiency, greater yield, greater size, greater biomass, and/or greater vigor as compared to a control plant.

Methods using manual alignment of sequences similar or homologous to one or more polynucleotide sequences or one or more polypeptides encoded by the polynucleotide sequences may be used to identify regions of similarity and conserved domains (e.g., DNA binding domains, activation domains, localization domains, repression domains, oligomerization domains, or other domains that are recognizably related across plant species. Such manual methods are well-known of those of skill in the art and can include, for example, comparisons of tertiary structure between a polypeptide sequence encoded by a polynucleotide that comprises a known function and a polypeptide sequence encoded by a polynucleotide sequence that has a function not yet determined. Such examples of tertiary structure may comprise predicted α-helices, β-sheets, amphipathic helices, leucine zipper motifs, zinc finger motifs, proline-rich regions, cysteine repeat motifs, and the like.

With respect to polynucleotides encoding presently disclosed polypeptides, a conserved domain refers to a subsequence within a polypeptide family the presence of which is correlated with at least one function exhibited by members of the polypeptide family, and which exhibits a high degree of sequence homology, such as at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 90%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95% or 96%, at least 97%, at least 98%, or at least 99%, or about 100% identity to a conserved domain (e.g., any of SEQ ID NOs: 2263-2312) of a polypeptide (e.g., any of SEQ ID NOs: 2n, where n=1 to 1131) of the Sequence Listing. Sequences that possess or encode for conserved domains that meet these criteria of percentage identity, and that have comparable biological and regulatory activity to the present polypeptide sequences. Sequences having lesser degrees of identity but comparable biological activity are considered to be equivalents.

Table 2 lists *Arabidopsis* sequence identifiers and the descriptions of various domains found within the respective proteins, including the domain names, the linear coordinates of the amino acids at the beginning and end of the respective domains, and the SEQ ID NOs: of the domains listed in this table. It is expected that domains of clade member polypeptides of each of these sequences, examples of said polypeptides being provided in the Sequence Listing, function similarly in plants and their presence is indicative of and correlated with the same functions as the domains in the *Arabidopsis* sequences.

TABLE 2

Various *Arabidopsis* domains found in polypeptide sequences that enhance nitrogen uptake in plants

| Sequence | Domain Name | Starting amino acid in protein sequence | Last amino acid in protein sequence | SEQ ID NO: of Domain |
|---|---|---|---|---|
| AT1G16150.1 | Wall-associated receptor kinase galacturonan-binding | 51 | 144 | 2263 |
| AT1G16150.1 | Wall-associated kinase | 174 | 279 | 2264 |
| AT1G16150.1 | protein kinase catalytic (PKc) domain | 442 | 708 | 2265 |
| AT1G57560.1 | Myb domain 1 (AKA SANT domain) | 14 | 61 | 2266 |
| AT1G57560.1 | Myb domain 2 (AKA SANT domain) | 67 | 112 | 2267 |
| AT1G09030.1 | CCAAT-binding transcription factor (NF-YB) | 6 | 71 | 2268 |
| AT1G51800.1 | Malectin-like | 32 | 353 | 2269 |
| AT1G51800.1 | Leucine rich repeat (LRR8) | 412 | 468 | 2270 |
| AT1G51800.1 | protein kinase catalytic (PKc) domain | 609 | 855 | 2271 |
| AT1G18860.1 | WRKY DNA binding domain | 191 | 248 | 2272 |
| AT1G61440.1 | Bulb-type mannose-specific lectin | 24 | 139 | 2273 |
| AT1G61440.1 | S-locus glycoprotein family | 198 | 305 | 2274 |
| AT1G61440.1 | PAN/APPLE-like domain | 322 | 407 | 2275 |
| AT1G61440.1 | Tyrosine kinase catalytic (TyrKc) domain | 479 | 741 | 2276 |
| AT1G07900.1 | Lateral organ boundaries (LOB) domain | 34 | 133 | 2277 |
| AT1G74080.1 | SANT (aka Myb) | 16 | 61 | 2278 |
| AT11G74080.1 | SANT (aka Myb) | 69 | 112 | 2279 |
| AT2G43260.1 | F-box-associated domain | 102 | 294 | 2280 |
| AT2G26150.1 | HSF DNA binding domain | 44 | 136 | 2281 |
| AT2G46510.1 | N-terminal domain associated with bHLH-MYC domain | 48 | 239 | 2282 |
| AT2G46510.1 | Helix-loop-helix domain (HLH) | 394 | 445 | 2283 |
| AT2G19190.1 | Malectin-like | 33 | 359 | 2284 |
| AT2G19190.1 | Leucine rich repeat (LRR8) | 415 | 474 | 2285 |
| AT2G19190.1 | protein kinase catalytic (PKc) domain | 580 | 766 | 2286 |
| AT2G37430.1 | C2H2-type zinc finger | 47 | 72 | 2287 |
| AT2G37430.1 | C2H2-type zinc finger | 93 | 118 | 2288 |
| AT2G24570.1 | Plant zinc cluster domain | 191 | 240 | 2289 |
| AT2G24570.1 | WRKY DNA-binding domain | 242 | 300 | 2290 |

TABLE 2-continued

Various *Arabidopsis* domains found in polypeptide sequences that enhance nitrogen uptake in plants

| Sequence | Domain Name | Starting amino acid in protein sequence | Last amino acid in protein sequence | SEQ ID NO: of Domain |
|---|---|---|---|---|
| AT2G34450.2 | High mobility group box | 63 | 129 | 2291 |
| AT3G05200.1 | C3HC4 RING finger | 125 | 171 | 2292 |
| AT3G23250.1 | SANT (aka Myb) | 16 | 61 | 2293 |
| AT3G23250.1 | SANT (aka Myb) | 69 | 112 | 2294 |
| AT3G15500.1 | NAM | 14 | 140 | 2295 |
| AT4G22070.1 | WRKY | 298 | 354 | 2296 |
| AT4G11470.1 | Salt stress response/antifungal | 23 | 130 | 2297 |
| AT4G11470.1 | Salt stress response/antifungal | 189 | 245 | 2298 |
| AT4G11470.1 | Tyrosine kinase catalytic (TyrKc) domain | 342 | 611 | 2299 |
| AT4G11480.1 | Salt stress response/antifungal | 23 | 126 | 2300 |
| AT4G11480.1 | Salt stress response/antifungal | 142 | 236 | 2301 |
| AT4G11480.1 | Protein kinase catalytic (PKc) domain | 325 | 602 | 2302 |
| AT4G20380.1 | LSD1 zinc finger | 4 | 34 | 2303 |
| AT4G20380.1 | LSD1 zinc finger | 45 | 75 | 2304 |
| AT4G20380.1 | LSD1 zinc finger | 95 | 119 | 2305 |
| AT5G54900.1 | RNA recognition motif 1 | 61 | 141 | 2306 |
| AT5G54900.1 | RNA recognition motif 2 | 153 | 232 | 2307 |
| AT5G54900.1 | RNA recognition motif 3 | 260 | 332 | 2308 |
| AT5G06740.1 | lectin domain | 25 | 257 | 2309 |
| AT5G06740.1 | Protein tyrosine kinase | 335 | 606 | 2310 |
| AT5G26930.1 | GATA zinc finger | 28 | 62 | 2311 |
| AT5G14640.1 | Protein kinase domain | 77 | 358 | 2312 |

Orthologs and Paralogs.

Homologous sequences as described above can comprise orthologous or paralogous sequences. Several different methods are known by those of skill in the art for identifying and defining these functionally homologous sequences. General methods for identifying orthologs and paralogs, including phylogenetic methods, sequence similarity and hybridization methods, are described herein; an ortholog or paralog, including equivalogs, may be identified by one or more of the methods described below.

As described by Eisen, 1998. *Genome Res.* 8: 163-167, evolutionary information may be used to predict gene function. It is common for groups of genes that are homologous in sequence to have diverse, although usually related, functions. However, in many cases, the identification of homologs is not sufficient to make specific predictions because not all homologs have the same function. Thus, an initial analysis of functional relatedness based on sequence similarity alone may not provide one with a means to determine where similarity ends and functional relatedness begins. Fortunately, it is well known in the art that protein function can be classified using phylogenetic analysis of gene trees combined with the corresponding species. Functional predictions can be greatly improved by focusing on how the genes became similar in sequence (i.e., by evolutionary processes) rather than on the sequence similarity itself (Eisen, supra). In fact, many specific examples exist in which gene function has been shown to correlate well with gene phylogeny (Eisen, supra). Thus, "[t]he first step in making functional predictions is the generation of a phylogenetic tree representing the evolutionary history of the gene of interest and its homologs. Such trees are distinct from clusters and other means of characterizing sequence similarity because they are inferred by techniques that help convert patterns of similarity into evolutionary relationships . . . . After the gene tree is inferred, biologically determined functions of the various homologs are overlaid onto the tree. Finally, the structure of the tree and the relative phylogenetic positions of genes of different functions are used to trace the history of functional changes, which is then used to predict functions of [as yet] uncharacterized genes" (Eisen, supra).

Within a single plant species, gene duplication may cause two copies of a particular gene, giving rise to two or more genes with similar sequence and often similar function known as paralogs. A paralog is therefore a similar gene formed by duplication within the same species. Paralogs typically cluster together or in the same clade (a group of similar genes) when a gene family phylogeny is analyzed using programs such as CLUSTAL (Thompson et al., 1994, *Nucleic Acids Res.* 22: 4673-4680; Higgins et al., 1996, *Methods Enzymol.* 266: 383-402). Groups of similar genes can also be identified with pair-wise BLAST analysis (Feng and Doolittle, 1987, *J. Mol. Evol.* 25: 351-360). For example, a clade of very similar MADS domain transcription factors from *Arabidopsis* all share a common function in flowering time (Ratcliffe et al., 2001, *Plant Physiol.* 126: 122-132), and a group of very similar AP2 domain transcription factors from *Arabidopsis* are involved in tolerance of plants to freezing (Gilmour et al., 1998, supra). Analysis of groups of similar genes with similar function that fall within one clade can yield sub-sequences that are particular to the clade. These sub-sequences, known as consensus sequences, can not only be used to define the sequences within each clade, but define the functions of these genes; genes within a clade may contain paralogous sequences, or orthologous sequences that share the same function (see also, for example, Mount, 2001, in *Bioinformatics: Sequence and Genome Analysis*, Cold Spring Harbor Laboratory Press, Cold Spring Harbor, N.Y., p. 543)

Regulatory polypeptide gene sequences are conserved across diverse eukaryotic species lines (Goodrich et al., 1993. *Cell* 75:519-530; Lin et al., 1991, *Nature* 353:569-571; Sadowski et al., 1988, *Nature* 335: 563-564). Plants are no exception to this observation; diverse plant species possess regulatory polypeptides that have similar sequences and functions. Speciation, the production of new species from a parental species, gives rise to two or more genes with similar sequence and similar function. These genes, termed orthologs, often have an identical function within their host plants and are often interchangeable between species without losing function. Because plants have common ancestors, many genes in any plant species will have a corresponding orthologous gene in another plant species. Once a phylogenic tree for a gene family of one species has been constructed using a program such as CLUSTAL (Thompson et al., 1994, supra; Higgins et al., 1996, supra) potential orthologous sequences can be placed into the phylogenetic tree and their relationship to genes from the species of interest can be determined. Orthologous sequences can also be identified by a reciprocal BLAST strategy. Once an orthologous sequence has been identified, the function of the ortholog can be deduced from the identified function of the reference sequence.

The polypeptides sequences belong to distinct clades of polypeptides that include members from diverse species. In each case, most or all of the clade member sequences derived from both eudicots and monocots have been shown and are predicted to enhance nitrogen uptake to confer increased yield when the sequences were overexpressed under the regulatory control of, for example, a root, root cap, root meristem, root vasculature, vascular, and/or green tissue-enhanced promoter. These studies each demonstrate that evolutionarily conserved genes from diverse species are likely to function similarly (i.e., by regulating similar target sequences and controlling the same traits), and that polynucleotides from one species may be transformed into closely-related or distantly-related plant species to confer or improve traits.

Orthologs and paralogs of presently disclosed polypeptides may be cloned using compositions provided by the present description according to methods well known in the art. cDNAs can be cloned using mRNA from a plant cell or tissue that expresses one of the present sequences. Appropriate mRNA sources may be identified by interrogating Northern blots with probes designed from the present sequences, after which a library is prepared from the mRNA obtained from a positive cell or tissue. Polypeptide-encoding cDNA is then isolated using, for example, PCR, using primers designed from a presently disclosed gene sequence, or by probing with a partial or complete cDNA or with one or more sets of degenerate probes based on the disclosed sequences. The cDNA library may be used to transform plant cells. Expression of the cDNAs of interest is detected using, for example, microarrays, Northern blots, quantitative PCR, or any other technique for monitoring changes in expression. Genomic clones may be isolated using similar techniques to those.

Examples of orthologs of the *Arabidopsis* polypeptide sequences and their functionally similar orthologs are listed in the present Sequence Listing. In addition to the *Arabidopsis* polypeptide sequences in the Sequence Listing, these orthologs are phylogenetically and structurally similar to the sequences in the Sequence Listing and can also function in a plant by increasing nitrogen use efficiency, nitrogen uptake, yield, vigor, and/or biomass when ectopically and preferentially expressed in a plant or in a plant organ. Since a significant number of these sequences are phylogenetically and sequentially related to each other and may be shown to increase yield from a plant and/or nitrogen uptake, one skilled in the art would predict that other similar, phylogenetically related sequences, including those falling within the present clades of polypeptides or having the same consensus sequences or which are sequentially similar, having a disclosed minimum percentage identity to one another or the listed *Arabidopsis* polypeptide, would also perform similar functions when ectopically expressed under the regulatory control of the disclosed promoters or other root, root cap, root meristem, root vasculature, vascular, and/or green tissue-enhanced promoters.

Promoters.

The tissue-enhanced promoters in Table 3 preferentially regulate gene expression in root, root cap, root meristem, root vasculature, and/or vascular tissue structures or organs relative to other tissues in a plant. Examples of tissue-enhanced promoters may also be found in the Sequence Listing as SEQ ID NOs: 2313 to 2349.

The choice of promoter may also include a constitutive promoter or a promoter with enhanced activity in a tissue capable of photosynthesis (also referred to herein as a "green tissue promoter", a "photosynthetic promoter" or a "photosynthetic tissue-enhanced promoter") such as a leaf tissue or other green tissue. Examples of photosynthetic or green tissue promoters include for example, an RBCS3 promoter (SEQ ID NO: 2323), an RBCS4 promoter (SEQ ID NO: 2324) others such as the At4g01060 promoter (SEQ ID NO: 2325), the latter regulating expression in a guard cell, or rice sequences SEQ ID NOs: 2326 to 2349, shown in Table 3 or in the Sequence Listing.

TABLE 3

Exemplary promoters

| Promoter | SEQ ID NO | Organism from which promoter is derived | Tissue | Reference |
|---|---|---|---|---|
| Os03g01700 | 2350 | rice | root | Li et al., 2013. Plant Sci. 207:37-44 |
| Os02g37190 | 2351 | rice | root | Li et al., 2013. Plant Sci. 207:37-44 |
| rolD | 2352 | *Agrobacterium rhizogenes* | root | Leach and Aoyagi. 1991. Plant Sci. 79:69-76 |
| RCc3 | 2353 | rice | root | Xu et al. 1995. Plant Mol. Biol. 27:237-248 |
| TobRB7 | 2354 | tobacco | root | Yamamoto, et al. 1991. Plant Cell 3:371-382 |
| Pyk10 | 2355 | *Arabidopsis* | root | Nitz et al. 2001. Plant Sci. 161:337-346 |
| PmPR10-1.14 | | *Pinus monticola* | root | Liu and Ekramoddoullah. 2003. Plant Mol. Biol. 52:103-120 |
| HvPht1;1 | 2356 | barley | root | Schünmann et al. 2004. J. Exp. Bot. 55:855-865 |
| HvPht1;2 | 2357 | barley | root | Schünmann 2004. J. Exp. Bot. 55:855-865 |
| MsPRP2 | | alfalfa | root | Winicov et al. 2004. Planta 219:925-935 |

TABLE 3-continued

Exemplary promoters

| Promoter | SEQ ID NO | Organism from which promoter is derived | Tissue | Reference |
|---|---|---|---|---|
| PHT1 | 2358 | *Arabidopsis* | root | Koyama et al. 2005. J. Biosci. Bioeng. 99: 38-42 |
| At1g73160 | 2359 | *Arabidopsis* | root | Vijaybhaskar et al. 2008. J. Biosci. 33; 185-193 |
| AtCel5 | 2360 | *Arabidopsis* | root cap | del Campillo et al. 2004. Plant Mol. Biol. 56: 309-323 |
| ARSK1 | 2361 | *Arabidopsis* | root | Hwang and Goodman. 1995. Plant J. 8:37-43 |
| RSI1 | 2362 | tomato | root meristem and vasculature | Taylor and Scheuring 1994. Mol. Gen. Genet. 243:148-157 |
| AT2G39850 | 2313 | *Arabidopsis* | vascular | SEQ ID NO: 27 of US patent pub. US20110179520 |
| AT2G03500 | 2314 | *Arabidopsis* | vascular | SEQ ID NO: 22 US patent pub. US20110179520 |
| AT3G42670 | 2315 | *Arabidopsis* | vascular | SEQ ID NO: 34 US patent pub. US20110179520 |
| AT1G24735 | 2316 | *Arabidopsis* | vascular | SEQ ID NO: 5 US patent pub. U520110179520 |
| AT5G56530 | 2317 | *Arabidopsis* | vascular | SEQ ID NO: 63 US patent pub. US20110179520 |
| AT3G12750 | 2318 | *Arabidopsis* | vascular | SEQ ID NO: 29 US patent pub. U520110179520 |
| AT3G16340 | 2319 | *Arabidopsis* | vascular | SEQ ID NO: 31 US patent pub. US20110179520 |
| AT1G65150 | 2320 | *Arabidopsis* | vascular | SEQ ID NO: 16 US patent pub. U520110179520 |
| AT5G27690 | 2321 | *Arabidopsis* | vascular | SEQ ID NO: 58 US patent pub. U520110179520 |
| AT1G10155 | 2322 | *Arabidopsis* | vascular | SEQ ID NO: 2 US patent pub. U520110179520 |
| SUC2 | 2363 | *Arabidopsis* | vascular | Truernit and Sauer. 1995. Planta 196:564-570 |
| CoYMV |  | Commelina yellow mottle virus | vascular | Medberry et al. 1992. Plant Cell 4:185-192 |
| Sucrose synthase |  | Rice | vascular | Wang et al. 1992. Plant Mol. Biol. 19:881-885 |
| Sucrose synthase | 2364 | maize | vascular | Yang and Russell. 1980. Proc. Natl Acad. Sci. USA 87:4144-4148 |
| GmSBP2 | 2365 | Glycine max | vascular | Waclawovsky et al. 2006. BBA-Gene Struct. Expr. 1759:89-98 |
| Rplec2 | 2366 | *Robinia pseudoacacia* | vascular | Yoshida et al. 2002. J. Plant Physiol. 159:757-764 |
| PP2 |  | *Cucurbita maxima* | vascular | Jiang et al. 1999. J. Agric. Biotechnol. 7:63-68 |
| PP2 |  | *Cucurbita maxima* | vascular | Thompson and Larkins. 1996. US patent pub. U5005495007A |
| rolC | 2367 | *Agrobacterium rhizogenes* | vascular | Schmulling et al. 1989. Plant Cell 1:665-670 |
| RTBV |  | rice tungro bacilliform virus | vascular | Yin and Beachy. 1997. Plant J. 12:1179-1188 |
| DX1 (Os12g33120) | 2368 | rice | green tissue | Zhou and Lin. 2012. Plant Cell Rep. 31:1159-1172. doi:10.1007/s00299-012-1238-8 |
| RBCS3 | 2323 | tomato | green tissue | Wanner and Gruissem. 1991. Plant Cell 3: 1289-1303 |
| RBCS4/RBCS1A | 2324 | *Arabidopsis* | green tissue |  |
| PEPC | 2369 | maize | green tissue | Koziel et al. 1993. Nature Biotechnol. 11:194-200 |
| prG682 At4g01060 | 2325 | *Arabidopsis* | guard cell |  |
| Os02g09720 | 2326 | rice | green tissue |  |
| Os05g34510 | 2327 | rice | green tissue |  |
| Os11g08230 | 2328 | rice | green tissue |  |
| Os01g64390 | 2329 | rice | green tissue |  |
| Os06g15760 | 2330 | rice | green tissue |  |
| Os12g37560 | 2331 | rice | green tissue |  |
| Os03g17420 | 2332 | rice | green tissue |  |
| Os04g51000 | 2333 | rice | green tissue |  |
| Os01g01960 | 2334 | rice | green tissue |  |
| Os05g04990 | 2335 | rice | green tissue |  |
| Os02g44970 | 2336 | rice | green tissue |  |
| Os01g25530 | 2337 | rice | green tissue |  |

TABLE 3-continued

Exemplary promoters

| Promoter | SEQ ID NO | Organism from which promoter is derived | Tissue | Reference |
|---|---|---|---|---|
| Os03g30650 | 2338 | rice | green tissue | |
| Os01g64910 | 2339 | rice | green tissue | |
| Os07g26810 | 2340 | rice | green tissue | |
| Os07g26820 | 2341 | rice | green tissue | |
| Os09g11220 | 2342 | rice | green tissue | |
| Os04g21800 | 2343 | rice | green tissue | |
| Os10g23840 | 2344 | rice | green tissue | |
| Os08g13850 | 2345 | rice | green tissue | |
| Os12g42980 | 2346 | rice | green tissue | |
| Os03g29280 | 2347 | rice | green tissue | |
| Os03g20650 | 2348 | rice | green tissue | |
| Os06g43920 | 2349 | rice | green tissue | |
| psaDb | | tobacco | green tissue | Yamamoto et al. 1997. Plant J. 12:255-265 |
| gapb | 2370 | Arabidopsis | green tissue | Kwon et al. 1994. Plant Physiol. 105:357-367 |
| cab 1 | | wheat | green tissue | Gotor et al. 1993. Plant J. 3:509-518 |
| cab 6 | | pine | green tissue | Yamamoto et al. 1994. Plant Cell Physiol. 35:773-778 |
| rbcs activase | | spinach | green tissue | Orozco et al. 1993. Plant Mol. Biol. 23: 1129-1138 |
| ppdk | 2371 | maize | green tissue | Matsuoka et al. 1993. Proc. Natl. Acad. Sci. USA 90:9586-9590 |
| lhcb1 * 2 | 2372 | tobacco | green tissue | Cerdan et al. 1997. Plant Mol. Biol. 33:245-255 |

EXAMPLES

It is to be understood that this description is not limited to the particular devices, machines, materials and methods described. Although particular embodiments are described, equivalent embodiments may be used to practice the claims.

The specification, now being generally described, will be more readily understood by reference to the following examples, which are included merely for purposes of illustration of certain aspects and embodiments of the present description and are not intended to limit the claims or description. It will be recognized by one of skill in the art that a polypeptide that is associated with a particular first trait may also be associated with at least one other, unrelated and inherent second trait which was not predicted by the first trait.

Example I. Identification of Regulators of UI and NUpE Through Gene Expression Profiling Plants grown under limiting nitrogen conditions take up and utilize nitrogen more efficiently than do plants grown under ample nitrogen. To elucidate the regulatory networks controlling these differences, a transcriptional profiling experiment was performed on *Arabidopsis* plants grown under conditions of limiting (2 mM) and ample (10 mM) nitrogen. Leaf and silique tissue were harvested beginning in the vegetative phase and continuing through seed development to create a developmental time series under these two different nutrient regimes.

Plant Growth and Tissue Isolation.

Plants were grown in pots containing three volumes of fritted clay at bottom and one volume of fine sand on top. Pots were pre-soaked in nutrient solution containing either 2 mM (low N) or 10 mM (high N) nitrate solution. Phosphate (0.25 mM), sulfate (0.25 mM), magnesium (0.25 mM), and sodium (0.20 mM) were present in both solutions at the same concentration. The difference between low and high N solutions affects only potassium (5.25 mM and 2.75 mM in high and low N solutions, respectively), calcium (2.50 mM and 0.50 mM, respectively), and chloride ions (0.25 mM and 0.70 mM, respectively). Pots were placed in Conviron growth chambers at a day temperature of 22° C. (19° C. night) with a 16 hr photoperiod at an initial light intensity of ~100 µmol m−2 s−1 and a final light intensity of −140 µmol m−2 s−1 at plant height. After two weeks, flats were moved to a commercial ebb and flow hydroponic system (Bigfoot, American Hydroponics, Arcata, Calif.) in an Enconair growth chamber with a 16 hr photoperiod at a light intensity of 140 µmol m−2 s−1 at plant height, and a 22° C. day temperature (19° C. night). Plants were supplied with nutrient solution containing 2 mM or 10 mM nitrate through a pumping system once every 8 hrs.

Leaf 7 (the seventh leaf formed by each plant) was tagged with thread 21 days after sowing ("days after sowing" abbreviation: DAS). Collection of leaf 7 was started at 22 DAS and continued every other day until 42 DAS, for a total of 11 time points. Sampling of siliques started when siliques reached stage 16 (floral organs withering) and 2, 4, 6, and 8 days post stage 16, for a total of five time points. At each time point, leaf 7 and siliques were harvested from 10-12 plants and eight plants, respectively, with plants being selected to minimize any potential effects of position within the hydroponic tub and growth room.

RNA Isolation.

Leaves were pulverized in liquid nitrogen with a mortar and pestle. Approximately 100 µl of frozen tissue was combined with buffer RA1 with 1% β-mercaptoethanol (NucleoSpin® 96 RNA, Macherey-Nagel, Bethlehem, Pa.), and total RNA was isolated according to the manufacturer's specifications and implemented as a custom method on a Biomek® FX$^P$ (Beckman Coulter, Brea, Calif.) liquid handling workstation. In some cases, RNA yields were too low to satisfy the target of 2 µg for making adapter libraries. In these cases a second aliquot of 100 µL tissue was taken to perform an additional RNA extraction. RNA from the second extraction was used if the yield was sufficient. Otherwise, RNA was pooled from both extractions.

Silique RNA was extracted following a modified protocol (Meng and Feldman, 2010, *Biotechnol. J.* 5: 183-186). This procedure employs a modified, high pH (pH 9.5) extraction buffer. An RNAeasy® kit (Quiagen, Hilden, Germany) was subsequently used to purify the RNA.

Sequence Library Creation.

The starting total RNA concentration was measured using a NanoDrop® Spectrophotometer (Thermo Scientific™, Waltham, Mass.) and 2 µg of total RNA was used as the entry point to the TruSeq RNA Sample Prep method (15008136_A, Illumina®, San Diego, Calif.). All steps were performed according to manufacturer specifications as indicated in the High-Throughput (HT) Protocol, but implemented as a custom method on a Biomek $FX^P$ liquid handling workstation. In brief, poly-A containing mRNA molecules were purified using poly-T oligo-attached magnetic beads (2-rounds), fragmented with heat to a size of 120-200 bp, and then reverse transcribed using random hexamer primers. Double stranded cDNA was produced and indexed adapters were attached by ligation (Illumina, Inc.). Library size distribution was assessed by capillary gel electrophoresis, and then normalized based on quantification based on absorbance, fluorescence and quantitative polymerase chain reaction (qPCR) using primers targeting the adapter sequences.

Sequencing.

Normalized libraries were pooled proportionally based on the results of the RT-PCR quantification and prepared for sequencing. Cluster formation on the flowcell was performed with the Illumina Cluster Station system and the TruSeq SR Cluster Kit v5 (Illumina). Flowcells were sequenced on the Genome Analyzer IIx (GAIIx) system using TruSeq SBS Kit v5 (Illumina) to produce single end 29 bp reads, plus a 7-cycle index read. At least 15 million reads per sample was acquired.

Data Processing.

Output from the GAIIx was pre-processed using Illumina's CASAVA software v1.8.1 to produce one file of short-read basecall profiles for each sample. Short reads in basecall profiles were aligned to transcript elements (N=41671) in the genomic reference *Arabidopsis* transcriptome (TAIR10_GFF3_genes.gff) using the TopHat program v2.0.4 with default parameters. Resulting TopHat alignment profiles were converted to SAM format using SAMTools v0.1.18. For each sample, absolute expression profiles were quantified using HTSeq v0.5.3p9 to produce counts for each "gene", aggregating across all aligned transcripts of the gene as structurally defined in the GFF. HTSeq was run in "union" mode in non-strand specific fashion. Gene expression profiles were then analyzed with EdgeR v3.0 to account for batch and treatment effects. Only genes that had more than two reads per million total reads in three or more samples were modeled.

Contrasts were created to compare the combinations of experimental factors against appropriate controls using a log-likelihood ratio test with p-values calculated using a $\chi 2$ distribution. Since these analyses produce results using many statistical tests, a Benjamini-Hochberg false discovery rate (FDR) multiple test correction was applied to p-values within each profile. To be considered differentially expressed between experimental conditions, a given gene was required to show at least a 1.3 fold difference of expression with a statistical significance of p-FDR<0.05.

Selection of Genes.

The transcript profiles of leaves at each of the 11 time points (22, 24, 26, 28, 30, 32, 34, 36, 38, 40 and 42 DAS) and silique (stage 16, 2, 4, 6 and 8 days post stage 16) were obtained, comparisons were made (i) between plants supplied with low and high nitrate at matched time point and (ii) against the initial time point (22 DAS and stage 16 for leaf and silique, respectively). The expression profiles of the low N and high N grown plants were relatively similar until 30 DAS, corresponding to the time when seed filling began, when a large number of genes began to be differentially expressed in low N conditions and visual evidence of senescence initiation was first noted in leaf 7 in low N. The resulting data were analyzed through a number of computational approaches, e.g., SplineCluster (Heard et al., 2006, *J. Am. Statist. Assoc.* 101: 18-29; Heard 2011, *J. Comput. Graph. Stat.* 20: 920-936, Cornet (cornet.psb.ugent.be/), Gene Ontology analysis and various network inference approaches) to identify potential regulators of NUE and NUpE. Differentially expressed regulatory genes (transcription factors, kinases, phosphatases, RING ubiquitin ligases) were also individually examined. Two types of genes were selected for experimental analysis:

1) Regulatory genes consistently more highly expressed in leaves of plants grown in low N than in leaves of plants grown in high N before 30 DAS. These are candidate genes for up-regulation in leaves, roots, vascular tissue, or whole plants to improve nitrogen uptake and/or assimilation.

2) Regulatory genes consistently more highly expressed in leaves of plants grown in high N than in leaves of plants grown in low N before 30 DAS. These are candidate genes for down-regulation leaves, roots, vascular tissue, or whole plants to improve nitrogen uptake and/or assimilation.

Example II. Identification of Regulators of UI and NUpE Through Whole Plant Soil-Based or Plate-Based Screening Assays Plants grown in plate-based studies or under normal growth conditions in soil may exhibit characteristics of enhanced nitrogen uptake efficiency or nitrogen use efficiency. For example, plants overexpressing a particular gene that are larger or darker green compared to control plants may be able to utilize nitrogen more effectively. In this way, large numbers of genes may be rapidly screened by examining changes in biomass, chlorophyll and nitrogen content.

Plant Growth Conditions for Plate-Based Assays.

Seeds from *Arabidopsis* lines overexpressing various genes were chlorine gas sterilized and stratified at 4° C. for three days and spread onto plates containing a sucrose-based media augmented with vitamins (80% MS+Vit, 1% sucrose, 0.65% Phytoblend™ agar) and kanamycin (3.5 mg/L). The media on these plates can be amended by altering the sucrose or nitrogen levels to alter seedling root and shoot development (for example, see Malamy and Ryan, 2001, *Plant Physiol.* 127: 899-909, Zhang and Forde, 2000, *J. Exp. Bot.* 51:51-59, Watch-Liu et al., 2006, *Ann. Bot.* 97: 875-881, Gifford et al., 2013, *PLoS Genet.* 9(9): e1003760. doi:10.1371/journal.pgen.1003760). The effect of the gene being overexpressed may be determined by growing control and overexpressing lines on the same plate and observing if root and shoot architecture (e.g. root length, root branching, dark green rosette leaves) are altered.

Plant Growth Conditions for Soil Based Experiments.

Seeds from *Arabidopsis* lines overexpressing various genes were chlorine gas sterilized using a standard protocol and spread onto plates containing a sucrose-based media augmented with vitamins (80% MS+Vit, 1% sucrose, 0.65%

PhBL) and either kanamycin (80% MS+Vit, 1% sucrose, 0.65% Phytoblend agar, kanamycin 3.5 mg/L) or sulfonamide (80% MS+Vit, 1% sucrose, 0.65% Phytoblend agar, asulam (1.5 mg/L) where selection was required. Seeds were stratified in the dark on plates, at 4° C. for three days, then moved to a walk-in growth chamber (Conviron MTW120, Conviron Controlled Environments Ltd, Winnipeg, Manitoba, Canada) running at a 10 h photoperiod at a photosynthetic photon flux of ca. 200 μmol m$^{-2}$ s$^{-1}$ at plant height and a photoperiod/night temperature regime of 22° C./19° C. After seven days of light exposure, seedlings were transplanted into 164 ml volume pots containing autoclaved ProMix® soil augmented with beneficial organisms for pest and disease control. All pots were returned to the same growth-chamber and were left standing in water, covered with a lid for the first seven days. This protocol kept the soil moist during this period. Seven days after transplanting, lids were removed and a watering and nutrition regime was begun. All plants received a fertilizer treatment once a week (80% Peter's NPK fertilizer), and water on two other days.

Rosette Biomass and Chemical Analysis for Soil Based Experiments.

The dry weight of whole *Arabidopsis* rosettes was measured after being dried down at 80° C. for 24 hours, a time found to be sufficient to reach constant weight. Samples were taken after 35 to 38 days growth, and used as an assay of aboveground productivity at growth light. Typically, five replicate rosettes were sampled per *Arabidopsis* line being screened. After weighing, the five rosettes sampled for each line screened were pooled together and ground to a fine powder. The pooled sample generated was sub-sampled and ca. 4 μg samples were analyzed for C and N using an elemental analyzer.

Example III. Production of Transgenic Plants

The above-identified regulatory genes may combined with tissue-specific or constitutive promoters and be used to create constructs to transform plants. Transformed plants may be prepared using the following methods, although these examples are not intended to limit the description or claims.

Transformation.

Transformation of *Arabidopsis* is typically performed by an *Agrobacterium*-mediated protocol based on the method of Bechtold and Pelletier, 1998, *Methods Mol. Biol.* 82:259-266.

Plant Preparation.

*Arabidopsis* seeds are sown on mesh covered pots. The seedlings are thinned so that 6-10 evenly spaced plants remain on each pot 10 days after planting. The primary bolts are cut off a week before transformation to break apical dominance and encourage axillary shoots to form. Transformation is typically performed at 4-5 weeks after sowing.

Bacterial Culture Preparation.

*Agrobacterium* stocks are inoculated from single colony plates or from glycerol stocks and grown with the appropriate antibiotics and grown until saturation. On the morning of transformation, the saturated cultures are centrifuged and bacterial pellets are re-suspended in Infiltration Media (0.5× MS, 1×B5 Vitamins, 5% sucrose, 1 mg/ml benzylaminopurine riboside, 200 μl/L Silwet L77) until an A600 reading of 0.8 is reached.

Transformation and Seed Harvest.

The *Agrobacterium* solution is poured into dipping containers. All flower buds and rosette leaves of the plants are immersed in this solution for 30 seconds. The plants are laid on their side and wrapped to keep the humidity high. The plants are kept this way overnight at 22° C. and then the pots are unwrapped, turned upright, and moved to the growth racks.

The plants are maintained on the growth rack under 24-hour light until seeds are ready to be harvested. Seeds are harvested when 80% of the siliques of the transformed plants are ripe (approximately five weeks after the initial transformation). This seed is deemed T0 seed, since it is obtained from the T0 generation, and is later plated on selection plates (kanamycin, sulfonamide or glyphosate). Resistant plants that are identified on such selection plates comprise the T1 generation.

For polynucleotides encoding polypeptides used in these experiments, RT-PCR may be performed to confirm the ability of cloned promoter fragments to drive expression of the polypeptide transgene in plants transformed with the vectors.

T1 plants transformed with promoter-TF combinations comprised within a nucleic acid construct are subjected to morphological analysis. Promoters that produce a substantial amelioration of the negative effects of TF overexpression are subjected to further analysis by propagation into the T2 generation, where the plants are analyzed for an altered trait relative to a control plant.

Example IV. Evaluating Transgenic *Arabidopsis* Usage Index (UI) and Nitrogen Uptake Efficiency (NupE) Under Limiting or Ample Nitrogen Conditions Using Whole Plant Assays Plant Growth and Tissue Isolation.

Transgenic seeds were surface sterilized using chlorine gas, plated on selective media, and stratified for three days at 4° C. in the dark. Plates were incubated at 22° C. under a light intensity of approximately 100 μmole m$^{-2}$ sec$^{-1}$ for seven days (Conviron ATV-26 growth chamber) under a L:D 10:14 regime. Seedlings were then transplanted into square pots (60 mm×60 mm) containing fritted clay topped with a small (10 mm) layer of medium particle sized sand and kept covered with a plastic dome for another seven days to maintain humidity while they became established. Plants are grown in this soil mixture under fluorescent lights, at a light intensity of approximately 100 μmole m$^{-2}$ sec$^{-1}$ and a temperature of 22° C. (L:D 10:14). Plants were cultivated under limiting nitrogen (2 mM nitrate) or ample nitrogen (10 mM nitrate) conditions. Phosphate (0.25 mM), sulfate (0.25 mM), magnesium (0.25 mM), and sodium (0.20 mM) were present in both solutions at the same concentration. The difference between low and high N solutions affects only potassium (5.25 mM and 2.75 mM in high and low N solutions, respectively), calcium (2.50 mM and 0.50 mM, respectively), and chloride ions (0.25 mM and 0.70 mM, respectively). Pots were watered three times per daily every eight h using a commercial ebb and flow hydroponic system (Bigfoot, American Hydroponics, Arcata Calif.).

$^{15}$N Labeling and Harvest.

$^{15}$N uptake was estimated 32 days after sowing when plants were still vegetative. The unlabelled watering solution was replaced by a $^{15}$N-containing solution that had the same nutrient composition except that $^{14}$NO$_3$ was replaced by $^{15}$NO$_3$ at 2.5% enrichment. All pots were watered for 24 h by immersing the base of the pot with a volume of labeled solutions sufficient to cover the lower 35 mm of the pot. After 24 h, the rosette was separated from its root to stop $^{15}$N uptake. Rosettes were then dried and their dry weight was determined. Four to six replicates were harvested for uptake and remobilization experiments.

Determination of Total Nitrogen Content and $^{15}N$ Abundance.

After drying and weighing each sample, material was ground in a bead mill to obtain a homogenous fine powder. A subsample of 2 to 3 mg was weighed into tin capsules to determine the total N content and $^{15}N$ abundance at the Stable Isotope Facility at UC Davis. Samples were analyzed for $^{15}N$ isotopes using a PDZ Europa ANCA-GSL elemental analyzer interfaced to a PDZ Europa 20-20 isotope ratio mass spectrometer (Sercon Ltd., Cheshire, UK). Samples were combusted at 1000° C. in a reactor packed with chromium oxide and silvered cobaltous/cobaltic oxide. Following combustion, oxides were removed in a reduction reactor (reduced copper at 650° C.). The helium carrier then flowed through a water trap (magnesium perchlorate). $N_2$ and $CO_2$ were resolved on a Carbosieve® GC column (65° C., 65 mL/min) before entering the IRMS. During analysis, samples were interspersed with several replicates of at least two different laboratory standards. These laboratory standards (selected to be compositionally similar to the samples being analyzed) were previously calibrated against NIST Standard Reference Materials (IAEA-N1, IAEA-N2, IAEA-N3, USGS-40, and USGS-41). A sample's preliminary isotope ratio is measured relative to reference gases analyzed with each sample. These preliminary values are finalized by correcting the values for the entire batch based on the known values of the included laboratory standards. The long term standard deviation is 0.3 per mil for $^{15}N$. The $^{15}N$ abundance was calculated as atom percent (A %=($^{15}N$)/($^{15}N+^{14}N$)) and for unlabeled plant controls (A %$_{control}$) was 0.3660. The $^{15}N$ enrichment (E %) of the plant material was then defined as E %=A %$_{sample}$-A %$_{control}$.

Determination of Nitrogen Related Parameters (Nitrogen Usage Index and Nitrogen Uptake Efficiency).

A number of traits related to nitrogen uptake and remobilization can be derived from tissue dry weight, tissue % nitrogen (% N), and tissue E %.

Usage Index (UI)

Usage index (UI)=tissue dry weight/N %

N uptake efficiency (NupE)

NupE=$^{15}N$/tissue dry weight=E %×N %×100

Example V. Experimental Results

This Example provides experimental observations for transgenic plants overexpressing GATA23, MYB50, AT2G43260, RBP45A, AtbHLH017, NF-YB4, ATL6, LSD1, WRKY17, ZAT11 and HMGB14, and results observed for improved nitrogen uptake. Two or three independent lines for each gene were evaluated for Usage Index (UI) and N uptake efficiency (NupE) under conditions of limiting and ample nitrogen as described above.

GATA23:

One GATA23 line showed a statistically significant increase in NupE when evaluated under limiting N conditions (150% of control). Two independent lines showed an increase in UI under ample N conditions (360% and 240% of control), including the same line that showed an improvement in NupE under limiting N conditions.

TABLE 4

Enhanced nitrogen uptake in plants ectopically expressing GATA23

| Gene Name | Event # | NupE Ave. | p val | % incr | UI Ave. | p val | % incr |
|---|---|---|---|---|---|---|---|
| Limiting nitrogen | | | | | | | |
| GATA23 | 1 | 72.0 | — | | 0.18 | — | |
| GATA23 | 2 | 72.4 | — | | 0.21 | — | |
| GATA23 | 3 | 88.4 | 0.087 | 150 | 0.20 | — | |
| Control | | 59.0 | | | 0.16 | | |
| Ample nitrogen | | | | | | | |
| GATA23 | 1 | 55.7 | — | | 0.25 | 0.000 | 360 |
| GATA23 | 2 | 55.5 | — | | 0.17 | | |
| GATA23 | 3 | 60.6 | — | | 0.17 | 0.098 | 240 |
| Control | | 56.9 | | | 0.07 | | |

MYB50.

One MYB50 line showed a statistically significant increase in NupE when evaluated under ample N conditions. Two independent MYB50 lines showed an increase in UI under limiting N conditions, and all three lines tested showed an improvement in UI under ample N conditions.

TABLE 5

Enhanced nitrogen uptake in plants ectopically expressing MYB50

| Gene Name | Event # | NupE Ave. | p val | % incr | UI Ave. | p val | % incr |
|---|---|---|---|---|---|---|---|
| Limiting nitrogen | | | | | | | |
| MYB50 | 1 | 62.8 | — | | 0.26 | 0.054 | 163 |
| MYB50 | 2 | 76.5 | — | | 0.25 | — | |
| MYB50 | 3 | 77.5 | — | | 0.27 | 0.010 | 169 |
| Control | | 59.0 | | | 0.16 | | |
| Ample nitrogen | | | | | | | |
| MYB50 | 1 | 62.3 | — | | 0.30 | 0.000 | 429 |
| MYB50 | 2 | 109.3 | 0.007 | 192 | 0.21 | 0.007 | 300 |
| MYB503 | 3 | 98.4 | — | | 0.28 | 0.090 | 400 |
| Control | | 56.9 | | | 0.07 | | |

AT2G43260:

Two independent AT2G43260_lines showed an increase in UI under limiting N conditions, and all three lines tested showed an improvement in UI under ample N conditions.

TABLE 6

Enhanced nitrogen uptake in plants ectopically expressing AT2G43260

| Gene Name | Event # | NupE Ave. | p val | % incr | UI Ave. | p val | % incr |
|---|---|---|---|---|---|---|---|
| Limiting nitrogen | | | | | | | |
| AT2G43260 | 1 | 64.7 | — | | 0.27 | 0.034 | 168 |
| AT2G43260 | 2 | 73.2 | — | | 0.23 | — | |
| AT2G43260 | 3 | 72.5 | — | | 0.33 | 0.000 | 206 |
| Control | | 59.0 | | | 0.16 | | |
| Ample nitrogen | | | | | | | |
| AT2G43260 | 1 | 64.7 | — | | 0.18 | 0.034 | 257 |
| AT2G43260 | 2 | 68.7 | — | | 0.18 | 0.052 | 257 |
| AT2G43260 | 3 | 62.5 | — | | 0.18 | 0.067 | 257 |
| Control | | 56.9 | | | 0.07 | | |

RBP45A:

All three independent RBP45A lines tested showed a significant increase in UI when grown under limiting N conditions, and one of these lines also showed a significant increase in UI under ample N conditions.

TABLE 7

Enhanced nitrogen uptake in plants ectopically expressing RBP45A

| Gene | Event | NupE | | | UI | | |
|---|---|---|---|---|---|---|---|
| Name | # | Ave. | p val | % incr | Ave. | p val | % incr |
| Limiting nitrogen | | | | | | | |
| RBP45A | 1 | 68.8 | — | | 0.36 | 0.000 | 225 |
| RBP45A | 2 | 85.4 | — | | 0.27 | 0.012 | 169 |
| RBP45A | 3 | 71.4 | — | | 0.26 | 0.031 | 162 |
| Control | | 59.0 | | | 0.16 | | |
| Ample nitrogen | | | | | | | |
| RBP45A | 1 | 63.5 | — | | 0.16 | — | |
| RBP45A | 2 | 65.1 | — | | 0.18 | 0.036 | 257 |
| RBP45A | 3 | 80.9 | — | | 0.12 | — | |
| Control | | 56.9 | | | 0.07 | | |

AtbHLH017:

All three independent AtbHLH017 lines tested showed a significant increase in UI when grown under limiting N conditions.

TABLE 8

Enhanced nitrogen uptake in plants ectopically expressing AtbHLH017

| Gene | Event | NupE | | | UI | | |
|---|---|---|---|---|---|---|---|
| Name | # | Ave. | p val | % incr | Ave. | p val | % incr |
| Limiting nitrogen | | | | | | | |
| AtbHLH017 | 1 | 65.5 | — | | 0.27 | 0.027 | 169 |
| AtbHLH017 | 2 | 57.8 | — | | 0.27 | 0.017 | 169 |
| AtbHLH017 | 3 | 65.2 | — | | 0.28 | 0.008 | 175 |
| Control | | 59.0 | | | 0.16 | | |
| Ample nitrogen | | | | | | | |
| AtbHLH017 | 1 | 70.8 | — | | 0.14 | — | |
| AtbHLH017 | 2 | 61.7 | — | | 0.12 | — | |
| AtbHLH017 | 3 | 82.8 | — | | 0.14 | — | |
| Control | | 56.9 | | | 0.07 | | |

NF-YB4:

One NF-YB4 line showed a significant increase in NupE when grown under ample N.

TABLE 9

Enhanced nitrogen uptake in plants ectopically expressing NFYB4

| Gene | Event | NupE | | | UI | | |
|---|---|---|---|---|---|---|---|
| Name | # | Ave. | p val | % incr | Ave. | p val | % incr |
| Limiting nitrogen | | | | | | | |
| NF-YB4 | 1 | 51.2 | — | | 0.13 | — | |
| NF-YB4 | 2 | 50.2 | — | | 0.08 | — | |
| NF-YB4 | 3 | 52.5 | — | | 0.09 | — | |
| Control | | 59.0 | | | 0.16 | | |
| Ample nitrogen | | | | | | | |
| NF-YB4 | 1 | 72.7 | — | | 0.09 | — | |
| NF-YB4 | 2 | 66.4 | — | | 0.08 | — | |
| NF-YB4 | 3 | 98.4 | 0.058 | 172 | 0.09 | — | |
| Control | | 56.9 | | | 0.07 | | |

ATL6:

Two independent ATL6 lines showed an increase in NupE under limiting N, and in UI under ample N conditions.

TABLE 10

Enhanced nitrogen uptake in plants ectopically expressing ATL6

| Gene | Event | NupE | | | UI | | |
|---|---|---|---|---|---|---|---|
| Name | # | Ave. | p val | % incr | Ave. | p val | % incr |
| Limiting nitrogen | | | | | | | |
| ATL6 | 1 | 93.3 | 0.026 | 158 | 0.22 | — | |
| ATL6 | 2 | 99.2 | 0.005 | 168 | 0.24 | — | |
| Control | | 59.0 | | | .16 | | |
| Ample nitrogen | | | | | | | |
| ATL6 | 1 | 89.2 | — | | 0.23 | 0.001 | 328 |
| ATL6 | 2 | 78.0 | — | | 0.25 | 0.000 | 357 |
| Control | | 56.9 | | | 0.07 | | |

LSD1:

Two independent LSD1 overexpressing lines showed an increase in NupE under both limiting and ample N conditions. One line also showed an increase in UI under limiting N.

TABLE 11

Enhanced nitrogen uptake in plants ectopically expressing LSD1

| Gene | Event | NupE | | | UI | | |
|---|---|---|---|---|---|---|---|
| Name | # | Ave. | p val | % incr | Ave. | p val | % incr |
| Limiting nitrogen | | | | | | | |
| LSD1 | 1 | 97.7 | 0.002 | 152 | 0.13 | — | |
| LSD1 | 2 | 111.0 | 0.000 | 173 | 0.23 | 0.000 | 176 |
| Control | | 64.0 | | | 0.13 | | |
| Ample nitrogen | | | | | | | |
| LSD1 | 1 | 118.8 | 0.008 | 152 | 0.19 | — | |
| LSD1 | 2 | 110.2 | 0.091 | 142 | 0.20 | — | |
| Control | | 77.6 | | | 0.12 | | |

WRKY17:

Three independent WRKY17 overexpressing lines showed a significant increase in NupE under limiting N conditions, and two of these lines also showed a significant increase under ample N. All three lines also showed an increase in UI under both limiting and ample N.

TABLE 12

Enhanced nitrogen uptake in plants ectopically expressing WRKY17

| Gene | Event | NupE | | | UI | | |
|---|---|---|---|---|---|---|---|
| Name | # | Ave. | p val | % incr | Ave. | p val | % incr |
| Limiting nitrogen | | | | | | | |
| WRKY17 | 1 | 100.3 | 0.000 | 157 | 0.30 | 0.000 | 231 |
| WRKY17 | 2 | 118.6 | 0.000 | 185 | 0.30 | 0.000 | 231 |
| WRKY17 | 3 | 110.9 | 0.000 | 173 | 0.33 | 0.000 | 254 |
| Control | | 64.0 | | | 0.13 | | |
| Ample nitrogen | | | | | | | |
| WRKY17 | 1 | 100.9 | — | | 0.23 | 0.033 | 192 |
| WRKY17 | 2 | 114.3 | 0.026 | 147 | 0.22 | 0.054 | 183 |
| WRKY17 | 3 | 114.8 | 0.023 | 148 | 0.23 | 0.040 | 192 |
| Control | | 77.6 | | | 0.12 | | |

ZAT11:

Three independent ZAT11 overexpressing lines showed a significant increase in NupE and UI under both limiting and ample N conditions.

TABLE 13

Enhanced nitrogen uptake in plants ectopically expressing ZAT11

| Gene Name | Event # | NupE | | | UI | | |
|---|---|---|---|---|---|---|---|
| | | Ave. | p val | % incr | Ave. | p val | % incr |
| Limiting nitrogen | | | | | | | |
| ZAT11 | 1 | 128.1 | 0.000 | 200 | 0.34 | 0.000 | 262 |
| ZAT11 | 2 | 130.1 | 0.000 | 203 | 0.32 | 0.000 | 246 |
| ZAT11 | 3 | 117.1 | 0.000 | 183 | 0.38 | 0.000 | 292 |
| Control | | 64.0 | | | 0.13 | | |
| Ample nitrogen | | | | | | | |
| ZAT11 | 1 | 115.4 | 0.019 | 149 | 0.25 | 0.007 | 208 |
| ZAT11 | 2 | 125.6 | 0.000 | 162 | 0.27 | 0.001 | 225 |
| ZAT11 | 3 | 146.6 | 0.000 | 189 | 0.28 | 0.000 | 233 |
| Control | | 77.6 | | | 0.12 | | |

HMGB14:

Three independent HMGB14 lines showed an increase in UI under limiting N conditions; one of these lines also showed an increase in UI under ample N conditions and an increase in NupE under limiting N conditions.

TABLE 14

Enhanced nitrogen uptake in plants ectopically expressing HMGB14

| Gene Name | Event # | NupE | | | UI | | |
|---|---|---|---|---|---|---|---|
| | | Ave. | p val | % incr | Ave. | p val | % incr |
| Limiting nitrogen | | | | | | | |
| HMGB14 | 1 | 100.4 | | | 0.22 | .019 | 157 |
| HMGB14 | 2 | 86.3 | | | 0.23 | .016 | 164 |
| HMGB14 | 3 | 149.9 | 0.001 | 178 | 0.20 | .088 | 143 |
| Control | | 84.2 | | | 0.14 | | |
| Ample nitrogen | | | | | | | |
| HMGB14 | 1 | 29.0 | | | 0.27 | | |
| HMGB14 | 2 | 27.8 | | | 0.28 | | |
| HMGB14 | 3 | 50.9 | | | 0.35 | .010 | 194 |
| Control | | 39.7 | | | 0.18 | | |

Example VI. Plant Transformation Methods

Crop species that overexpress polypeptides of the instant description may produce plants with increased photosynthetic resource use efficiency and/or yield. Thus, polynucleotide sequences listed in the Sequence Listing recombined into, for example, one of the expression vectors of the instant description, or another suitable expression vector, may be transformed into a plant for the purpose of modifying plant traits for the purpose of improving yield, quality, and/or photosynthetic resource use efficiency. The expression vector may contain a constitutive, tissue-enhanced or inducible promoter operably linked to the polynucleotide. The cloning vector may be introduced into a variety of plants by means well known in the art such as, for example, direct DNA transfer or *Agrobacterium tumefaciens*-mediated transformation.

Transformation of Monocots.

Cereal plants including corn, wheat, rice, sorghum, barley, or other monocots may be transformed with the present polynucleotide sequences, including monocot or eudicot-derived sequences such as those presented in the present Tables, cloned into a vector such as pGA643 and containing a kanamycin-resistance marker, and expressed constitutively under, for example, the CaMV35S or COR15 promoters, or with tissue-enhanced or inducible promoters. The expression vectors may be one found in the Sequence Listing, or any other suitable expression vector may be similarly used. For example, pMEN020 may be modified to replace the NptII coding region with the BAR gene of *Streptomyces hygroscopicus* that confers resistance to phosphinothricin. The KpnI and BglII sites of the Bar gene are removed by site-directed mutagenesis with silent codon changes.

The cloning vector may be introduced into a variety of cereal plants by means well known in the art including direct DNA transfer or *Agrobacterium tumefaciens*-mediated transformation. The latter approach may be accomplished by a variety of means, including, for example, that of U.S. Pat. No. 5,591,616, in which monocotyledon callus is transformed by contacting dedifferentiating tissue with the *Agrobacterium* containing the cloning vector.

The sample tissues are immersed in a suspension of $3 \times 10^{-9}$ cells of *Agrobacterium* containing the cloning vector for 3-10 minutes. The callus material is cultured on solid medium at 25° C. in the dark for several days. The calli grown on this medium are transferred to a Regeneration Medium. Transfers are continued every two to three weeks (two or three times) until shoots develop. Shoots are then transferred to Shoot-Elongation Medium every 2-3 weeks. Healthy looking shoots are transferred to Rooting Medium and after roots have developed, the plants are placed into moist potting soil.

The transformed plants are then analyzed for the presence of the NPTII gene/kanamycin resistance by ELISA, using the ELISA NPTII kit from 5Prime-3Prime Inc. (Boulder, Colo.).

It is also routine to use other methods to produce transgenic plants of most cereal crops (Vasil, 1994. *Plant Mol. Biol.* 25: 925-937) such as corn, wheat, rice, sorghum (Cassas et al., 1993. *Proc. Natl. Acad. Sci. USA* 90: 11212-11216), and barley (Wan and Lemeaux, 1994. *Plant Physiol.* 104: 37-48). DNA transfer methods such as the microprojectile method can be used for corn (Fromm et al., 1990. *Bio/Technol.* 8: 833-839; Gordon-Kamm et al., 1990. *Plant Cell* 2: 603-618; Ishida, 1990. *Nature Biotechnol.* 14:745-750), wheat (Vasil et al., 1992. *Bio/Technol.* 10:667-674; Vasil et al., 1993. *Bio/Technol.* 11:1553-1558; Weeks et al., 1993. *Plant Physiol.* 102:1077-1084), and rice (Christou, 1991. *Bio/Technol.* 9:957-962; Hiei et al., 1994. *Plant J.* 6:271-282; Aldemita and Hodges, 1996. *Planta* 199: 612-617; and Hiei et al., 1997. *Plant Mol. Biol.* 35:205-218). For most cereal plants, embryogenic cells derived from immature scutellum tissues are the preferred cellular targets for transformation (Hiei et al., 1997. supra; Vasil, 1994. supra). For transforming corn embryogenic cells derived from immature scutellar tissue using microprojectile bombardment, the A188XB73 genotype is the preferred genotype (Fromm et al., 1990. *Bio/Technol.* 8: 833-839; Gordon-Kamm et al., 1990. supra). After microprojectile bombardment the tissues are selected on phosphinothricin to identify the transgenic embryogenic cells (Gordon-Kamm et al., 1990. supra). Transgenic plants from transformed host plant cells may be regenerated by standard corn regeneration techniques (Fromm et al., 1990. *Bio/Technol.* 8: 833-839; Gordon-Kamm et al., 1990. supra).

Transformation of Dicots.

It is now routine to produce transgenic plants using most eudicot plants (see U.S. Pat. No. 8,273,954 (Rogers et al.) issued Sep. 25, 2012; Weissbach and Weissbach, 1989. *Methods for Plant Molecular Biology*, Academic Press; Gelvin et al., 1990. *Plant Molecular Biology Manual*, Kluwer Academic Publishers; Herrera-Estrella et al., 1983. *Nature* 303: 209; Bevan, 1984. *Nucleic Acids Res.* 12: 8711-8721; and Klee, 1985. *Bio/Technology* 3: 637-642). Methods for analysis of traits are routine in the art and examples are disclosed above.

Numerous protocols for the transformation of tomato and soy plants have been previously described, and are well known in the art. Gruber et al., in Glick and Thompson, 1993. *Methods in Plant Molecular Biology and Biotechnology*. eds., CRC Press, Inc., Boca Raton, describe several expression vectors and culture methods that may be used for cell or tissue transformation and subsequent regeneration. For soybean transformation, methods are described by Mild et al., 1993. in *Methods in Plant Molecular Biology and Biotechnology*, p. 67-88, Glick and Thompson, eds., CRC Press, Inc., Boca Raton; and U.S. Pat. No. 5,563,055, (Townsend and Thomas), issued Oct. 8, 1996.

There are a substantial number of alternatives to *Agrobacterium*-mediated transformation protocols, other methods for the purpose of transferring exogenous genes into soybeans or tomatoes. One such method is microprojectile-mediated transformation, in which DNA on the surface of microprojectile particles is driven into plant tissues with a biolistic device (see, for example, Sanford et al., 1987. *Part. Sci. Technol.* 5:27-37; Sanford, 1993. *Methods Enzymol.* 217: 483-509; Christou et al., 1992. *Plant. J.* 2: 275-281; Klein et al., 1987. *Nature* 327: 70-73; U.S. Pat. No. 5,015,580 (Christou et al), issued May 14, 1991; and U.S. Pat. No. 5,322,783 (Tomes et al.), issued Jun. 21, 1994).

Alternatively, sonication methods (see, for example, Zhang et al., 1991. *Bio/Technology* 9: 996-997); direct uptake of DNA into protoplasts using $CaCl_2$ precipitation, polyvinyl alcohol or poly-L-ornithine (see, for example, Hain et al., 1985. *Mol. Gen. Genet.* 199: 161-168; Draper et al., 1982. *Plant Cell Physiol.* 23: 451-458); liposome or spheroplast fusion (see, for example, Deshayes et al., 1985. *EMBO J.*, 4: 2731-2737; Christou et al., 1987. *Proc. Natl. Acad. Sci. USA* 84: 3962-3966); and electroporation of protoplasts and whole cells and tissues (see, for example, Donn et al. 1990. in *Abstracts of VIIth International Congress on Plant Cell and Tissue Culture IAPTC*, A2-38: 53; D'Halluin et al., 1992. *Plant Cell* 4: 1495-1505; and Spencer et al., 1994. *Plant Mol. Biol.* 24: 51-61) have been used to introduce foreign DNA and expression vectors into plants.

After a plant or plant cell is transformed (and the transformed host plant cell then regenerated into a plant), the transformed plant may propagated vegetatively or it may be crossed with itself or a plant from the same line, a non-transformed or wild-type plant, or another transformed plant from a different transgenic line of plants. Crossing provides the advantages of producing new and often stable transgenic varieties. Genes and the traits they confer that have been introduced into a tomato or soybean line may be moved into distinct line of plants using traditional backcrossing techniques well known in the art. Transformation of tomato plants may be conducted using the protocols of Koornneef et al, 1986. In *Tomato Biotechnology*: Alan R. Liss, Inc., 169-178, and in U.S. Pat. No. 6,613,962, the latter method described in brief here. Eight day old cotyledon explants are precultured for 24 hours in Petri dishes containing a feeder layer of *Petunia hybrida* suspension cells plated on MS medium with 2% (w/v) sucrose and 0.8% agar supplemented with 10 µM-naphthalene acetic acid and 4.4 µM 6-benzylaminopurine. The explants are then infected with a diluted overnight culture of *Agrobacterium tumefaciens* containing an expression vector comprising a polynucleotide of the instant description for 5-10 minutes, blotted dry on sterile filter paper and cocultured for 48 hours on the original feeder layer plates. Culture conditions are as described above. Overnight cultures of *Agrobacterium tumefaciens* are diluted in liquid MS medium with 2% (w/v/) sucrose, pH 5.7, to an $OD_{600}$ of 0.8.

Following cocultivation, the cotyledon explants are transferred to Petri dishes with selective medium comprising MS medium with 4.56 µM zeatin, 67.3 µM vancomycin, 418.9 µM cefotaxime and 171.6 µM kanamycin sulfate, and cultured under the culture conditions described above. The explants are subcultured every three weeks onto fresh medium. Emerging shoots are dissected from the underlying callus and transferred to glass jars with selective medium without zeatin to form roots. The formation of roots in a kanamycin sulfate-containing medium is a positive indication of a successful transformation.

Transformation of soybean plants may be conducted using the methods found in, for example, U.S. Pat. No. 5,563,055 (Townsend et al., issued Oct. 8, 1996), described in brief here. In this method soybean seed is surface sterilized by exposure to chlorine gas evolved in a glass bell jar. Seeds are germinated by plating on ¹⁄₁₀ strength agar solidified medium without plant growth regulators and culturing at 28° C. with a 16 hour day length. After three or four days, seed may be prepared for cocultivation. The seedcoat is removed and the elongating radicle removed 3-4 mm below the cotyledons.

*Eucalyptus* is now considered an important crop that is grown for example to provide feedstocks for the pulp and paper and biofuel markets. This species is also amenable to transformation as described in PCT patent publication WO/2005/032241.

*Crambe* has been recognized as a high potential oilseed crop that may be grown for the production of high value oils. An efficient method for transformation of this species has been described in PCT patent publication WO 2009/067398 A1.

Overnight cultures of *Agrobacterium tumefaciens* harboring the expression vector comprising a polynucleotide of the instant description are grown to log phase, pooled, and concentrated by centrifugation. Inoculations are conducted in batches such that each plate of seed was treated with a newly resuspended pellet of *Agrobacterium*. The pellets are resuspended in 20 ml inoculation medium. The inoculum is poured into a Petri dish containing prepared seed and the cotyledonary nodes are macerated with a surgical blade. After 30 minutes the explants are transferred to plates of the same medium that has been solidified. Explants are embedded with the adaxial side up and level with the surface of the medium and cultured at 22° C. for three days under white fluorescent light. These plants may then be regenerated according to methods well established in the art, such as by moving the explants after three days to a liquid counter-selection medium (see U.S. Pat. No. 5,563,055).

The explants may then be picked, embedded and cultured in solidified selection medium. After one month on selective media transformed tissue becomes visible as green sectors of regenerating tissue against a background of bleached, less healthy tissue. Explants with green sectors are transferred to an elongation medium. Culture is continued on this medium with transfers to fresh plates every two weeks. When shoots are 0.5 cm in length they may be excised at the base and placed in a rooting medium.

Experimental Methods; Transformation of *Arabidopsis*.

Transformation of *Arabidopsis* is performed by an *Agrobacterium*-mediated protocol based on the method of Bechtold and Pelletier, 1998. Unless otherwise specified, all experimental work is performed using the Columbia ecotype.

Plant Preparation.

*Arabidopsis* seeds are gas sterilized and sown on plates with media containing 80% MS with vitamins, 0.3% sucrose and 1% Bacto™ agar. The plates are placed at 4° C. in the dark for the days then transferred to 24 hour light at 22° C. for seven days. After 7 days the seedlings are transplanted to soil, placing individual seedlings in each pot. The primary bolts are cut off a week before transformation to break apical dominance and encourage auxiliary shoots to form. Transformation is typically performed at 4-5 weeks after sowing.

Bacterial Culture Preparation.

*Agrobacterium* stocks are inoculated from single colony plates or from glycerol stocks and grown with the appropriate antibiotics until saturation. On the morning of transformation, the saturated cultures are centrifuged and bacterial pellets are re-suspended in Infiltration Media (0.5× MS, 1× Gamborg's Vitamins, 5% sucrose, 200 μl/L Silwet® L77) until an $A_{600}$ reading of 0.8 is reached.

Transformation and Harvest of Transgenic Seeds.

The *Agrobacterium* solution is poured into dipping containers. All flower buds and rosette leaves of the plants are immersed in this solution for 30 seconds. The plants are laid on their side and wrapped to keep the humidity high. The plants are kept this way overnight at 22° C. and then the pots are turned upright, unwrapped, and moved to the growth racks. In most cases, the transformation process is repeated one week later to increase transformation efficiency.

The plants are maintained on the growth rack under 24-hour light until seeds are ready to be harvested. Seeds are harvested when 80% of the siliques of the transformed plants are ripe (approximately five weeks after the initial transformation). This seed is deemed $T_0$ seed, since it is obtained from the $T_0$ generation, and is later plated on selection plates (either kanamycin or sulfonamide). Resistant plants that are identified on such selection plates comprise the T1 generation, from which transgenic seed comprising an expression vector of interest may be derived.

Example VII. Identification of Crop Plants with Enhanced Nitrogen Uptake

Evaluating Transgenic Crop Plants for Enhanced Nitrogen Use Efficiency and Nitrogen Uptake Efficiency (NupE) Under Field Conditions.

In field studies, the nitrogen use efficiency (NUE) in crop production systems can be computed using a number of methods (Table 15; Dobermann, 2005, digitalcommons.unl.edu/agronomyfacpub/316). In field studies, these parameters are either calculated based on differences in crop yield and total N uptake with aboveground biomass between fertilized plots and an unfertilized control (the "difference method") or by using $^{15}$N-labeled fertilizers to estimate crop and soil recovery of applied N. The time scale in these studies is usually one cropping season while the spatial scale for measurement is mostly a field or plot. Because each parameter can differ in its value in interpreting the data, field research on fertilizer-N efficiency should include measurements of several parameters to assess causes of variation in NUE. The "difference method" is simple and cost efficient procedure which makes it particularly suitable for field research. The use of labeled $^{15}$N to trace the fate of applied N is a precise but expensive method that is only applicable in scientific experiments and is not generally used in field studies.

TABLE 15

Agronomic indices of N use efficiency

| NUE index | Calculation | Interpretation |
|---|---|---|
| NUE - Nitrogen use efficiency (also called partial factor productivity of applied N ($PFP_N$) (kg harvest product per kg N applied) | $NUE = Y_N/F_N$ | Most important for farmers because it integrates the use efficiency of both indigenous and applied N resources: $NUE = (Y_0/F_N) + AE_N$ Increasing indigenous soil N ($Y_0$) and the efficiency of applied N ($AE_N$) are equally important for improving NUE Limited potential for identifying specific constraints or promising management strategies |
| $AE_N$ = Agronomic efficiency of applied N (kg yield increase per kg N applied) | $AE_N = (Y_N - Y_0)/F_N$ | $AE_N$ is the product of the efficiency of N recovery from applied N and the efficiency with which the plant uses each additional unit of N acquired: $AE_N = RE_N \times PE_N$ $AE_N$ can be increased by N, crop, and soil management practices that affect $RE_N$, $PE_N$, or both. |
| $RE_N$ = Crop recovery efficiency of applied N (kg increase in N uptake per kg N applied) | $RE_N = (U_N - U_0)/F_N$ | $RE_N$ depends on the congruence between plant N demand and the quantity of N released from applied N. $RE_N$ is affected by the N application method (amount, timing, placement, N form) as well as factors that determine the size of the crop N sink (genotype, climate, plant density, abiotic/biotic stresses). |

TABLE 15-continued

Agronomic indices of N use efficiency

| NUE index | Calculation | Interpretation |
|---|---|---|
| $PE_N$ = Physiological efficiency of applied N (kg yield increase per kg increase in N uptake from fertilizer) | $PE_N = (Y_N - Y_0)/(U_N - U_0)$ | $PE_N$ represents the ability of a plant to transform N acquired from fertilizer into economic yield (grain). $PE_N$ depends on genotypic characteristics (e.g., harvest index), environmental and management factors, particularly during reproductive growth. Low $PE_N$ suggests sub-optimal growth (nutrient deficiencies, drought stress, heat stress, mineral toxicities, pests). |

FN-amount of (fertilizer) N applied (kg ha-1)
YN-crop yield with applied N (kg ha-1)
Y0-crop yield (kg ha-1) in a control treatment with no N
UN-total plant N uptake in aboveground biomass at maturity (kg ha-1) in a plot that received N
U0-the total N uptake in aboveground biomass at maturity (kg ha-1) in a plot that received no N Example VIII. Embodiments of the Description The contents and teachings of the instant application and each of the information sources provided herein can be relied on and used to make and use embodiments of the instant disclosure. Although particular embodiments are described, equivalent embodiments may be used to practice the compositions and methods of the instant description, embodiments, and claims.

The instant disclosure pertains to, but is not limited by, the following embodiments:

1. A method of altering architecture or physiology of a root tissue or green tissue in a plant, comprising:
    (a) introducing into a plant cell a nucleic acid construct comprising a constitutive, or a tissue-enhanced promoter that preferentially regulates expression of a polypeptide in a root, root cap, root meristem, root vasculature, vascular, and/or green tissue, wherein:
        said polypeptide is at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 90%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95% or 96%, at least 97%, at least 98%, or at least 99%, or about 100% identical to SEQ ID NO:2n, where n=1 to 1131 or SEQ ID NO: 2263 to 2312;
        wherein said regulation of expression of the polypeptide increases nitrogen uptake, assimilation, nitrogen uptake efficiency (NUpE), nitrogen usage index (UI), and/or seed yield in the transgenic plant as compared to a control or reference plant that does not comprise the a nucleic acid construct; and
    b. optionally, identifying a transgenic plant that has greater nitrogen uptake, assimilation, nitrogen uptake efficiency (NUpE), nitrogen usage index (UI), and/or greater seed yield, as compared to a control or reference plant.

2. A method for producing a plant that has enhanced nitrogen uptake, assimilation, nitrogen uptake efficiency (NUpE), nitrogen usage index (UI), and/or seed yield, the method comprising:
    (a) providing a plant with a nucleic acid construct comprising a constitutive promoter, or a tissue-enhanced promoter that preferentially regulates expression of a polypeptide in a root, root cap, root meristem, root vasculature, vascular, and/or green tissue, wherein:
        said polypeptide is at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 90%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95% or 96%, at least 97%, at least 98%, or at least 99%, or about 100% identical to SEQ ID NO:2n, where n=1 to 1131 or SEQ ID NO: 2263 to 2312;
        wherein said regulation of expression of the polypeptide increases nitrogen uptake in the transgenic plant as compared to a control or reference plant that does not comprise the a nucleic acid construct; and
    b. optionally, identifying a transgenic plant that has greater nitrogen uptake, assimilation, nitrogen uptake efficiency (NUpE), nitrogen usage index (UI), and/or greater seed yield, as compared to a control or reference plant.

3. The method of embodiment 2, wherein said providing the plant with the nucleic acid construct is accomplished by transforming a plant with the nucleic acid construct.

4. The method of embodiment 2, wherein said providing the plant with the nucleic acid construct is accomplished by crossing the plant with a plant that comprises the nucleic acid construct.

5. A method for producing a plant that has enhanced nitrogen uptake, assimilation, nitrogen uptake efficiency (NUpE), nitrogen usage index (UI), and/or greater seed yield in the plant or a part of the plant comprising:
   a. providing a constitutive promoter, or a root, root cap, root meristem, root vasculature, vascular, and/or green tissue-enhanced promoter that is capable of up-regulating gene expression in the root, root cap, root meristem, root vasculature, vascular, and/or green tissue structure, organ, or plant part of the plant;
   b. providing a suppressor of gene expression capable of suppressing expression of an endogenous polynucleotide and its encoded endogenous polypeptide;
      wherein said polypeptide is at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 90%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95% or 96%, at least 97%, at least 98%, or at least 99%, or about 100% identical to SEQ ID NO:2n, where n=1 to 1131 or SEQ ID NO: 2263 to 2312;
   c. providing a target plant with at least one nucleic acid construct to produce a transgenic plant, wherein the at least one nucleic acid construct comprises the constitutive or tissue-enhanced promoter and the suppressor of gene expression;
      wherein the tissue-enhanced promoter increases expression of the suppressor of gene expression in the structure, organ, or plant part of the transgenic plant of the transgenic plant, which results in decreased expression of the endogenous polynucleotide and its encoded endogenous polypeptide; and said decreased expression of the endogenous polypeptide increases nitrogen uptake, assimilation, nitrogen uptake efficiency (NUpE), nitrogen usage index (UI), and/or seed yield in the transgenic plant as compared to a control or reference plant that does not comprise the a nucleic acid construct; and
   d. optionally, identifying a transgenic plant that has greater nitrogen uptake, assimilation, nitrogen uptake efficiency (NUpE), nitrogen usage index (UI), and/or greater seed yield, as compared to the control or reference plant.

6. The method of embodiment 5, wherein the suppressor of gene expression is an RNAi (RNA interference) molecule, a small interfering RNA (siRNA) molecule, a small hairpin RNA (shRNA) molecule, a microRNA (miRNA) molecule, an antisense molecule, a cosuppression directing nucleic acid, a nucleic acid encoding a ribozyme, a nucleic acid encoding a deoxyribozyme (DNAzyme), a nucleic acid encoding a transcription factor suppressor, or a triple helix oligonucleotide that decreases the expression of the polynucleotide.

7. The method of embodiment 5, wherein the tissue-enhanced promoter is selected from the group consisting of SEQ ID NOs: 2313 to 2372.

8. A method for producing a plant that has enhanced nitrogen uptake in the plant or a part of the plant, comprising:
   a. growing a plant in a medium containing:
      a limiting concentration of nitrogen that limits growth of the plant; or an ample concentration of nitrogen that does not limit growth of the plant;
   b. identifying a polypeptide the expression of which is higher in a part of the plant including a root, root cap, root meristem, root vasculature, vascular, leaf, and/or green tissue structure or organ of a nitrogen-limited plant grown in the limiting concentration of nitrogen than in a corresponding root, root cap, root meristem, root vasculature, vascular, leaf, and/or green tissue structure or organ of a nitrogen-ample plant grown in the ample concentration of nitrogen;
   d. identifying a polynucleotide that encodes the polypeptide;
   c. identifying a constitutive promoter, or a root, root cap, root meristem, root vasculature, vascular, and/or green tissue-enhanced promoter that is capable of up-regulating protein expression in a root, root cap, root meristem, root vasculature, vascular, leaf, and/or green tissue structure or organ;
   e. introducing into a target plant at least one recombinant nucleic acid construct to produce a transgenic plant, and the at least one recombinant nucleic acid construct comprises the polynucleotide and the constitutive or tissue-enhanced promoter;
      wherein the tissue-enhanced promoter regulates transcription of the polynucleotide, and said transcriptional regulation is preferentially enhanced in the root, root cap, root meristem, root vasculature, vascular, and/or green tissue structure or organ of the transgenic plant;
      wherein the preferentially enhanced expression of the polypeptide in the transgenic plant or in the root, root cap, root meristem, root vasculature, vascular, and/or green tissue structure or organ of the transgenic plant increases nitrogen uptake, assimilation, nitrogen uptake efficiency (NUpE), nitrogen usage index (UI), and/or seed yield in the transgenic plant as compared to a control or reference plant that does not comprise the a nucleic acid construct; and
   f. optionally, selecting a transgenic plant that has greater nitrogen uptake, assimilation, nitrogen uptake efficiency (NUpE), nitrogen usage index (UI), and/or greater seed yield than the control plant.

9. A method for producing a plant that has enhanced nitrogen uptake in the plant or a part of the plant, comprising:
   a. growing a plant in a medium containing:
      a limiting concentration of nitrogen that limits growth of the plant; or an ample concentration of nitrogen that does not limit growth of the plant;
   b. identifying a polypeptide the expression of which is lower in a part of the plant including a root, root cap, root meristem, root vasculature, vascular, leaf, and/or green tissue structure or organ of a nitrogen-limited plant grown in the limiting concentration of nitrogen than in a corresponding root, root cap, root meristem, root vasculature, vascular, leaf, and/or green tissue structure or organ of a nitrogen-ample plant grown in the ample concentration of nitrogen;
   d. identifying a polynucleotide that encodes the polypeptide;

c. identifying a constitutive promoter, or a root, root cap, root meristem, root vasculature, vascular, and/or green tissue-enhanced promoter that is capable of up-regulating protein expression in a root, root cap, root meristem, root vasculature, vascular, leaf, and/or green tissue structure or organ;

e. introducing into a target plant at least one recombinant nucleic acid construct to produce a transgenic plant, and the at least one recombinant nucleic acid construct comprises the polynucleotide and the constitutive or tissue-enhanced promoter;

wherein the tissue-enhanced promoter regulates transcription of the polynucleotide, and said transcriptional regulation is preferentially enhanced in the root, root cap, root meristem, root vasculature, vascular, and/or green tissue structure or organ of the transgenic plant;

wherein the preferentially enhanced expression of the polypeptide in the transgenic plant or in the root, root cap, root meristem, root vasculature, vascular, and/or green tissue structure or organ of the transgenic plant increases nitrogen uptake, assimilation, nitrogen uptake efficiency (NUpE), nitrogen usage index (UI), and/or seed yield in the transgenic plant as compared to a control or reference plant that does not comprise the a nucleic acid construct; and f. optionally, selecting a transgenic plant that has greater nitrogen uptake, assimilation, nitrogen uptake efficiency (NUpE), nitrogen usage index (UI), and/or greater seed yield than the control plant.

10. The method of embodiment 8 or embodiment 9, wherein the limiting concentration of nitrogen in the medium is a total nitrogen content of 2 mM nitrogen and the ample concentration of nitrogen is a total nitrogen content of 10 mM nitrogen.

11. The method of embodiment 8, embodiment 9, or embodiment 10, wherein the polypeptide is at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 90%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95% or 96%, at least 97%, at least 98%, or at least 99%, or about 100% identical to SEQ ID NO:2n, where n=1 to 1131

12. A method for enhancing nitrogen uptake in a crop plant, the method comprising:

providing a transgenic crop plant that comprises at least one nucleic acid construct, wherein the nucleic acid construct comprises a promoter and a polynucleotide; and the promoter is a constitutive promoter or a root, root cap, root meristem, root vasculature, vascular, or green tissue-enhanced promoter;

wherein the polynucleotide encodes a polypeptide is at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 90%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95% or 96%, at least 97%, at least 98%, or at least 99%, or about 100% identical to SEQ ID NO:2n, where n=1 to 1131; and wherein the promoter enhances expression of the polynucleotide in the transgenic crop plant, or preferentially enhances expression of the polynucleotide in a root, root cap, root meristem, root vasculature, vascular, and/or green tissue structure or organ of the transgenic crop plant, and said preferential enhancement of expression increases nitrogen uptake in the transgenic crop plant relative to a control or reference plant that does not comprise the a nucleic acid construct.

13. A method for enhancing nitrogen uptake, assimilation, nitrogen uptake efficiency (NUpE), nitrogen usage index (UI), and/or seed yield in a crop plant, the method comprising:

providing a transgenic crop plant that comprises at least one recombinant nucleic acid construct, wherein the nucleic acid construct comprises a constitutive promoter or a root, root cap, root meristem, root vasculature, vascular, and/or green tissue-enhanced promoter, and a suppressor of gene expression capable of suppressing expression of an endogenous polynucleotide;

wherein the suppressor of gene expression inhibits expression of the polynucleotide and its encoded endogenous polypeptide, and the endogenous polypeptide is at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 90%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or about 100% identical to SEQ ID NO:2n, where n=1 to 1131 or SEQ ID NO: 2263-2312; and wherein the constitutive or tissue-enhanced promoter increases expression of the suppressor of gene expression in the transgenic plant or the part of the transgenic plant, which results in decreased expression of the endogenous polynucleotide and its encoded endogenous polypeptide; and said decreased expression of the endogenous polypeptide increases nitrogen uptake, assimilation, nitrogen uptake efficiency (NUpE), nitrogen usage index (UI), and/or seed yield in the transgenic plant relative to the control plant.

14. The method of embodiment 13, wherein the suppressor of gene expression is an RNAi (RNA interference) molecule, a small interfering RNA (siRNA) molecule, a small hairpin RNA (shRNA) molecule, a microRNA (miRNA) molecule, an antisense molecule, a cosuppression directing nucleic acid, a nucleic acid encoding a ribozyme, a nucleic acid encoding a deoxyribozyme (DNAzyme), a nucleic acid encoding a transcription factor suppressor, or a triple helix oligonucleotide that decreases the expression of the polynucleotide.

15. The method of any of embodiments 13 or 14, wherein the plant has higher nitrogen uptake, assimilation, nitrogen uptake efficiency (NUpE), nitrogen usage index (UI), and/or seed yield.

16. The method of any of embodiments 13 to 15, wherein the tissue-enhanced promoter is selected from the group consisting of SEQ ID NOs: 2313 to 2349 or a promoter listed in Table 3.

17. A recombinant nucleic acid construct comprising a root, root cap, root meristem, root vasculature, vascular, and/or green tissue-enhanced promoter selected from the group consisting of SEQ ID NOs: 2313 to 2372;
    wherein the promoter regulates expression of a polynucleotide that inhibits expression of an endogenous polypeptide that is at least 30%, at least 31%, at least 32%, at least 33%, at least 34%, at least 35%, at least 36%, at least 37%, at least 38%, at least 39%, at least 40%, at least 41%, at least 42%, at least 43%, at least 44%, at least 45%, at least 46%, at least 47%, at least 48%, at least 49%, at least 50%, at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95% or 96%, at least 97%, at least 98%, or at least 99%, or about 100% identical to SEQ ID NO:2n, where n=1 to 1131, or to SEQ ID NO 2263 to 2312.

18. A transgenic crop plant produced by the method of any of embodiments 1 to 16 or comprising a recombinant nucleic acid construct of embodiment 17, wherein the transgenic plant has enhanced nitrogen uptake, assimilation, nitrogen uptake efficiency (NUpE), nitrogen usage index (UI), and/or seed yield, as compared to the control or reference plant.

19. The transgenic crop plant of embodiment 18, wherein the transgenic plant is selected from the group consisting of: a non-leguminous plant, a monocot plant, a cereal plant, a maize (corn) plant, a rice plant, a wheat plant, a barley plant, a sorghum plant, a millet plant, an oat plant, a triticale plant, a rye plant, a buckwheat plant, a fonio plant, and a *quinoa* plant.

All publications and patent applications mentioned in this specification are herein incorporated by reference to the same extent as if each individual publication or patent application was specifically and individually indicated to be incorporated by reference.

The present invention is not limited by the specific embodiments described herein. The invention now being fully described, it will be apparent to one of ordinary skill in the art that many changes and modifications can be made thereto without departing from the spirit or scope of the appended claims. Modifications that become apparent from the foregoing description fall within the scope of the claims.

SEQUENCE LISTING (2372 sequences)

SEQ ID NO: 1 - DNA, 963 bp, Arabidopsis thaliana
  AT2G24570.1
atgaccgttgatattatgcgtttacctaagatggaagatcaaacggctatacaagaagctgcatcacaaggcttaaaaagcatggaacacttgattcgtgtcctctctaaccgtcccgaagaacgtaacgttgattgctctgagatcactgatttcacagtttctaagttcaagaaagttatctctcttcttaaccgttccggtcacgcccggtttagacgtggtccggttcattcccctccttcctcctccgttcctccaccggtgaaagtgacaactccggctcccactcagatctctgctccagcaccggttagcttcgttcaggcaaatcaacaaagcgtgacgttagatttcactagaccgagcgtttttggcgctaaaaccaagagctcggaggttgttgagtttgctaaagagagctttagcgtatcttctaactcttctttcatgtcttctgcgatcaccggtgatggaagtgtctctaaaggctcttcgatctttcttgctccggctccagcggtgccagtgacttcctccgggaaaccgccgctttctggtcttccttacaggaagagatgctttgaacatgaccactctgaaggcttttccggcaagatctctggctccggcaacggcaagtgccattgcaagaaaagccgaaaaaatcggatgaagagaaccgtgagagtaccggcggtaagtgcaaagatcgccgatataccaccagacgaatattcatggagaaagtatggacaaaaaccgatcaaaggctcaccacatccacggggttattacaagtgtagtacatttagaggatgtccagcgaggaaacacgtggaaagagctttggatgattcaacgatgttgattgtgacgtacgaaggagagcaccgtcatcaccagtccacgatgcaggagcatgtaactcctagcgtgagtggtttggtgtttggttcggct

SEQ ID NO: 2 - protein, 321 aa, Arabidopsis thaliana
  AT2G24570.1
MTVDIMRLPKMEDQTAIQEAASQGLKSMEHLIRVLSNRPEERNVDCSEITDFTVSKFKKVISLLNRSGHARFRRGPVHSPPSSSVPPPVKVTTPAPTQISAPAPVSFVQANQQSVTLDFTRPSVFGAKTKSSEVVEFAKESFSVSSNSSFMSSAITGDGSVSKGSSIFLAPAPAVPVTSSGKPPLSGLPYRKRCFEHDHSEGFSGKISGSGNGKCHCKKSRKNRMKRTVRVPAVSAKIADIPPDEYSWRKYGQKPIKGSPHPRGYYKCSTFRGCPARKHVERALDDSTMLIVTYEGEHRHHQSTMQEHVTPSVSGLVFGSA

SEQ ID NO: 3 - DNA, 975 bp, Arabidopsis thaliana
  AT4G31550.1
atggccgtcgatctaatgcgtttccctaagatagatgatcaaacggctattcaggaagctgcatcgcaaggtttacaaagtatggaacatctgatccgtgtcctctctaaccgtcccgaacaacaacacaacgttgactgctccgagatcactgacttcaccgtttctaaattcaaaaccgtcatttctctccttaaccgtactggtcacgctcggttcagacgcggaccggttcactccacttcctctgccgcatctcagaaactacagagtcagatcgttaaaaatactcaacctgaggctccgatagtgagaacaactacgaatcaccctcaaatcgttcctccaccgtctagtgtaacactcgatttctctaaaccaagcatcttcggcaccaaagctaagagcgccgagctggaattctccaaagaaaacttcagtgtttctttaaactcctcattcatgtcgtcggcgataaccggagacggcagcgtctccaatggaaaaatcttccttgcttctgctccgttgcagcctgttaactcttccggaaaaccaccgttggctggtcatccttacagaaagagatgtctcgagcatgagcactcagagagtttctccggaaaagtctccggctccgcctacggaaagtgccattgcaagaaaagcaggaaaaatcggatgaagagaaccgtgagagtaccggcgataagtgcaaagatcgccgatattccaccggacgaatattcgtggaggaagtacggacaaaaaccgatcaagggctcaccacacccacgtggttactacaagtgcagtacattcagaggatgtccagcgaggaaacacgtggaacgagcattagatgatccagcgatgcttattgtgacatacgaaggagagcaccgtcataaccaatccgcgatgcaggagaatatttcttcttcaggcattaatgatttagtgtttgcctcggct

SEQ ID NO: 4 - protein, 325 aa, Arabidopsis thaliana
  AT4G31550.1
MAVDLMRFPKIDDQTAIQEAASQGLQSMEHLIRVLSNRPEQQHNVDCSEITDFTVSKFKTVISLLNRTGHARFRRGPVHSTSSAASQKLQSQIVKNTQPEAPIVRTTTNHPQIVPPPSSVTLDFSKPSIFGTKAKSAELEFSKENFSVSLNSSFMSSAITGDGSVSNGKIFLASAPLQPVNSSGKPPLAGHPYRKRCLEHEHSESFSGKVSGSAYGKCHCKKSRKNRMKRTVRVPAISAKIADIPPDEYSWRKYGQKPIKGSPHPRGYYKCSTFRGCPARKHVERALDDPAMLIVTYEGEHRHNQSAMQENISSSGINDLVFASA

SEQ ID NO: 5 - DNA, 918 bp, Brachypodium distachyon
  Bradi3g18580.1
atggccgtcgacctgatgggacgcggcggcgggtacagcgccccgcgcgccgagcaggagcagcagcgcgcgttccaggacgccgccaccgcggggctccgcagcctggagctcctcgtctcctccctctcccctcgcgccgccgaccgagccacggcagccccgctcggcgagatcgcggaccagacggtctccaggttccgccgcgtcatcaacatgctcgaccgcaccggccacgcccgcttccgccgcggccccgtcgtctcttccccatcccccgccccaactccatcaaagccccctccggtctcttcttcttccccagcaccggcaccggcaccggcagtagcgcctgcgccaccgaagacgctcaccctggacttcaccaagcccaccaaggcagccgcatccgtgacttccacatccttcttctcctcggtcaccgcagccgggtgcggcggcggcggcggcgagggcagcgtctccaagggccagggccagatcgcgatctcctcgggcaagccgcccctcgccgcgggcaccaagcgcaagctccaacagcaactccagcagcagcagcagccgtgcgcgagcggcgcgcactcggacgcggcggcgccgtgccactgcgcgtcctcgaagaagcgcaagagccgggcgtcgaggcgcgccgtgcgcgtgccggccacgagcgcgcgcgccgccgacatccccggggacgagttctcctggcgcaagtacgggcagaagcccatcaagggctccccttacccgcggggatactacaagtgcagcaccgtcaaggggtgtccggcaaggaaacacgtcgagcgcgccaccgatgaccccgccatgctcgtcgtcacctacgagggcgaccaccgccacggcgccgacctccctgcgccggccgccaat

SEQ ID NO: 6 - protein, 306 aa, Brachypodium distachyon
  Bradi3g18580.1
MAVDLMGRGGGYSAPRAEQEQQRAFQDAATAGLRSLELLVSSLSPRAADRATAAPLGEIADQTVSRFRRVINMLDRTGHARFRRGPVVSSPSPAPTPSKPPPVSSSSPAPAPAPAVAPAPPKTLTLDFTKPTKAAASVTSTSFFSSVTAAGCGGGGGEGSVSKGQGQIAISSGKPPLAAGTKRKLQQQLQQQQQPCASGAHSDAAAPCHCASSKKRKSRASRRAVRVPATSARAADIPGDEFSWRKYGQKPIKGSPYPRGYYKCSTVKGCPARKHVERATDDPAMLVVTYEGDHRHGADLPAPAAN

SEQ ID NO: 7 - DNA, 921 bp, Oryza sativa
  LOC_Os08g13840.1
atggccgtggacctcatgggcttcagcccgcgcggcggctgccgcccgtccgtggagacggagcagctcgctttccaggaggccgccgccgcggggctccgcagcctcgagctgctcgtctcgtcgctctccgccgggggggagcaccaccaccgccgccgcccgcaggagaagcagtcttcgccgccgctgggggagatcgcggaccaggcggtgtccaggttcaggaaggtgatctcgattcttgaccggaccggccacgcccgcttccgccgtggccctgtcgtcggagcggcagctgcggaggcggctgccgcggcggcgtcggcgtcaccgtcgtcgtctcctgtctcgccgcctctcccgccggtgacgacgcagccggcggccgccgtgaagagcctgacgctggacttcacgaatcccgccaaggtcgcggcggcgtcggtgacctcgacgtcgttcttctcgtcggtcaccgccggcggagacggcagcgtgtccaagggccggagcctggtctcctccgggaagcccccgctcgccggcggcgtcaagcgcaagcacccgcacccgccctgcgccgccgccggcgacggccacggccacggcgcaggccacgcgcacgcgcacggcgggtgccactgctccaagaagcggaagcagcgggttcggcgcacggtgcgcgtggcggcggcgagcgcgcgggtggcggacatccccgccgacgagtactcgtggcgcaagtacgggcagaagccgatcaaggggtccccctacccgcgcggctactaccggtgcagcaccgtcaagggttgccccgcccggaagcacgtcgagcgcgccgccgacgaccccgccaccctcgtcgtcacctacgagggcgaccaccgccactcgccgccgccgccgccgcttgtt

SEQ ID NO: 8 - protein, 307 aa, Oryza sativa
  LOC_Os08g13840.1
MAVDLMGFSPRGGCRPSVETEQLAFQEAAAAGLRSLELLVSSLSAGGEHHHRRRPQEKQSSPPLGEIADQAVSRFRKVISILDRTGHARFRRGPVVGAAAAEAAAAAASASPSSSPVSPPLPPVTTQPAAAVKSLTLDFTNPAKVAAASVTSTSFFSSVTAGGDGSVSKGRSLVSSGKPPLAGGVKRKHPHPPCAAAGDGHGHGAGHAHAHGGCHCSKKRKQRVRRTVRVAAASARVADIPADEYSWRKYGQKPIKGSPYPRGYYRCSTVKGCPARKHVERAADDPATLVVTYEGDHRHSPPPPPLV

SEQ ID NO: 9 - DNA, 921 bp, Oryza sativa; identical to SEQ ID NO: 7
  LOC_Os08g13840.2

SEQ ID NO: 10 - protein, 307 aa, Oryza sativa; identical to SEQ ID NO: 8
  LOC_Os08g13840.2

SEQ ID NO: 11 - DNA, 933 bp, Zea mays
  GRMZM2G090594_T01
atggcggtggacctcatgtcctgcggcggcggggcgtacgagcaactggcgttccaggaggcagccgcggcggggctccgcagcctggagttgctcgcttcctcgctctccccgtgcggcgcggggcgggcggagtcgccgccgctcgggcagatcgccgaccaggcggtgtcccggttccggcgcgtcatcaacctgctggaccgcacggggcacgcccgcttccgccgcgcgcccgccgtcgccgcggtggagcccatagagacggagacgccagcgtcacagcaggcggcggcggagccgcctcatcaggctcagaacaaagccctgacgctggacttcgccaagtctgtcccgccggcagcgaacaagaaggccccgcgggcgccggccgtgtccgcgacttcgacctcgttcctgtcgtccgtgaccgcgggcggcgaagggagcgtgtccaaggggtgcagcctcgccgccgtgtcctcgggcaagccgcctctcccgaagcgcacgtcgccgtgccccgccgctgctccgccgggggcgcaccacgccgagtccggcgctggaggttgccactgctcgaagaagaagcgcagccggcagggcctgtcccggcgcacggtgcgcctacccgcggccgcggcaacgccggggtcgcagccgcccggccacgtgccggcgtcgtcggacgtaccccacgacgagtactcgtggcgcaagtacgggcagaagcccatcaaggggtccccttacccgcgcggctactaccggtgcagcagcgccaagggttgccccgcgcggaagcacgtggagcgcgccgccgacgacccggccgtgctcgtcgtcacctacgagggcgaccaccgccacgacggcgacggcgacggcgacggcggcgttggcgctggcgctgcccgctcccgcgcggcg

SEQ ID NO: 12 - protein, 311 aa, Zea mays
  GRMZM2G090594_T01
MAVDLMSCGGGAYEQLAFQEAAAAGLRSLELLASSLSPCGAGRAESPPLGQIADQAVSRFRRVINLLDRTGHARFRRAPAVAAVEPIETETPASQQAAAEPPHQAQNKALTLDFAKSVPPAANKKAPRAPAVSATSTSFLSSVTAGGEGSVSKGCSLAAVSSGKPPLPKRTSPCPAAAPPGAHHAESGAGGCHCSKKKRSRQGLSRRTVRLPAAAATPGSQPPGHVPASSDVPHDEYSWRKYGQKPIKGSPYPRGYYRCSSAKGCPARKHVERAADDPAVLVVTYEGDHRHDGDGDGDGGVGAGAARSRAA

SEQ ID NO: 13 - DNA, 894 bp, Setaria italica
  Si014163m
atggcggtggacctgatgtcatgcggcggcgcctacgagcacctggcgttccaggaggccgccgcggcggggctccgcagcctggagctcctggcgtcgtccctttccccgcgcgccgccgggagggcggagtccccgccgctcggggagatcgccgaccaggccgtctcccgcttccgccgcgtcatcaacctcctcgaccgcacgggccacgctcgcttccgccgcgcgcccgccgtttcccccgcggcggagacgacgcctcccgcgtctcctcgccccgcgccgcccgcggtggccgcgccgcctcagaagaatagcctgacgctggacttcaccaagccgtccccggcggcggcgaccaagcaggcggcggcgccggccgtgtccgcgacgtcgacctcgttcctgtcgtccgtgacggcgggcggcgagggcagcgtgtccaagggcggcagcctggccgtgtcctccggcaagccaccccttccgaagcgcaagcacccggctgcgtgccccacccccgccgcccccggcgcgcaccaccaccacggcgagcccggcgccgccgggcggtgccactgctcgaagaagccgaagcggagccggcaggggctgtcgcgccgcacggtgcgcgtgcccgccgtgggcacggcggcgccaggatcccaggcgccggcgtcgtcggacatccccgccgacgactactcgtggcgcaagtacgggcagaagcccatcaaggggtccccctacccgcgcggctactaccggtgcagctccgccaagggttgccccgcccggaagcacgtggagcgcgccgccgacgaccccgccacgctcgtcgtcacctacgagggcgaccaccgccacgacggccccgccggccacgcggcg

SEQ ID NO: 14 - protein, 298 aa, Setaria italica
  Si014163m
MAVDLMSCGGAYEHLAFQEAAAAGLRSLELLASSLSPRAAGRAESPPLGEIADQAVSRFRRVINLLDRTGHARFRRAPAVSPAAETTPPASPRPAPPAVAAPPQKNSLTLDFTKPSPAAATKQAAAPAVSATSTSFLSSVTAGGEGSVSKGGSLAVSSGKPPLPKRKHPAACPTPAAPGAHHHHGEPGAAGRCHCSKKPKRSRQGLSRRTVRVPAVGTAAPGSQAPASSDIPADDYSWRKYGQKPIKGSPYPRGYYRCSSAKGCPARKHVERAADDPATLVVTYEGDHRHDGPAGHAA

SEQ ID NO: 15 - DNA, 933 bp, Brachypodium distachyon
  Bradi5g20700.1
atggccgtggacctcatgggctgcttcgccccgcgccgcgccgacgaccagctcgccatccaggaggcggccgccgccggcctccgcagcctggagctcctcgtctcgtccctctccgccgcgccttcttccaaggcggcgcatcctcaacagcagcagcagcagccgttcggggagatcgccgaccaggccgtctccaagttccgcaaggtgatctccatcctcgaccgcaccggccacgcccgcttccgccgcgggcccgtcgagtcgccgcctcacgctccggtcgtctctgcccctcccccgcctccgccgccgcaggctgcccctgtggctaccgtcgtcgcgccggtggttgtcgcgccgcagccgcagccgcagagcctgacgctcgacttcaccaagccgaacctgaccatgtcggccgcaacctccgtgacctccacctccttcttctcgtccgtgaccgccggcgaggggagcgtctccaagggccggagcctgggcaagccgccgctgtccgggcacaagaggaagccctgcgccggcgcgcactccgaggccaacaccaccggcagccgatgccactgctccaagagaagaaagaaccgcgtgaagacgacgatcagagtgccggcggtgagctccaagatcgccgacatcccggcggacgagttctcgtggaggaagtacggccagaagcccatcaagggatccccttacccacggggatactacaagtgcagcacagtaagagggtgcccggcgaggaagcacgtggagcgcgccaccgacgacccggcgatgctggtggtgacgtacgagggcgagcaccgccactcgccggtgcccctgggtgcgccgtcgccgatgccgcccatgtccgccgccgcttccggcgtagctagtctttctgccggcaacgggcatgcc

SEQ ID NO: 16 - protein, 311 aa, Brachypodium distachyon
  Bradi5g20700.1
MAVDLMGCFAPRRADDQLAIQEAAAAGLRSLELLVSSLSAAPSSKAAHPQQQQQQPFGEIADQAVSKFRKVISILDRTGHARFRRGPVESPPHAPVVSAPPPPPPPQAAPVATVVAPVVVAPQPQPQSLTLDFTKPNLTMSAATSVTSTSFFSSVTAGEGSVSKGRSLGKPPLSGHKRKPCAGAHSEANTTGSRCHCSKRRKNRVKTTIRVPAVSSKIADIPADEFSWRKYGQKPIKGSPYPRGYYKCSTVRGCPARKHVERATDDPAMLVVTYEGEHRHSPVPLGAPSPMPPMSAAASGVASLSAGNGHA

SEQ ID NO: 17 - DNA, 927 bp, Oryza sativa
  LOC_Os04g51560.1
atggccgtggacctgatgggctgctacgccccgcgccgcgcagacgaccagctcgccatccaggaggcggccaccgccggcctccgcagcctggagatgctcgtgtcgtccctctcctcctcctctcaggccgccggggctcacaaggcctcgccgcagcagcagccgttcggcgagatcgccgaccaggccgtctccaagttccgcaaggtcatctccatcctcgaccgcaccggccacgcccgcttccgccgcggcccggtcgagtcgtctgctcccgccgcccccgtcgctgctgctccccctcctcctcctccaccaccggcgccggtcgctgccgccctcgcgccgacctcctcgcagccgcagaccctgacgctggacttcacgaagccgaacctgaccatgtcggccgcgacgtccgtgacatccacgtcgttcttctcgtcggtgacggccggcgagggaagcgtttccaagggccggagcctgctctcctccggcaagccgccgctgtctgggcacaagcggaagccctgcgccggcggccactccgaggccaccgccaacggcggccgctgccactgctccaagagaaggaagaaccgggtgaagaggacgatccgagtgccggcaatcagctcgaagatcgccgacatcccgccggacgaatactcgtggaggaagtacggccagaaacccatcaagggctccccttacccacggggctactacaagtgcagcacagtgagaggatgccccgcgcggaagcacgtggagcgcgccaccgacgacccggcgatgctggtcgtgacctacgagggcgagcaccgccacacgccggggcccctcccggcgccacccgccgccgccgccgtcgccgcgatgccggtgtccgtcgccgtgtccaccggcaacggacatgtc

SEQ ID NO: 18 - protein, 309 aa, Oryza sativa
  LOC_Os04g51560.1
MAVDLMGCYAPRRADDQLAIQEAATAGLRSLEMLVSSLSSSSQAAGAHKASPQQQPFGEIADQAVSKFRKVISILDRTGHARFRRGPVESSAPAAPVAAAPPPPPPPPAPVAAALAPTSSQPQTLTLDFTKPNLTMSAATSVTSTSFFSSVTAGEGSVSKGRSLLSSGKPPLSGHKRKPCAGGHSEATANGGRCHCSKRRKNRVKRTIRVPAISSKIADIPPDEYSWRKYGQKPIKGSPYPRGYYKCSTVRGCPARKHVERATDDPAMLVVTYEGEHRHTPGPLPAPPAAAAVAAMPVSVAVSTGNGHV

SEQ ID NO: 19 - DNA, 1008 bp, Triticum aestivum
  ACD80370.1
agagcgcaaccgggacagcgagccaagatctgcagagccacaggtgacctcacaccggcgaccatggccgtggacctcatgggctgctacacccctcgccgcgccgacgaccagctcgccatccaggaggccgccaccgccggcctccgcagcctggagctcctcgtctcctccctctccggcgcggcgccgtccaaggcgccgcagcagcacccgcagcagccgttcggcgagatcgccgaccaggccgtctccaagttccgcaaggtgatctccatcctcgaccgcaccggccacgcccgcttccgccgcggccccgtccagtcgcctaccccgcctcctccggctccggtcgctcctccgccgcccccaccgcgccctctggccgtcgtcgagccggccaggcccgctcccttgaccgtcgtggcgccggtgtcggtggccgccccggtcccgcagccgcagagcctgacgctggacttcaccaagccgaacctgaccatgtcgggcgcgacgtccgtcacgtccacgtccttcttctcgtcggtgaccgccggcgagggcagcgtgtccaagggccgcagcctggtctccgccggcaagccgccgctgtccgggcacaagagaaagccctgcgccggcgcgcactcggaggccaacaccaccggcagccgatgccactgctccaagagaaggaagaaccgcgtgaagacgacggtgagggtgcccgcggtgagcgcgaagatcgccgacatcccgccggacgagtactcgtggaggaagtacggccagaagcccatcaagggatccccttacccacggggtactacaagtgcagcacagtgcgggggtgcccggcgcgggaagcacgtggagcgcgccctggacgacccggcgatgctggtggtgacctacgagggcggagcaccgccactcgccggggccgatgccgatgcagatggcgccgtcgcctatgccgatgccgatgggcgctcccgtcgccgtagc

SEQ ID NO: 20 - protein, 336 aa, Triticum aestivum
  ACD80370.1
RAQPGQRAKICRATGDLTPATMAVDLMGCYTPRRADDQLAIQEAATAGLRSLELLVSSLSGAAPSKAPQQHPQQPFGEIADQAVSKFRKVISILDRTGHARFRRGPVQSPTPPPPAPVAPPPPPPRPLAVVEPARPAPLTVVAPVSVAAPVPQPQSLTLDFTKPNLTMSGATSVTSTSFFSSVTAGEGSVSKGRSLVSAGKPPLSGHKRKPCAGAHSEANTTGSRCHCSKRRKNRVKTTVRVPAVSAKIADIPPDEYSWRKYGQKPIKGSPYPRGTTSAAQCGGARRGKHVERALDDPAMLVVTYEGGAPPLAGADADADGAVAYADADGRSRRRS

SEQ ID NO: 21 - DNA, 894 bp, Zea mays
  GRMZM2G071907_T01
atggccgtggacctgatgggctgctacgccccgcgccgcgccaacgaccagctcgccatccaggaggcggcggcggccgggctccgcaacctggagctgctggtgacgtccctgtccacgcaggccgccgcgccgcacagagccgctgatcagccgttcggcgagatcgccggccaggccgtctccaagttccgcaaggtcatctccatcctcgaccgcacggggcacgcccgcttccgccgcgggcccgtcgagccgccgccgccgacgccgccgccgcctcctgtcgtccccggtcctgcccccctggcggccgtcagcgtggcgcagccgccgcagagcctgacgctggacttcacgaagccgaacctggccgtgtcggccgccacgtccgtcacctccacgtccttcttctcgtcggtcacggccggcgagggcagcgtctccaagggccggagcctcatgtcctccgggaagccgccgctgtccggccacaagcggaagccctgcgccggcgcccactccgaggccaccaccaacggcagccgttgccactgctccaagagaaggaagaaccgcgtgaagaggaccatcagagtgccggcgatcagctcgaaggtcgccgacatcccttcggacgagtactcgtggaggaagtacggccagaagcccatcaagggctccccttacccacggggctactacaagtgcagcactgtgcggggatgcccggcgaggaagcacgtggagcgggccaccgacgacccggccatgctggtggtgacgtacgagggcgagcaccgccacacgccgggcgcggtccaggggccgagccccctggcgaccgcgtcgccggtgcccgtcgccgtctccgccggcaacgggctcgttgtc

SEQ ID NO: 22 - protein, 298 aa, Zea mays
  GRMZM2G071907_T01
MAVDLMGCYAPRRANDQLAIQEAAAAGLRNLELLVTSLSTQAAAPHRAADQPFGEIAGQAVSKFRKVISILDRTGHARFRRGPVEPPPPTPPPPPVVPGPAPLAAVSVAQPPQSLTLDFTKPNLAVSAATSVTSTSFFSSVTAGEGSVSKGRSLMSSGKPPLSGHKRKPCAGAHSEATTNGSRCHCSKRRKNRVKRTIRVPAISSKVADIPSDEYSWRKYGQKPIKGSPYPRGYYKCSTVRGCPARKHVERATDDPAMLVVTYEGEHRHTPGAVQGPSPLATASPVPVAVSAGNGLVV

SEQ ID NO: 23 - DNA, 855 bp, Zea mays
  GRMZM2G071907_T03
atggccgtggacctgatgggctgctacgccccgcgccgcgccaacgaccagctcgccatccaggaggcggcggcggccgggctccgcaacctggagctgctggtgacgtccctgtccacgcaggccgccgcgccgcacagagccgctgatcagccgttcggcgagatcgccggccaggccgtctccaagttccgcaaggtcatctccatcctcgagccgccgccgccgacgccgccgccgcctcctgtcgtccccggtcctgcccccctggcggccgtcagcgtggcgcagccgccgcagagcctgacgctggacttcacgaagccgaacctggccgtgtcggccgccacgtccgtcacctccacgtccttcttctcgtcggtcacggccggcgagggcagcgtctccaagggccggagcctcatgtcctccgggaagccgccgctgtccggccacaagcggaagccctgcgccggcgcccactccgaggccaccaccaacggcagccgttgccactgctccaagagaaggaagaaccgcgtgaagaggaccatcagagtgccggcgatcagctcgaaggtcgccgacatcccttcggacgagtactcgtggaggaagtacggccagaagcccatcaagggctccccttacccacggggctactacaagtgcagcactgtgcggggatgcccggcgaggaagcacgtggagcgggccaccgacgacccggccatgctggtggtgacgtacgagggcgagcaccgccacacgccgggcgcggtccaggggccgagccccctggcgaccgcgtcgccggtgcccgtcgccgtctccgccggcaacgggctcgttgtc

SEQ ID NO: 24 - protein, 285 aa, Zea mays
  GRMZM2G071907_T03
MAVDLMGCYAPRRANDQLAIQEAAAAGLRNLELLVTSLSTQAAAPHRAADQPFGEIAGQAVSKFRKVISILEPPPPTPPPPPVVPGPAPLAAVSVAQPPQSLTLDFTKPNLAVSAATSVTSTSFFSSVTAGEGSVSKGRSLMSSGKPPLSGHKRKPCAGAHSEATTNGSRCHCSKRRKNRVKRTIRVPAISSKVADIPSDEYSWRKYGQKPIKGSPYPRGYYKCSTVRGCPARKHVERATDDPAMLVVTYEGEHRHTPGAVQGPSPLATASPVPVAVSAGNGLVV

SEQ ID NO: 25 - DNA, 948 bp, Zea mays
  GRMZM2G091331_T01
atggccgtggacctgatggggtgctacgccccgcgccgcgccaacgaccagctcgccatccaggaggcggcggcggcggggctccgcagcctggagctcctcgtgtcgtcgctgtccacgcaggccgccgcgccgcacagggccgcggctcaccagctgcagaagccgccttcgcagccgccgatcggcgagatcgccgaccaggccgtctccaggttccgcaaggtcatctccatcctggaccgcaccggccacgcccgcttccggcgcgggcccgtggtcgaggcgccgccaccggtgcctcctccggccgtctccgctcccgctctccccgtggcgcacgtggtggctcccgtcggcgcggcgcagccccagagcctgaccctggacttcacgaagccgaacctggccgtgtcgggcggcgccacgtccgtcacctccacgtccttcttctcctcggtcacggccggcgagggcagcgtgtccaagggccgcagcctggtgtcctccggcaagccgccgctgtccggccacaagcggaagccctgcgccggcgcgcactccgaggccaccaccaacggcagccgctgccactgctccaagagaaggaaaaaccgcgtgaagaggaccatcagagtgccggcgatcagcgccaagatcgcggacatcccgccggacgagtactcgtggaggaagtacggccagaagcccatcaagggctccccctacccacggggctactacaagtgcagcaccgtgcgcgggtgcccggcgaggaagcacgtggagcgcgccaccgacgacccggccatgctggtggtgacgtacgagggcgagcaccgccacacgccgggcgcgcccgcgcccgcgcccagccccctggcggccgcgtcgccggtgcccgcctccgccgccgccgccgtctccgccggcaacaacgggcttgtc

SEQ ID NO: 26 - protein, 316 aa, Zea mays
  GRMZM2G091331_T01
MAVDLMGCYAPRRANDQLAIQEAAAAGLRSLELLVSSLSTQAAAPHRAAAHQLQKPPSQPPIGEIADQAVSRFRKVISILDRTGHARFRRGPVVEAPPPVPPPAVSAPALPVAHVVAPVGAAQPQSLTLDFTKPNLAVSGGATSVTSTSFFSSVTAGEGSVSKGRSLVSSGKPPLSGHKRKPCAGAHSEATTNGSRCHCSKRRKNRVKRTIRVPAISAKIADIPPDEYSWRKYGQKPIKGSPYPRGYYKCSTVRGCPARKHVERATDDPAMLVVTYEGEHRHTPGAPAPAPSPLAAASPVPASAAAAVSAGNNGLV

SEQ ID NO: 27 - DNA, 1011 bp, Setaria italica
  Si010545m
atgtcagccccaagccaagatctgcgcggccagtccaccggcgaagcaccggctgccatggccgtggacctcatgggctgctacgccccgcgccgcgccaacgaccagctcgccatccaggaggcggcggcggccggcctccgcagcctggagctcctggtctcgtccctgtcctcccaggccgccgcgccgcaaaaagcagctcagcagcttcagcatcagcagcagccgttcggcgagatcgccgaccaggccgtctccaagttccgcaaggtgatctccatcctcgaccgcaccggccacgcccgcttccgccgcgggcccgtcgagtcgccggccccggtggcctcggcgccggtggtcgccgctcctgcggctcccccggcacccttgccgcacgtggcgcccgtcagcgtggcgcagccggcgccggccccgcagccgcagagcctgacgctggacttcacgaagccgaacctgaccatgtcggccgcgacgtccgtgacctcgacgtcgttcttctcctcggtgaccgccggcgaggggagcgtctccaagggccggagcctgatgtccgccgggaagccgccgctgtccgggcacaagcggaagccctgcgccggcgcgcactccgaggccaccgccaacggcggcagccgctgccactgctccaagagaaggaaaaaccgtgtgaagaggaccatcagagtgccggcgatcagctccaagatcgccgacatcccgccggatgagtactcctggaggaagtacggccagaaacccatcaagggctccccttacccacggggctactacaagtgcagcaccgtccgcggctgcccggcgaggaagcacgtggagcgcgcgaccgacgaccccgcgatgctggtggtgacgtacgagggcgagcaccgccacacaccgggagcggcggggccgagccccctggcaaccgcgtcgccggtggccgccgccgtagccgctagcgtctccgccggcaacggccatgcc

SEQ ID NO: 28 - protein, 337 aa, Setaria italica
  Si010545m
MSAPSQDLRGQSTGEAPAAMAVDLMGCYAPRRANDQLAIQEAAAAGLRSLELLVSSLSSQAAAPQKAAQQLQHQQQPFGEIADQAVSKFRKVISILDRTGHARFRRGPVESPAPVASAPVVAAPAAPPAPLPHVAPVSVAQPAPAPQPQSLTLDFTKPNLTMSAATSVTSTSFFSSVTAGEGSVSKGRSLMSAGKPPLSGHKRKPCAGAHSEATANGGSRCHCSKRRKNRVKRTIRVPAISSKIADIPPDEYSWRKYGQKPIKGSPYPRGYYKCSTVRGCPARKHVERATDDPAMLVVTYEGEHRHTPGAAGPSPLATASPVAAAVAASVSAGNGHA

SEQ ID NO: 29 - DNA, 933 bp, Brachypodium distachyon
  Bradi5g04817.1
atgatgaccatggatctgatgggaggatacgggcgggcggacgagcaggcggcgatccaggaggcggcggcggcggggctgcgcgggatggagcacctcatcctgcggctctcccagacgggcaccggcgccgagagctccccggccgtcgcggcaccggagcaggccaaggggaagcagcagcagcagcaggagcaggtggactgcagggagatcacggacatgacggtgtccaagttcaagaaggtgatctccatcctcaaccgcaccggccacgccaggttccggcgcggccccgtggtggcgcagtcccagggccccgagcaccagcagcaggcgccggtggtagtaaggtcttcttccgtgacgctggacttcaccaaggccgggtacgggaataaggacgccgggctgagcgtctctgccgcgaccgcgagctcgtcgtttctgtcgtcggtgaccggtgacgggagcgtgtccaacgggcgcgctggcgtgtcctcttccatggtgttcccgccgccgccttcggccagctgcgggaagccgccgctggctgcgaagcacaagtgccacgaccacgcgcactccgagaacgtcgccggcgcctccggtggccgctgccactgctccaagcgcaggaagtctcgggtgaggcggatgacccgcgtgccggccatcagttccaaggcggccgagatcccggccgacgatttctcgtggcgcaagtacgggcagaagcccatcaagggctccccctatccgcgaggctactacaaatgcagcacggtgcgcgggtgcccggcgcggaagcacgtggagcgcgaccccagcgagccctccatgctcatcgtcacctacgaaggcgaccaccgccacgcgcccgccgaccaggagccgccgccgccgccgctcgccgcactccacgagctt

SEQ ID NO: 30 - protein, 311 aa, Brachypodium distachyon
  Bradi5g04817.1
MMTMDLMGGYGRADEQAAIQEAAAAGLRGMEHLILRLSQTGTGAESSPAVAAPEQAKGKQQQQQEQVDCREITDMTVSKFKKVISILNRTGHARFRRGPVVAQSQGPEHQQQAPVVVRSSSVTLDFTKAGYGNKDAGLSVSAATASSSFLSSVTGDGSVSNGRAGVSSSMVFPPPPSASCGKPPLAAKHKCHDHAHSENVAGASGGRCHCSKRRKSRVRRMTRVPAISSKAAEIPADDFSWRKYGQKPIKGSPYPRGYYKCSTVRGCPARKHVERDPSEPSMLIVTYEGDHRHAPADQEPPPPPLAALHEL

SEQ ID NO: 31 - DNA, 978 bp, Oryza sativa
  LOC_Os04g21950.1
atgattaccatggatctgatgggtgggtacgggcgggtggacgagcaggtggccatccaggaggcggcggcggcggggctaagggggatggagcatcttattctgcagctgtcccagactgggacgagcgagaggtcgccggcgccggcgcaggagcagcagcaacaggtggactgcagggagatcacggacatgacggtgtccaagttcaagaaggtgatctccatgctgaaccgcaccggccacgcgcggttccggcggggcccggtggtggcgcagtcgtcgggcccggcggcgtccgagccggcgccggtgaggtcgtccccgtcggcggtgtcgaggcccatgacgctcgacttcaccaaggcggcgtccgggtacggcaaggacgccgggttcagcgtctccggcatctccgccgcgagctcgtccttcctctcgtcggtcaccggcgacggcagcgtgtccaacgggcgcggcggcgggtcatcctccctgatgcttcccccgccgccggcgaccagctgcggcaagccaccgctgtcctccgccgccgccgccatgtcagccggcgcaggccacaagcgcaagtgccacgaccacgcgcactccgagaacgtcgccggcggcaagtacggatccaccggcggccgctgccactgctccaagcgccggaagcatcgggtgaagaggacgatccgcgtgccggcgataagctcgaaggtggcggacatccccgccgacgacttctcgtggcggaagtacgggcagaagcccatcaagggctcccccttcccacgaggatactacaagtgtagcacgctgcgcggttgcccggcgaggaagcacgtggagcgcgacccgaccgacccgtccatgctcatcgtcacctacgagggcgagcaccgccactccccctccgccgccggccaggaccacccgccggcgccgcctccgccgctggcgctgccgctcgcc

SEQ ID NO: 32 - protein, 326 aa, Oryza sativa
  LOC_Os04g21950.1
MITMDLMGGYGRVDEQVAIQEAAAAGLRGMEHLILQLSQTGTSERSPAPAQEQQQQVDCREITDMTVSKFKKVISMLNRTGHARFRRGPVVAQSSGPAASEPAPVRSSPSAVSRPMTLDFTKAASGYGKDAGFSVSGISAASSSFLSSVTGDGSVSNGRGGGSSSLMLPPPPATSCGKPPLSSAAAAMSAGAGHKRKCHDHAHSENVAGGKYGSTGGRCHCSKRRKHRVKRTIRVPAISSKVADIPADDFSWRKYGQKPIKGSPFPRGYYKCSTLRGCPARKHVERDPTDPSMLIVTYEGEHRHSPSAAGQDHPPAPPPPLALPLA

SEQ ID NO: 33 - DNA, 993 bp, Zea mays
  GRMZM2G102583_T02
atgacgaccctcgatctgatgggagggtacgggcgggtggacgagcaggtggccatccaggaggccgccacggcggggctgcgcgggatggagcgtctcatcttgcagctctcccaggctggcaccggggagcggtcgttgtccccaccggcggtacaggcgcagcgccagcagcagaagcagctggagcagatccagcagcaggttgactgccgggagctcacggacatgacggtgtccaagttcaagaaggtgatctccatcctgaaccgcacggggcacgcgcggttccggcgtggccccgtggcggcgcggtcgcagtcgcagtcgcagggacctgcctcccccgagcccgcgcaatcggcgccggctcccgccgcgaggcccctgacgctggacttcaccaagtcggtgtccggttacagcagggactccgggttcagcgtgtccggcgcgagctcgtcgttcctgtcgtcggtgacgaccggggacgggagcgtgtcgaacgggcgcgcgggaggctcgtcgttcctcatgttcccaccggcgcccggcgcggccagctgcgcgaagccgccgcccgccggtgcggcgcagaagcgcaagtgccacgaccacgcgcactcggagaacgtcgccggcggcaagtacggggctaacggcgggcgctgccactgctcgaagcgcaggaagcaccgtgtgaagcgcacgatccgcgtgccggcgatcagccccaaagtggcggacatccccgccgacgagtactcgtggcgcaagtacggccagaaacccatcaaggggtcgccctacccacgcggctactacaagtgcagcacggtgcgcggctgccccgcccggaagcatgtggagcgcgaccccgccgacccgtcgatgctgatcgtcacctacgagggcgagcaccgccacagccccgcctccggccaggacccgccgccgccgtcgctcgcgccgctgccggagctgcccagccat

SEQ ID NO: 34 - protein, 331 aa, Zea mays
  GRMZM2G102583_T02
MTTLDLMGGYGRVDEQVAIQEAATAGLRGMERLILQLSQAGTGERSLSPPAVQAQRQQQKQLEQIQQQVDCRELTDMTVSKFKKVISILNRTGHARFRRGPVAARSQSQSQGPASPEPAQSAPAPAARPLTLDFTKSVSGYSRDSGFSVSGASSSFLSSVTTGDGSVSNGRAGGSSFLMFPPAPGAASCAKPPPAGAAQKRKCHDHAHSENVAGGKYGANGGRCHCSKRRKHRVKRTIRVPAISPKVADIPADEYSWRKYGQKPIKGSPYPRGYYKCSTVRGCPARKHVERDPADPSMLIVTYEGEHRHSPASGQDPPPPSLAPLPELPSH

SEQ ID NO: 35 - DNA, 1095 bp, Setaria italica
  Si012025m
ctgcccctgcggctctggcctccttcccacttctcctcctccttccctgttctccgctccggtgcggcggcaagcactccggcgagcgcgatgatgaccctggacctgatgggagggtacgggcgggtggacgaacaggtggccatccaggaggcggcggcggcggggctgcgcgggatggagcacctcatctcgcagctctcccgtgccggcaccggcgagcggccgtcgtcgccgccgccagggacggctccggcgcagcaacatcagcagcagctgccggagcagagccacccgcagcagcaggtggactgccgcgagatcacggacatgacggtgtccaagttcaagaaggtgatctccatcctgaaccgcacgggccacgcccggttccggcgcggccccatggtggcgcagtctccgggcccggcggccgcctgctccgagcccgcggcgctcccggcgcggtcagccccggcggcgaggcccgtgacgctggacttcaccaagtcggtgtccgggtacagccgggactccgggttcagcgtgtccggcgccagctcgtcgttcctgtcgtcggtgacgaccggcgacgggagcgtgtcgaacgggcgcggcggcggcgggtcgtcgtcgctgatgctcccgccggcggccggggcggccagctgcgggaagccgccgctgtcgtcgtccggcgccgggcagaagcgcaggtgccacgagcacgcgcactcggagaacgtcgccggcggcaagtacggggccaacggcgggcgatgccactgctccaagcgcaggaagcacagggtgaagcgcacgatccgcgtgccggcgatcagcccgaaggttgcggacatccccgccgacgagtactcgtggcgcaagtacgggcagaagcccatcaagggatctccatacccgcggggatactacaagtgcagcacggtgcgcggttgccccgcgcggaagcacgtggagcgcgaccccggcgagccgtcgatgctgatcgttacctacgagggcgagcaccgccacagccccgccggccaggacccgccgccgctcgccccgctgccggagctgcccaaccat

SEQ ID NO: 36 - protein, 365 aa, Setaria italica
  Si012025m
LPLRLWPPSHFSSSFPVLRSGAAASTPASAMMTLDLMGGYGRVDEQVAIQEAAAAGLRGMEHLISQLSRAGTGERPSSPPPGTAPAQQHQQQLPEQSHPQQQVDCREITDMTVSKFKKVISILNRTGHARFRRGPMVAQSPGPAAACSEPAALPARSAPAARPVTLDFTKSVSGYSRDSGFSVSGASSSFLSSVTTGDGSVSNGRGGGGSSSLMLPPAAGAASCGKPPLSSSGAGQKRRCHEHAHSENVAGGKYGANGGRCHCSKRRKHRVKRTIRVPAISPKVADIPADEYSWRKYGQKPIKGSPYPRGYYKCSTVRGCPARKHVERDPGEPSMLIVTYEGEHRHSPAGQDPPPLAPLPELPNH

SEQ ID NO: 37 - DNA, 921 bp, Setaria italica
  Si017889m
atgatcaccatcgacgatctgatgagctgcagcagcggcggcggtggggctccggtggttcctagcgacgacgggcaggtggcgacgacgtcgtggcagcaaatgatggcggtgggcgaccaccaactgacggtgtccaggatccgggcggcggtgtccatgctcggccgccgcacgggccacgcgcgcttccgccgcggccccgtcgccgtggcggacggccacccgccgtcgtcgtcggaccaccaccagcagcagccgtcggggagctcggcgctgggcttcgtcaagaaggggtgcgatgaggcggcgccaagcgcgtcggcctcggggggcagctcgtcgctcccctcgacgacgacgccgacgagccttaccgccggtggcgaagggagcgtgtccaacggccgcgtgcagggccgctttcctctgatgagcggcagcgccaccggcaaagcggtatcgatgcagcagcagcctgccgcctccgattattacccctccggcggcgccgcgctgagaagcaagtcccacggcggccgcgcgcgctccgagaacgacgccggcggcaaggcggcgcacgccggcctctgccactgctccaagaaacggaagtcgcgcgtgaggcggatggtccgcgtgccggcgatcagctcccggaacgccgacatcccgccggacgactactcctggcgcaagtacggccagaagcccatcaagggctcgccgtacccacgcgggtactacaagtgcagcacggtgcgcgggtgcccggcgcggaagcacgtggagcgcgaccccggcgagccggcgatgctcatcgtcacctacgagggcgaccaccgccacgacggccagcaggaccggggggcctccgccgccgctgccgccacgcagcctgagcacacggcgacgtccact

SEQ ID NO: 38 - protein, 307 aa, Setaria italica
  Si017889m
MITIDDLMSCSSGGGGAPVVPSDDGQVATTSWQQMMAVGDHQLTVSRIRAAVSMLGRRTGHARFRRGPVAVADGHPPSSSDHHQQQPSGSSALGFVKKGCDEAAPSASASGGSSSLPSTTTPTSLTAGGEGSVSNGRVQGRFPLMSGSATGKAVSMQQQPAASDYYPSGGAALRSKSHGGRARSENDAGGKAAHAGLCHCSKKRKSRVRRMVRVPAISSRNADIPPDDYSWRKYGQKPIKGSPYPRGYYKCSTVRGCPARKHVERDPGEPAMLIVTYEGDHRHDGQQDRGASAAAAATQPEHTATST

SEQ ID NO: 39 - DNA, 1026 bp, Citrus clementina
  clementine0.9_014855m
atggcggtggagctgatgggatttccaaaaaggatgatggaagatcagacggcgatacaagaagctgcaacgcaagggatcaaaagcatggagcacctgatccgtctcatgtctcatcaccaatcctcgaatcacgttgactgctcggacctcaccgatctcaccgtctctaagttcaaaaaagtcatttccctgctcaaccgaaccggtcacgcccggttcaggcgcgggccggttcactcttcgccttcatcttcatctgcatctgcgccagccgccgccgccgcctcaggcaactctccacacacacagaccttaactcttactccgcctgctcctacgatggctgtcgctccctctacggcgagttacgtccagtcacagccgcacagtctgactcttgattttacaaaacctagtttgtttagcggaaacgtcaagagcactgagctcgagttttccaaagacagcttctgtgtgtcgtcgaactcgtccttcatgtcctctgctatcaccggagacggcagcgtttcgaacgggaagcaaggaggatcttcgatcttcttggcgccacaagctcctgctgtttccgctggaaagccgccgctcgcggctcagccttacaagaagaggtgtcaagatcataaagatcattccgatgatctttccggcaagttctccggctccacctctggcaacaacaagtgtcactgctctaagagaaggaaaaaccgagtaaagaaaactattagagtgccggcgattagttcaaaaatagccgatattccaccggacgagtattcttggaggaagtatggtcaaaagccgatcaagggctcaccatacccacgcggctattacaagtgcagtacaatgagagggtgcccagccaggaaacacgtggagagggcaccagacgatccaacgatgctgattgtgacgtacgaaggagagcaccggcattcgcaggccgcgatgcaggagaacgcggcccctgctggagtgggtttggttttcgagtcaacg

SEQ ID NO: 40 - protein, 342 aa, Citrus clementina
  clementine0.9_014855m
MAVELMGFPKRMMEDQTAIQEAATQGIKSMEHLIRLMSHHQSSNHVDCSDLTDLTVSKFKKVISLLNRTGHARFRRGPVHSSPSSSSASAPAAAAASGNSPHTQTLTLTPPAPTMAVAPSTASYVQSQPHSLTLDFTKPSLFSGNVKSTELEFSKDSFCVSSNSSFMSSAITGDGSVSNGKQGGSSIFLAPQAPAVSAGKPPLAAQPYKKRCQDHKDHSDDLSGKFSGSTSGNNKCHCSKRRKNRVKKTIRVPAISSKIADIPPDEYSWRKYGQKPIKGSPYPRGYYKCSTMRGCPARKHVERAPDDPTMLIVTYEGEHRHSQAAMQENAAPAGVGLVFEST

SEQ ID NO: 41 - DNA, 852 bp, Citrus clementina
  clementine0.9_017878m
atggcggtggagctgatgggatttccaaaaaggatgatggaagatcagacggcgatacaagaagctgcaacgcaagggatcaaaagcatggagcacctgatccgtctcatgtctcatcaccaatcctcgaatcacgttgactgctcggacctcaccgatctcaccgtctctaagttcaaaaaagtcatttccctgctcaaccgaaccggtcacgcccggttcaggcgcgggccggttcactcttcgccttcatcttcatctgcatctgcgccagccgccgccgccgcctcaggcaactctccacacacacagaccttaactcttactccgcctgctcctacgatggctgtcgctccctctacggcgagttacgtccagtcacagccgcacagtctgactcttgattttacaaaacctagtttgtttagcggaaacgtcaagagcactgagctcgagttttccaaagacagcttctgtgtgtcgtcgaactcgtccttcatgtcctctgctatcaccggagacggcagcgtttcgaacgggaagcaaggaggatcttcgatcttcttggcgccacaagctcctgctgtttccgctggaaagccgccgctcgcggctcagccttacaagaagaggtgtcaagatcataaagatcattccgatgatctttccggcaagttctccggctccacctctggcaacaacaagtgtcactgctctaagagaaggaaaaaccgagtaaagaaaactattagagtgccggcgattagttcaaaaatagccgatattccaccggacgagtattcttggaggaagtatggtcaaaagccgatcaagggctcaccatacccacgg

SEQ ID NO: 42 - protein, 284 aa, Citrus clementina
  clementine0.9_017878m
MAVELMGFPKRMMEDQTAIQEAATQGIKSMEHLIRLMSHHQSSNHVDCSDLTDLTVSKFKKVISLLNRTGHARFRRGPVHSSPSSSSASAPAAAAASGNSPHTQTLTLTPPAPTMAVAPSTASYVQSQPHSLTLDFTKPSLFSGNVKSTELEFSKDSFCVSSNSSFMSSAITGDGSVSNGKQGGSSIFLAPQAPAVSAGKPPLAAQPYKKRCQDHKDHSDDLSGKFSGSTSGNNKCHCSKRRKNRVKKTIRVPAISSKIADIPPDEYSWRKYGQKPIKGSPYPR

SEQ ID NO: 43 - DNA, 1029 bp, Eucalyptus grandis
  Eucgr.C04011.1
atggcgatcgagctgcatcttggcttctccaagatggaggatcacacggcgatacaggaggccgcgtctcaggggctgaagaccatggagcacctgatcggcgtcctctcccgccagaacctccaccaccccggcgccgtcgactgcaccgacctcaccgaccggaccgtctccaagttcaggaaggtcatctccctcctggaccgcaccggccacgcccgcttccggcgggccccgctcccctcctcctcctcttcctcctccaagtctgcccccgtcgcttcccctgtccccccggcggttcagtctcggagccagcctctagcgccgacgcccatccaggccccgacgagctcgcagccgtctccggccagcttcctccacgcgcagcccaagcagagcttgaccctcgacttcacccggccgagcatcctgggccccaactccaaaggcgtttccgagatcgagttcgcgaaggacagcttcagcgtgtcgtccaactcttccttcatgtcttcggcgatcaccggcgacggaagcgtttcgaacgggaagctggggacgtcgatgttcatagctccggcgtccggcccggcttcgtccgccggaaagccaccgatctcgagcgtgccgtacaagaagcggtgccacgagcacgacccctccgataacatctccggcaagcactccggctccggcagcggcaagtgccactgctccaaaagaaggaaaaaccgagtgaagaaggtgacgagagtgccggcgatcagcaacaagatcgcggacatcccggccgacgagttctcgtggaggaagtacggacagaagccgatcaaagggtctcccttcccacgaggttactacaagtgcagtacaatgagagggtgccccgcgaggaaacacgtggagagggcccccgacgatccaacgatgctgatcgtgacgtacgagggggagcatcgtcactcccagtccgcgtcgcaggagattgtgcccgccggtgcgatgaacctggtattcaagtcaacc

SEQ ID NO: 44 - protein, 343 aa, Eucalyptus grandis
  Eucgr.C04011.1
MAIELHLGFSKMEDHTAIQEAASQGLKTMEHLIGVLSRQNLHHPGAVDCTDLTDRTVSKFRKVISLLDRTGHARFRRAPLPSSSSSSSKSAPVASPVPPAVQSRSQPLAPTPIQAPTSSQPSPASFLHAQPKQSLTLDFTRPSILGPNSKGVSEIEFAKDSFSVSSNSSFMSSAITGDGSVSNGKLGTSMFIAPASGPASSAGKPPISSVPYKKRCHEHDPSDNISGKHSGSGSGKCHCSKRRKNRVKKVTRVPAISNKIADIPADEFSWRKYGQKPIKGSPFPRGYYKCSTMRGCPARKHVERAPDDPTMLIVTYEGEHRHSQSASQEIVPAGAMNLVFKST

SEQ ID NO: 45 - DNA, 1002 bp, Eucalyptus grandis
  Eucgr.C04011.2
atggcgatcgagctgcatcttggcttctccaagatggaggatcacacggcgatacaggaggccgcgtctcaggggctgaagaccatggagcacctgatcggcgtcctctcccgccagaacctccaccaccccggcgccgtcgactgcaccgacctcaccgaccggaccgtctccaagttcaggaaggtcatctccctcctggaccgcaccggccacgcccgcttccggcgggccccgctcccctcctcctcctcttcctcctccaagtctgcccccgtcgcttcccctgtccccccggcggttcagtctcggagccagcctctagcgccgacgcccatccaggccccgacgagctcgcagccgtctccggccagcttcctccacgcgcagcccaagcagagcttgaccctcgacttcacccggccgagcatcctgggccccaactccaaaggcgtttccgagatcgagttcgcgaaggacagcttcagcgtgtcgtccaactcttccttcatgtcttcggcgatcaccggcgacggaagcgtttcgaacgggaagctggggacgtcgatgttcatagctccggcgtccggcccggcttcgtccgccggaaagccaccgatctcgagcgtgccgtacaagaagcggtgccacgagcacgacccctccgataacatctccggcaagcactccggctccggcagcggcaagtgccactgctccaaaagaaggaaaaaccgagtgaagaaggtgacgagagtgccggcgatcagcaacaagatcgcggacatcccggccgacgagttctcgtggaggaagtacggacagaagccgatcaaagggtctcccttcccacgaggttactacaagtgcagtacaatgagagggtgccccgcgaggaaacacgtggagagggcccccgacgatccaacgatgctgatcgtgacgtacgagggggagcatcgtcactcccagtccgcgtcgcaggagattgtgcccggcggc

SEQ ID NO: 46 - protein, 334 aa, Eucalyptus grandis
  Eucgr.C04011.2
MAIELHLGFSKMEDHTAIQEAASQGLKTMEHLIGVLSRQNLHHPGAVDCTDLTDRTVSKFRKVISLLDRTGHARFRRAPLPSSSSSSSKSAPVASPVPPAVQSRSQPLAPTPIQAPTSSQPSPASFLHAQPKQSLTLDFTRPSILGPNSKGVSEIEFAKDSFSVSSNSSFMSSAITGDGSVSNGKLGTSMFIAPASGPASSAGKPPISSVPYKKRCHEHDPSDNISGKHSGSGSGKCHCSKRRKNRVKKVTRVPAISNKIADIPADEFSWRKYGQKPIKGSPFPRGYYKCSTMRGCPARKHVERAPDDPTMLIVTYEGEHRHSQSASQEIVPGG

SEQ ID NO: 47 - DNA, 837 bp, Glycine max
  Glyma04g08060.1
atggaacacctcctccgtctcctctcccatcaaccttcccacctccgcactcaccacaccgacgccaccgtttccaacttcaaaaaactcatctcccttctcaaccgccgcaccggccatgcccgtttccgccgcgcacccctcccttccacttccaactctctcgccccatcccctccaccggctaacccggtcaccttcgccccttcgcagtcacagagtctaaccctcgatttctcaaaacctaacatgttcaacaccaccaacgccaaatccatggacctcgagttctctaaagaaaccttcagcgtctcctccaactcctccttcatgtcctccgctatcaccggcgacggtagcgtctccaatggcaaactaggatcctccctcttcctcactcctccgccagtctccgccggaaaacctcctctctcgtttgctccgatcaagaagaggtgccacgaccaccgcgagcactccgacgacatctccgggaaactctccggctccagcaagtgccactgcatcaagagaaggaagaatcgtgtgaagaaaacggttagagttccggcgattagttcgaaggtcgccgatattccgccggatgagtactcgtggaggaagtacggacagaagccgatcaagggatcaccgtacccgagggggtattacaagtgcagtaccgtgagagggtgcccggcgaggaaacacgtggagcgtgcttcggacgatccgacgatgttgattgtaacgtacgagggggagcaccgacactcgattcagaccgcgatgcaggagaacatttccgggggagtgggtttggtattcgagtcaacg

SEQ ID NO: 48 - protein, 279 aa, Glycine max
  Glyma04g08060.1
MEHLLRLLSHQPSHLRTHHTDATVSNFKKLISLLNRRTGHARFRRAPLPSTSNSLAPSPPPANPVTFAPSQSQSLTLDFSKPNMFNTTNAKSMDLEFSKETFSVSSNSSFMSSAITGDGSVSNGKLGSSLFLTPPPVSAGKPPLSFAPIKKRCHDHREHSDDISGKLSGSSKCHCIKRRKNRVKKTVRVPAISSKVADIPPDEYSWRKYGQKPIKGSPYPRGYYKCSTVRGCPARKHVERASDDPTMLIVTYEGEHRHSIQTAMQENISGGVGLVFEST

SEQ ID NO: 49 - DNA, 900 bp, Glycine max
  Glyma06g08120.1
atgacagtggagcttatggggttccccaaaatggaggaacagaaggcaattcaagaagctgcctccgaaggcctcaaggccatggaacacctcctccgtctcctatcctatcaaccctctcacctccacgctcaccacaccgacgccaccgtttccaacttcaaaaaactcatctccttactcagccgccgcaccggccacgcccgtttccgtcgcgcacctctcccttccccgccaccggctaacccggtcaccctccaccaacctccctccaccttcgtcccttcgcactcccagtctctaaccctcgatttcacaaaacctagcattttcgcctccaacgccaaatccatggacctccaattctctaaagaaaccttcagcgtctcctccaactcctccttcatgtcctccgccatcaccggcgacgccagtgtctcttacggcaaactaggatcctccctcttcctcactcctccgccagtctcagccggaaaacctcctctctcctccgctccgatcaagaagaggtgtcacgaccaccgcgaacactccgacgagatctccgggaaactctccggctccagcaagtgccactgcactaagagaaggaagaatcgagtgaagaaaacggtaagagttccggtgatcagttcgaagatcgccgatattccgccggacgagtactcgtggaggaagtacgggcagaagccgatcaagggatcgccgtacccgagggggtattacaagtgcagtagcgttagagggtgtccggcgaggaaacacgtggagcgtgctccggacgatccgacgatgttgattgtgacatatgaaggggagcaccggcactcgatgcaggagaacatttccgggggagtgggtttgggattcgagtcaacg

SEQ ID NO: 50 - protein, 300 aa, Glycine max
  Glyma06g08120.1
MTVELMGFPKMEEQKAIQEAASEGLKAMEHLLRLLSYQPSHLHAHHTDATVSNFKKLISLLSRRTGHARFRRAPLPSPPPANPVTLHQPPSTFVPSHSQSLTLDFTKPSIFASNAKSMDLQFSKETFSVSSNSSFMSSAITGDASVSYGKLGSSLFLTPPPVSAGKPPLSSAPIKKRCHDHREHSDEISGKLSGSSKCHCTKRRKNRVKKTVRVPVISSKIADIPPDEYSWRKYGQKPIKGSPYPRGYYKCSSVRGCPARKHVERAPDDPTMLIVTYEGEHRHSMQENISGGVGLGFEST

SEQ ID NO: 51 - DNA, 948 bp, Glycine max
  Glyma14g17730.1
atggcattggaactcatggggttcccaaaactagacgaacaaaaggccattcaagaggccgcatcagaaggcctcaaaggcatggagcacttgatccgaactctctcccaccaaccctttcacttaaacaccgaactcaccgatgttactgtttccaagtttaagaaactcatttcgctcctaaaccgaaccggccatgcccgattcagacgggccccggttcagtactcatctccacccgcacctgttcacaacgctaacacttccacctcatcaattcaactccctcctccgccgcaaaaccctaatattcccgcgccggtgcagtttccttctcctgcgccggtggccgttcaccacgcgccggtgacgctcgatttcacgaagccgcacaacgcgcttctgagctccaacgcgaaatctgttgagctcgagttctcgaaggagaccttcagcgtttcatcgaactcgtccttcatgtcctccgcgatcaccggcgatggcagcgtctccaacgggaagatcttcctggcgccgccggcgacctccgcccgaaaacctccagcgttcaagaagcggtgccacgaacaccgcgaacactccggcgacgtctccggcaacagcaagtgccactgcgttaagcgaaggaaaaatagggtgaagaacacagtgagagtgccggcgattagttcaaaaatcgccgatattccacccgacgagtactcgtggagaaagtacggtcagaaaccgatcaagggttccccatacccaaggggttactacaagtgcagcacggtgagagggtgcccagcgaggaagcacgtggagcgcgcaccagacgatccggcgatgctgatagtgacgtacgagggggagcacaggcacgccgttcaggccgcgatgcaggagaacgcagccggggtggtggggttggtgttcgagtcaacg

SEQ ID NO: 52 - protein, 316 aa, Glycine max
  Glyma14g17730.1
MALELMGFPKLDEQKAIQEAASEGLKGMEHLIRTLSHQPFHLNTELTDVTVSKFKKLISLLNRTGHARFRRAPVQYSSPPAPVHNANTSTSSIQLPPPPQNPNIPAPVQFPSPAPVAVHHAPVTLDFTKPHNALLSSNAKSVELEFSKETFSVSSNSSFMSSAITGDGSVSNGKIFLAPPATSARKPPAFKKRCHEHREHSGDVSGNSKCHCVKRRKNRVKNTVRVPAISSKIADIPPDEYSWRKYGQKPIKGSPYPRGYYKCSTVRGCPARKHVERAPDDPAMLIVTYEGEHRHAVQAAMQENAAGVVGLVFEST

SEQ ID NO: 53 - DNA, 948 bp, Glycine max
  Glyma17g29190.1
atggctgtggaactcatggggttcccaaaactagacgaacaaaaggccattcaagaagccgcatcagaaggcctcaagggcatgaaacacctgatccgaaccctttccaaccaaccctctcacttaaacaccgaacttaccgacgttaccgtttcaaagttcaagaaacttatttcactcttaaatcgaaccggccacgcccggttcagacgcgccccggttcagtactcatctccacacgcacccgttcacaacactaacgcttccacctcatcaattcaactccctcctccgccgcaaaaccctaatattcccgcgctggcgcagtttcctactccggcgccggtggccgtgcaccacacgccggtgacgctcgatttcacgaagccgcacaacgcgcttctgagctccaacgccaaatccgtcgagctcgagttctcgaaggaaaccttcagcgtttcctctaactcctctttcatgtcctccgcgatcaccggcgacggcagcgtctccaatgggaagattttcctcgcgccaccggcgacctccgccggaaaacgtccggcgttcaagaagcggtgccacgaacaccgcgaacactccgacgatgtctccggcaacagcaagtgccactgcgttaagcgaaggaaaaatagggtgaagagcactgtgagagtgccggcgattagttcaaaagtcgccgatattccaccggacgagtactcgtggaggaagtacggtcagaaaccgatcaagggttccccatacccaaggggttactacaagtgcagcacgattagagggtgcccagcgaggaagcacgtggagcgcgcaccagacgatcctgcaatgctgatagtgacgtacgagggggagcacaggcacgcggttcaggctgcgatgcaggagaacgcagccggggtggtggggttggtgttcgagtcaacg

SEQ ID NO: 54 - protein, 316 aa, Glycine max
  Glyma17g29190.1
MAVELMGFPKLDEQKAIQEAASEGLKGMKHLIRTLSNQPSHLNTELTDVTVSKFKKLISLLNRTGHARFRRAPVQYSSPHAPVHNTNASTSSIQLPPPPQNPNIPALAQFPTPAPVAVHHTPVTLDFTKPHNALLSSNAKSVELEFSKETFSVSSNSSFMSSAITGDGSVSNGKIFLAPPATSAGKRPAFKKRCHEHREHSDDVSGNSKCHCVKRRKNRVKSTVRVPAISSKVADIPPDEYSWRKYGQKPIKGSPYPRGYYKCSTIRGCPARKHVERAPDDPAMLIVTYEGEHRHAVQAAMQENAAGVVGLVFEST

SEQ ID NO: 55 - DNA, 1014 bp, Populus trichocarpa
  POPTR_0018s03450.1
atggcggtagagctgatgagttttaacacaaagatggatgatcagtcggctatacaagaggctgcgtcacaaggaattaagagcatggaacacttgatccgaatcatgtctcaccaaaataatcatcacgttgccgattgcactgaccttactgatgtaaccgtttccaagttcaagaaagtcatttccatcttaaaccgaacaggtcacgcccggttccgtcgtggcccgattcaacccaaccagccggccaagtcttcgttttccctctctccaccctccacatcgacacaatcaccgcaatcacagtctcagtccccctccttctctcgcttccaaaacctaaccctaactccacagcaaatcacaactccggtcaccgcaccggcggcgccgacgagtctgacgcttgatttcacgaaaccgaatatatttagctccaagagtgcagagattgagttctcgaaggatagtttcagtgtctcttcgaactcggcgtcgtttatgtcgtcggggataaccggagacggcagcgtttctaatggaaagcaaggatcgtcgattttcttaggatccgctggcaagccgccgctctcgacggtgccgtacagcaacaagaagcggtgccatgagcatcatcatgatgacactgtctctggctcctctagtggcaagtgccattgctcttccaagagaaggaagaatcgggtgaagaaaacaatcagggttccagcaataagttcaaaaatagctgatattccaccagatgagtattcttggagaaaatatggtcaaaaaccaatcaagggatcaccatacccaaggggatattacaagtgcagtacaatgagagggtgcccggcaaggaaacatgtggagagagcaacagatgatccagccatgttgattgtaacctacgagggagagcactgccatactcaaggtgcaatggagggtaacatggctgccggaactgttaacttggtgttcgagtcaaccatgatggtaggggaa

SEQ ID NO: 56 - protein, 338 aa, Populus trichocarpa
  POPTR_0018s03450.1
MAVELMSFNTKMDDQSAIQEAASQGIKSMEHLIRIMSHQNNHHVADCTDLTDVTVSKFKKVISILNRTGHARFRRGPIQPNQPAKSSFSLSPPSTSTQSPQSQSQSPSFSRFQNLTLTPQQITTPVTAPAAPTSLTLDFTKPNIFSSKSAEIEFSKDSFSVSSNSASFMSSGITGDGSVSNGKQGSSIFLGSAGKPPLSTVPYSNKKRCHEHHHDDTVSGSSSGKCHCSSKRRKNRVKKTIRVPAISSKIADIPPDEYSWRKYGQKPIKGSPYPRGYYKCSTMRGCPARKHVERATDDPAMLIVTYEGEHCHTQGAMEGNMAAGTVNLVFESTMMVGE

SEQ ID NO: 57 - DNA, 888 bp, Glycine max
  Glyma09g06980.1
atgatggcattggatatgattgatgttgttcccaggacgaggatggaagaagaaaatatagcaatacaagaagcagcttccgctgggttaaagagcatggagcatctcattcgtctcctttctccttcttcttctcttcacaacaacgttaataatctcaatctcaaccacctcgactgctccgaaatcaccggcttcactgtctccaagttcaaacaagtcatcaaccttctcaaccgcaccggccacgcccgcttccgccgctctccaccccaagcccaagcccaagcccaagcccaagcccaagcccaaactaatcctcaaccacaacctcagatccaacaacaagggttcagtttagatttcgtgaagcccaccattctaaactcaaagcccatcaacaaagacgaaactttgactctttcaacaacctcttcttccttcatgtcctccgtcaccaacgacgccagcgtctccgacggcaagatcggacctttcctccctccctccgccgccaaaccccctctctcctccgcccaccggaaaaagtgccgcgacgccgccgcagcactctccgccaaaccctcctgccactgctccaagaaaaggaaatcacgcgtgaaacgaacgattcgggtgccggcgataagctcaaagatcgcagatatcccaccggacgagtattcgtggagaaaatacggtcaaaaaccgatcaagggctcaccttaccctcgagggtactacaagtgcagcaccgtgagagggtgtccggcgaggaagcacgtggagcgagcgcaggatgaccccaagatgctaatagtgacttacgagggtgagcaccgtcacgtgctgccgttaacttccgccgccggcgttagtttcggccat

SEQ ID NO: 58 - protein, 296 aa, Glycine max
  Glyma09g06980.1
MMALDMIDVVPRTRMEEENIAIQEAASAGLKSMEHLIRLLSPSSSLHNNVNNLNLNHLDCSEITGFTVSKFKQVINLLNRTGHARFRRSPPQAQAQAQAQAQAQTNPQPQPQIQQQGFSLDFVKPTILNSKPINKDETLTLSTTSSSFMSSVTNDASVSDGKIGPFLPPSAAKPPLSSAHRKKCRDAAAALSAKPSCHCSKKRKSRVKRTIRVPAISSKIADIPPDEYSWRKYGQKPIKGSPYPRGYYKCSTVRGCPARKHVERAQDDPKMLIVTYEGEHRHVLPLTSAAGVSFGH

SEQ ID NO: 59 - DNA, 879 bp, Glycine max
  Glyma15g18250.1
atgatggcattggatatgatagatgttgttccgagaacgaggatggaggaagctgcttccgctggattaaagagcatggagcatctcattcgactcctttctccaacctcttctaattccaattcttcttcttctcctcttctcaataccaatcccaacaacctccactgctcccaaatcaccgacttcaccgtctccaacttcaaacaagtcatcaaccttctcaaccgcaccggccacgcccgcttccgccgctctccaccccaagcccaagcccaagcccaaacccaaacccaaacccaaacaagtcttcagcctcaaccagaaacccaacaagggttcagtttagatttcgtgaagcccaccattctaaactcaaaacccagcaacaaagacgagactttgaccctctccaccacctcctcctcctccttcacgtcctccgtcaccaacgacgccagcgtctccgacggcaagatcggccctttcctccctccctccgccgccaagccacctctctcctccgcccaccggaaaaagtgccgcgacgctgccgccgcgctctccaccaaaccctcctgccactgctccaagaaaaggaaatcacgcgtgaaacgaacgattcgtgtgccggcggtaagctccaagatcgccgatatcccatcggacgagtactcgtggagaaaatacggtcaaaaaccgatcaagggttcaccttaccctcgagggtactacaagtgcagcaccgtgagagggtgtccggcgaggaagcacgtggagcgagcgcaagataaccccaagatgctaatagtgacttacgagggtgagcaccgtcacgttcttccgttaactgccgctgccggcgttagtttcggccat

SEQ ID NO: 60 - protein, 293 aa, Glycine max
  Glyma15g18250.1
MMALDMIDVVPRTRMEEAASAGLKSMEHLIRLLSPTSSNSNSSSSPLLNTNPNNLHCSQITDFTVSNFKQVINLLNRTGHARFRRSPPQAQAQAQTQTQTQTSLQPQPETQQGFSLDFVKPTILNSKPSNKDETLTLSTTSSSSFTSSVTNDASVSDGKIGPFLPPSAAKPPLSSAHRKKCRDAAAALSTKPSCHCSKKRKSRVKRTIRVPAVSSKIADIPSDEYSWRKYGQKPIKGSPYPRGYYKCSTVRGCPARKHVERAQDNPKMLIVTYEGEHRHVLPLTAAAGVSFGH

SEQ ID NO: 61 - DNA, 972 bp, Glycine max
  Glyma13g00380.1
atgacagtagatctggtaggtgctgccaagatggggatggaggagaatatagcgatacaagaagctgcttccgctgggttgaagagtatggagcatctgattcgtgtgctttcttctcaaatcccttcttctgcttcgtcttcttctaacgcacaccaccaccgtcttaatctcaaccaccttgactgcaccgaaatcaccgacttcactgtctccaagttcaaacaagtcatcaacttgttgaatcgcacgggacacgctcgctttcgtagcgcaccttctcatccttctccttctacttctcttccttctcaacctcaacctcaaccacaaccacaaccatatgcactgactcttgatttcgcaaaacctgttatgcttaagtcaaatcccaaccctaacccttcttctaccgatttgtcggtttctcaatattctaagaccaaggacaccaccacctctagtatatctcctcccgtgtccaccaccacctcctcattcatgtcctccatcaccgccgacggaagtgtctccgacggaaagatcggccccgccatcatcgctgccggcaagcctcctctctcctcatcccaccggaaaaggtgtcacgacgccaccctctctgccggaaaagcctcttcctccgctcactgccattgctccaagagaagaaaatctcgtgtgaaacgaatgatacgtgtgccggcgataagttcgaagattgccgatatcccagtggacgagtactcatggcgaaagtatggtcaaaaaccaatcaaaggttcaccttacccgcgagggtattacaagtgcagtagcgtgagagggtgtccggcgaggaagcacgttgagcgagcccaggatgaccccaacatgctcatcgttacctacgagggagagcaccgtcatccgcaaccgcgtctgccggaaactgctgccggcgccggcgggacttttgccgctcatcctgtt

SEQ ID NO: 62 - protein, 324 aa, Glycine max
  Glyma13g00380.1
MTVDLVGAAKMGMEENIAIQEAASAGLKSMEHLIRVLSSQIPSSASSSSNAHHHRLNLNHLDCTEITDFTVSKFKQVINLLNRTGHARFRSAPSHPSPSTSLPSQPQPQPQPQPYALTLDFAKPVMLKSNPNPNPSSTDLSVSQYSKTKDTTTSSISPPVSTTTSSFMSSITADGSVSDGKIGPAIIAAGKPPLSSSHRKRCHDATLSAGKASSSAHCHCSKRRKSRVKRMIRVPAISSKIADIPVDEYSWRKYGQKPIKGSPYPRGYYKCSSVRGCPARKHVERAQDDPNMLIVTYEGEHRHPQPRLPETAAGAGGTFAAHPV

SEQ ID NO: 63 - DNA, 960 bp, Glycine max
  Glyma17g06450.1
atggcagtagatctggcaaatattaggatggaagagaatatggcgattcaagaagcagcttccgctgggttgaagagtatggagcatctgattcgcgtcctttcttctcaaatcccttctgcttcgtcttcttcttctaacgcacaccaccaccgtcttaatctcaaccaccttgactgcgcggaaatcaccgacttcactgtctccaagttcaaacaagtcatcaacttgttgaatcgcaccggccacgctcgctttcgtcgcgcaccttctcatccttctccttcaatttctccctctcaacctcaacctcagccacaaccacaaccacagacgctgactcttgattttgcaaaacctgttatggtaaagtcaaatcccaaccctaacccttcttctaccgatttgtcggtttctcaatattctaagaccaaggacacaaccacctttagtatatcccctcccatgtccaccaccacttcttccttcctgtcatccatcaccgccgacggcagcgtctctgacggcaagatcggccccgccatcctcgccgccggcaagcctcctctctcctcatcccaccggaaaaggtgtcacgacgccactctctccgccggaaaagcctcttcctccgctcactgccattgctccaagagaaggaaatctcgtgtgaaacgaatgatacgtgtgccggcgataagttcgaagattgccgatatcccagcggacgagtactcgtggagaaagtatggtcaaaaaccaatcaagggatcaccttacccacgagggtattataagtgcagtagcgtgagagggtgtccggcgaggaagcacgtggagcgagcccaggatgaccccaacatgctcatcgttacctacgagggagagcaccgtcatccgcaaccgcgtctgccggaaacttctgccggcgccgccgcggattttgtctctcagcctgtt

SEQ ID NO: 64 - protein, 320 aa, Glycine max
  Glyma17g06450.1
MAVDLANIRMEENMAIQEAASAGLKSMEHLIRVLSSQIPSASSSSSNAHHHRLNLNHLDCAEITDFTVSKFKQVINLLNRTGHARFRRAPSHPSPSISPSQPQPQPQPQPQTLTLDFAKPVMVKSNPNPNPSSTDLSVSQYSKTKDTTTFSISPPMSTTTSSFLSSITADGSVSDGKIGPAILAAGKPPLSSSHRKRCHDATLSAGKASSSAHCHCSKRRKSRVKRMIRVPAISSKIADIPADEYSWRKYGQKPIKGSPYPRGYYKCSSVRGCPARKHVERAQDDPNMLIVTYEGEHRHPQPRLPETSAGAAADFVSQPV

SEQ ID NO: 65 - DNA, 903 bp, Populus trichocarpa
  POPTR_0006s07170.1
atggctgtggatctagttaggtattcaaagatggaagatcagatggctatacaagaagctgcatcagctgggctcgagagcatggagcacttgatctttgcattctctaaccaaactcgacaaagccaccaacttgactgcggagaaatcacaaacttcaccgttgctaagttcaagcaagtcatctccatgttgaaccggaccggtcatgcccgttttcgccgtggaccaacttcttctccttcttcctacccggttcccgtccgacctgtccctcaagagcctcaaaaactgaaccttgattttgttaacagtaatagcccccctaaagctgagtcgaaaaatgacctgtctttgggtagtcagtattcaaaggatagccttagctctggcaccactacctcatccttcgtgtcttctgttacagctgatgggagtgtctctaatgggaaacaaggtggctcttctcttttcggaactcaagcgcgatctaccggaaaaccacctctctcatcgacccaccgcaagaaatgccacgatcatgccctctccgccagaaagatctcctccggtggaagctgtcattgctccaaaagaaggaaatcaagggttaagaggacaataagggtaccagccgtgagttccaagattgccgatataccagcagatgagtactcatggagaaaatatggtcaaaagccaatcaagggctcaccatacccaagagggtattacaagtgtagcagtgttagaggatgtccagcaaggaagcatgtggagcgtgccgtagatgactcggccatgcttatcgtgacttacgagggggagcaccgtcactcacatactccgttgccgggagacgtcaccgcgagtgctgcaatgcgacacgtgtttcactcaaca

SEQ ID NO: 66 - protein, 301 aa, Populus trichocarpa
  POPTR_0006s07170.1
MAVDLVRYSKMEDQMAIQEAASAGLESMEHLIFAFSNQTRQSHQLDCGEITNFTVAKFKQVISMLNRTGHARFRRGPTSSPSSYPVPVRPVPQEPQKLNLDFVNSNSPPKAESKNDLSLGSQYSKDSLSSGTTTSSFVSSVTADGSVSNGKQGGSSLFGTQARSTGKPPLSSTHRKKCHDHALSARKISSGGSCHCSKRRKSRVKRTIRVPAVSSKIADIPADEYSWRKYGQKPIKGSPYPRGYYKCSSVRGCPARKHVERAVDDSAMLIVTYEGEHRHSHTPLPGDVTASAAMRHVFHST

SEQ ID NO: 67 - DNA, 900 bp, Populus trichocarpa
  POPTR_0018s13600.1
atggctgttgatctagttgggtactcaaagatggaagatcagatggctattcaagaagctgcatcagctgggattaagagcatggagcacttgatctttgcactctctaaccaaacccaacaaagtcaccaacttgactgcagagaaatcactagcttcaccgttgctaagttcaagcaagtcatctccatcctgaaccggaccggtcatgcccgtttccgccgtggacccacttcttccaacccggtttccgtccgacctgtcgtccaagaacctcaaaaactaaatcttgatttctttaagagtaacaatacctttaaatctgagaccaaaaacgacttgtcattcggcagtcagtattccaaggattgttttagctctggcacgactacttcgtccttcctgtcttctgttacagctgatgggagtgtctctgatgggaaacaaggtggctcgtcttctcttttcggaactcatcctcgacctaccggaaaaccacctctctcatctatccatcgcaagaaatgccatgatcataccctctccaccagcaagatctcctcctccggtggcagctgccattgctccaaaagaaggaaatcaagggtgaagaggacaataagagtcccagcaataagttccaaagttgctgatataccagcagatgagttctcatggagaaaatatggtcaaaagccaatcaagggttcaccttacccaagagggtactacaagtgtagtagtgtgaggggatgtccagcaaggaagcacgtggagcgtgccgtagatgatccggccatgcttattgtaacatacgaaggggagcaccgtcactcacatgctcccctaccagaaaatgtcacagccaacgctgccatgcgacacgtgttccagtcaaca

SEQ ID NO: 68 - protein, 300 aa, Populus trichocarpa
  POPTR_0018s13600.1
MAVDLVGYSKMEDQMAIQEAASAGIKSMEHLIFALSNQTQQSHQLDCREITSFTVAKFKQVISILNRTGHARFRRGPTSSNPVSVRPVVQEPQKLNLDFFKSNNTFKSETKNDLSFGSQYSKDCFSSGTTTSSFLSSVTADGSVSDGKQGGSSSLFGTHPRPTGKPPLSSIHRKKCHDHTLSTSKISSSGGSCHCSKRRKSRVKRTIRVPAISSKVADIPADEFSWRKYGQKPIKGSPYPRGYYKCSSVRGCPARKHVERAVDDPAMLIVTYEGEHRHSHAPLPENVTANAAMRHVFQST

SEQ ID NO: 69 - DNA, 837 bp, Vitis vinifera
  GSVIVT01029265001
atggccgtcgattttctaggattctccaagatggacgagcagatggctatccaggaagccgcatcggccggtttgaagagcatggagcacctgatcctcctcttgaatcatcaccatcctcaatctcagcaaatcaaccacttcgattgcagagaaatcaccgatttcacagtttccaagttcaagcaagtcatttccatcctgaaccggaccggccacgcccggttccgtcgcggtccggttacttcttctccttctcacccatttcattcgaacctgattctatctgcgaagcctgatccgctcaaatcggaaggcaacgctagcgtgtcgtcgacgacttcgtctttcttgtcgtcgatcaccggagacggcagcgtgtcgaacggaaaattagggactcctctgttcgcacctcctccggctccggcggtttccgccggtaaaccgcctctttcgtcgtctcaacggaggaaatgtcatgagcatggatcctccgacaacatctccggaaaactctctgtttccggccgctgccattgctcgaaaagaaggaaaaatcgtgtgaagaggacgatcagagttcctgcgataagctcgaagatcgccgatattcccgccgacgagtactcttggagaaagtacggtcagaagccgatcaagggctcaccatacccacgaggctactacaaatgtagcagcgtgagaggctgcccagcgagaaaacacgtggagcgcgcaccagacgatccggcgatgctcatcgtcacctacgagggagagcaccgccactctcaaactccggcaccggccggtgggctcatgttcccatcaacc

SEQ ID NO: 70 - protein, 279 aa, Vitis vinifera
  GSVIVT01029265001
MAVDFLGFSKMDEQMAIQEAASAGLKSMEHLILLLNHHHPQSQQINHFDCREITDFTVSKFKQVISILNRTGHARFRRGPVTSSPSHPFHSNLILSAKPDPLKSEGNASVSSTTSSFLSSITGDGSVSNGKLGTPLFAPPPAPAVSAGKPPLSSSQRRKCHEHGSSDNISGKLSVSGRCHCSKRRKNRVKRTIRVPAISSKIADIPADEYSWRKYGQKPIKGSPYPRGYYKCSSVRGCPARKHVERAPDDPAMLIVTYEGEHRHSQTPAPAGGLMFPST

SEQ ID NO: 71 - DNA, 984 bp, Solanum lycopersicum
  Solyc08g006320.2.1
atggctgtagatttgttaaattattcgaatttgaatgaacaattagctttacaagaagctgctacagccggtttaaaatctatggataatttaatccggttcgtttcatttcaacaacagcaaaatcaaacggttcagccggattgtagagagataactgattatactgtttcgaattttagaaaggttattactattttgaaccggaccggtcatgcccggtttagacgtagtccggttcaggttactgatgattcgtctacggctttaactctatcgccgttgacaaatccggcggaggaaactgtaccggcggtgaaagtaccggttgagaagtatcaatcgaaggcgttgactttagattttacgaaacggaaagttggtaaatctattggatgtgaagctgttccggtagcgagttcgacgacgtcgtcgtcgtttatgtcgacgattacaggtgaaggaagtgtttcgaatggtaaagtgttttcgtcgatgagtttacctcctcgtccgcctgtttcctccgggaagccgccaatcgccgggaaaagatgtcgtgatcatgagctgtctgatgaattttccggtagaacttctagctccgggaagtgtcagtgcaaaaagaggaaatctcgagtaaaaaaagtgatcagagttccggcgatcagttcaaaaactgctgatattccggcagatgaatactcatggagaaagtacggtcaaaagccgatcaaaggttcaccatacccaaggggatattaccgatgtagtagtgttagaggctgtccggcgagaaagcacgtagaaagagccaccgatgatcctggaatgcttgttgtgacttacggcggagagcatcgtcatgttcaaaccacgatctccggcaacgtcaccggcgctggagctggaagttccggcgagagaatgatggcttttgagttaacaggacagaaaaatggagaaagattagggttagagatt

SEQ ID NO: 72 - protein, 328 aa, Solanum lycopersicum
  Solyc08g006320.2.1
MAVDLLNYSNLNEQLALQEAATAGLKSMDNLIRFVSFQQQQNQTVQPDCREITDYTVSNFRKVITILNRTGHARFRRSPVQVTDDSSTALTLSPLTNPAEETVPAVKVPVEKYQSKALTLDFTKRKVGKSIGCEAVPVASSTTSSSFMSTITGEGSVSNGKVFSSMSLPPRPPVSSGKPPIAGKRCRDHELSDEFSGRTSSSGKCQCKKRKSRVKKVIRVPAISSKTADIPADEYSWRKYGQKPIKGSPYPRGYYRCSSVRGCPARKHVERATDDPGMLVVTYGGEHRHVQTTISGNVTGAGAGSSGERMMAFELTGQKNGERLGLEI

SEQ ID NO: 73 - DNA, 1014 bp, Solanum lycopersicum
  Solyc12g096350.1.1
atggctgttttatcaaaaatgaatgaaagttttgctgttgaagaagcagcttccgccggtttgaaatcaatggagaatttaatccgattggtttctcatgaaccggttcaggctgattgccgtgaaatggctgattttacggtttcgaagttcaaaaaggtgatttcaattttggaccggaccggtcatgctcggttccggcgaggaccggttcaggctcaggctccggctccggttcaggttagagctccggttcgtggtccggtttatcctgattcgtttacttcgttgtctcttgctccgtcgttaagctttgctacggcgaaggagagacttgctccgtcgttaagctttgcttcggcgaaggagagaccggtggtgcaggtgcagacggcgttgacgcttgacttttcgaagctgaatgttaaccgtccgatcgggaattcaagtgcttttactgcttttactgtgaaatctaaggaggttttaatggcggatccgacgccgacgaactcgtcgtcgtttatgtcgacgattaccggcgaagcaactgtatctaatggtaagcaagtttcttcttctatgttgttgcttccgccacaggctgtgaattttccgaccaccggaaaacgttgccgcgagcatgaacaatctgatgctatctccggcagcaaatccaccggctccggcaagtgtcactgcaaaaagaggaaagctaaggatcggaaagtgattaggattccggcgataagtacgagggtggctgatataccgggagacgagttttcatggaggaaatacgggcaaaagccgatcaagggttcaaaatacccaaggggttattacaagtgtagcagcttacgtggatgtccagcaaggaaacacgtggagcgcgcgatggacgatccaacgatgctgattgtgacttatgaagatgaacattgtcataatccagttgctgcgatgcatgggaacagttctcaaatggtgaattttgggttaatggaaaagaag

SEQ ID NO: 74 - protein, 338 aa, Solanum lycopersicum
  Solyc12g096350.1.1
MAVLSKMNESFAVEEAASAGLKSMENLIRLVSHEPVQADCREMADFTVSKFKKVISILDRTGHARFRRGPVQAQAPAPVQVRAPVRGPVYPDSFTSLSLAPSLSFATAKERLAPSLSFASAKERPVVQVQTALTLDFSKLNVNRPIGNSSAFTAFTVKSKEVLMADPTPTNSSSFMSTITGEATVSNGKQVSSSMLLLPPQAVNFPTTGKRCREHEQSDAISGSKSTGSGKCHCKKRKAKDRKVIRIPAISTRVADIPGDEFSWRKYGQKPIKGSKYPRGYYKCSSLRGCPARKHVERAMDDPTMLIVTYEDEHCHNPVAAMHGNSSQMVNFGLMEKK

SEQ ID NO: 75 - DNA, 534 bp, Arabidopsis thaliana
  AT2G37430.1
atgaagagagaaagatctgatttcgaagaatccctcaagaatattgacattgctaaatgtctgatgatactagcacaaacctccatggtcaaacagatcggtttgaaccaacataccgagagccatacaagcaaccaattcgaatgcaaaacatgtaacaagagattttcttcgtttcaagcccttggtggccaccgggcaagccataagaagccaaagctcaccgttgagcagaaagatgtgaaacatcttagcaacgattataaaggaaatcattttcacaagtgttccatatgcagtcagagttttgggaccggacaggctttaggtggtcacatgagacggcataggtcaagcatgacggtcgagccatcgttcatctctccgatgattccatccatgccggttttgaaacgatgcggtagtagtaagaggattttgagtttggatttgaatctgactccgttagagaatgatcttgaatatatctttgggaagacatttgtcccaaaaatagatatgaagttcgttctt

SEQ ID NO: 76 - protein, 178 aa, Arabidopsis thaliana
  AT2G37430.1
MKRERSDFEESLKNIDIAKCLMILAQTSMVKQIGLNQHTESHTSNQFECKTCNKRFSSFQALGGHRASHKKPKLTVEQKDVKHLSNDYKGNHFHKCSICSQSFGTGQALGGHMRRHRSSMTVEPSFISPMIPSMPVLKRCGSSKRILSLDLNLTPLENDLEYIFGKTFVPKIDMKFVL

SEQ ID NO: 77 - DNA, 525 bp, Arabidopsis thaliana
  AT3G53600.1
atgaagagagaccggtccgattacgaagaatccatgaagcatatagacatagtagaaagtctaatgatgttatctcgaagtttcgtggtcaaacaaatcgatgtaaagcaatctaccggaagcaaaacgaaccataataaccacttcgaatgcaaaacgtgtaaccggaaatttgattccttccaagctcttggaggtcatagagctagccacaagaaacctaagctgatcgttgaccaagaacaggtgaagcatcgtaacaaagagaatgatatgcataagtgtacaatttgcgatcaaatgtttgggaccggtcaagctctaggcggtcacatgagaaagcataggacgagcatgataaccgagcaatcgattgtcccttctgtggtttattccagaccggtttttaatcgttgcagtagcagcaaggagatcttggacttaaatctaactccattggaaaatgatcttgtgttaatctttgggaagaatttggttccacaaattgatttgaagtttgtgaat

SEQ ID NO: 78 - protein, 175 aa, Arabidopsis thaliana
  AT3G53600.1
MKRDRSDYEESMKHIDIVESLMMLSRSFVVKQIDVKQSTGSKTNHNNHFECKTCNRKFDSFQALGGHRASHKKPKLIVDQEQVKHRNKENDMHKCTICDQMFGTGQALGGHMRKHRTSMITEQSIVPSVVYSRPVFNRCSSSKEILDLNLTPLENDLVLIFGKNLVPQIDLKFVN

SEQ ID NO: 79 - DNA, 516 bp, Citrus clementina
  clementine0.9_035547m
atggccgtgaagggaggtttagcaaatggagaaatagcggagagattagcactggctaactgtttgatgttgcttacacgtagcaatagagcaaagctgccaattaagaagcgtttggcgagcgacgtatttgagtgcaagacttgtaatcgccagttcccatcatttcaagccctaggaggccacagagccagccacaagaagccaagactaatcaatggcgagaccaaaacgttgagctcgacgacggcgacgaagccgaagctgcatgaatgctcaatatgtgggcaggaatttgctatggggcaggccttgggcggtcacatgagaaggcacaggatcgccatgaatgaaagcttgaattctgccgtgatcgtttcgcagtcgccgccggtgttaaggagatcgaatagcagcagaagggtttttggattggatttgaacttgactccattagagaatgatttggaggctttgtttgggaagatggttcctaaggttgatctattaatgact

SEQ ID NO: 80 - protein, 172 aa, Citrus clementina
  clementine0.9_035547m
MAVKGGLANGEIAERLALANCLMLLTRSNRAKLPIKKRLASDVFECKTCNRQFPSFQALGGHRASHKKPRLINGETKTLSSTTATKPKLHECSICGQEFAMGQALGGHMRRHRIAMNESLNSAVIVSQSPPVLRRSNSSRRVFGLDLNLTPLENDLEALFGKMVPKVDLLMT

SEQ ID NO: 81 - DNA, 531 bp, Eucalyptus grandis
  Eucgr.A01230.1
atgaaaagaaccagagatgactatgaacggatgagcttggacatggcgaaatgcctaatgcttctctcccacggggtcaacgcagagctcaaaagagccgctgtgcatcaaaccgaggacaactacgagtgcaagacgtgcaatcgccagttctcttcattccaggcgcttggcggccaccgggcgagccacaagaagccgaagttgctgcagaacaagccgggagactgcaccaagttggcgttgggagggacagcggagaccaagatgcatgagtgctcggtatgtgggctgaagttcgcgttggggcaagccttgggcggccacatgaggaagcacagggccgagttaatgagtgggaacatgatgaatatggacgaatttttcgggattaattcgacggtcccggtgttgaacaggtcgaatagcagcagtaagagggttatgggcctggacttgaacttgactcctcttgagaatgacctcaagttcttgtttggcaagatgtatccacggacggtcgctttctct

SEQ ID NO: 82 - protein, 177 aa, Eucalyptus grandis
  Eucgr.A01230.1
MKRTRDDYERMSLDMAKCLMLLSHGVNAELKRAAVHQTEDNYECKTCNRQFSSFQALGGHRASHKKPKLLQNKPGDCTKLALGGTAETKMHECSVCGLKFALGQALGGHMRKHRAELMSGNMMNMDEFFGINSTVPVLNRSNSSSKRVMGLDLNLTPLENDLKFLFGKMYPRTVAFS

SEQ ID NO: 83 - DNA, 492 bp, Eucalyptus grandis
  Eucgr.A01231.1
atggcgaaatgcctgatgcttctctcccacggggtcaacacaaaccctaaaaaagccgccgtgcatcacgatgaggacaacttcgagtgcaagacgtgcaaccgccggttctcgtcattccaggcacttggcggccaccgggcgagccacaagaagccaaggctgctggagacaacgaagctggaagactgcaccaagctggcgttgggctcaatggcaaagccgaagatgcacgagtgctcgatgtgcgggctgaagttcgcatcggggcaagccttgggaggccacatgaggagacacagggccgagctgatgagcggggacatgatgaagatggacgagattctcgctgtcggttcgatgatccctctgttgaagaggtcgaatagcagcaagagggttatgggcctggacttgaacttgtctcctcttgagaatgatctcaagttcttgtttggcaagatggctcccaagatagatccagtgttcctg

SEQ ID NO: 84 - protein, 164 aa, Eucalyptus grandis
  Eucgr.A01231.1
MAKCLMLLSHGVNTNPKKAAVHHDEDNFECKTCNRRFSSFQALGGHRASHKKPRLLETTKLEDCTKLALGSMAKPKMHECSMCGLKFASGQALGGHMRRHRAELMSGDMMKMDEILAVGSMIPLLKRSNSSKRVMGLDLNLSPLENDLKFLFGKMAPKIDPVFL

SEQ ID NO: 85 - DNA, 543 bp, Eucalyptus grandis
  Eucgr.A01232.1
atgatgaaaagaagcagagatgactatgaaaggatgaacttggacatggcgaaatgcctaatgctactcacccatggcgtcaacgcaaacccaaagacagccgctgtgcatcaccatgaagacaacttcaagtgcaagacgtgcaatcgccagttcccttcattccaggcgcttggtggccaccgggcaagccacaagaagccgaagctgctggagacaaagccagaagacagcaccaagtcagtgttgggcacgacggcaaatcccaagatgcacgagtgctcgatatgcgggctgaagttctcattggggcaagccttgggaggccacatgaggaggcacagggtgcagttgatgagcgggagcgggagcgtgatgaagatggatgagattttcgtggttggtccgacaatcccagtgttgaagaggtcgaaaagcagcaataagagggttatgggcctcgacttgaacttgactcctcttgagaatgacctcaagttcttatttggcaagatggctccggagatagatgccttgctcctg

SEQ ID NO: 86 - protein, 181 aa, Eucalyptus grandis
  Eucgr.A01232.1
MMKRSRDDYERMNLDMAKCLMLLTHGVNANPKTAAVHHHEDNFKCKTCNRQFPSFQALGGHRASHKKPKLLETKPEDSTKSVLGTTANPKMHECSICGLKFSLGQALGGHMRRHRVQLMSGSGSVMKMDEIFVVGPTIPVLKRSKSSNKRVMGLDLNLTPLENDLKFLFGKMAPEIDALLL

SEQ ID NO: 87 - DNA, 519 bp, Glycine max
  Glyma03g33050.1
atgaagagacagagagatttcgaggggtttgagagcatagatttggcaaattgtctaatgatgctctctcatccccaacaaaataagaaactacttcaaacaaaaattgaggctgtgaaatttgagtgcaagacatgcaaccgcaaattctcttcctttcaagcattgggtggccatagggctagccacaaaaggtcgaaacttgagggagatgaactcaaagcacatgctatatctctaagtttgggaaacaaacccaaaatgcacgagtgttccatttgtggacaagaattctcattgggacaagcacttgggggtcacatgagaaggcacaggacaaccattaacgaagatttttcttcaataaaacaggttattacacaagtacctgatttgaaaagatcgaatagcacgagggtgattatgtgcttggacttgaacctaacgccgtttgagaacgacttgaagttgttgtttggaaagatggcaccgaattctggtgccttagttgattcttta

SEQ ID NO: 88 - protein, 173 aa, Glycine max
  Glyma03g33050.1
MKRQRDFEGFESIDLANCLMMLSHPQQNKKLLQTKIEAVKFECKTCNRKFSSFQALGGHRASHKRSKLEGDELKAHAISLSLGNKPKMHECSICGQEFSLGQALGGHMRRHRTTINEDFSSIKQVITQVPDLKRSNSTRVIMCLDLNLTPFENDLKLLFGKMAPNSGALVDSL

SEQ ID NO: 89 - DNA, 513 bp, Glycine max
  Glyma19g35740.1
atgaagagacagagagatttcaaggggtttgagagcatagatttggcaaattgtctaatgatgctctctcatccccaacaaaatgagaaactacttcaaaaaaaaattgaggctgtggaatttgagtgcaagacatgcaaccgcaaattctcttcctttcaagcattgggtggccatagggctagccacaaaaggtcgaaacttgagggagatcatgaactcaaagcacatgctatatctctaagtttggcaaacaaacccaaaatgcacgagtgttccatttgtggacaagaattctcattgggacaagcacttgggggtcacatgagaaggcacagaacaaccatccacgaagatttttcttcaataaaacaggttattacacaaatgcctgttttgaaaagatcgaatagcacgagggtggttacgtgcttggacttgaacctaacaccgcttgagaacgacttgaagttgttgtttggaaagatggcaccgaatgctggtgcctttgcc

SEQ ID NO: 90 - protein, 171 aa, Glycine max
  Glyma19g35740.1
MKRQRDFKGFESIDLANCLMMLSHPQQNEKLLQKKIEAVEFECKTCNRKFSSFQALGGHRASHKRSKLEGDHELKAHAISLSLANKPKMHECSICGQEFSLGQALGGHMRRHRTTIHEDFSSIKQVITQMPVLKRSNSTRVVTCLDLNLTPLENDLKLLFGKMAPNAGAFA

SEQ ID NO: 91 - DNA, 474 bp, Glycine max
  Glyma03g33070.1
atgaacaacaacatgttaggaatgaagagacggagagatgataatgaagggtccttggatttggcaaaatgtcttatgctgttttcttgtccaatagaaagcaacaagacacaacagaaaagttttggttctgtggaatttgagtgcaagacgtgcaaccgcaagttctcttcttttcaagcactgggagggcacagggcaagccacaagaggcagaagctggagggggaagaactgaaagaacaggccaaaagtcttagcttgtggaacaaacccaaaatgcacgagtgctccatttgtggccttgaattctctctgggccaggctctgggtggccacatgagaaaacacagagcttccctcaacgaagggtttcctattattccttctatcgaccaagttattgcgaaaatcccggttttgaaaaggtcgaatagcaccagggttatgtgcttggacttggagttacacctg

SEQ ID NO: 92 - protein, 158 aa, Glycine max
  Glyma03g33070.1
MNNNMLGMKRRRDDNEGSLDLAKCLMLFSCPIESNKTQQKSFGSVEFECKTCNRKFSSFQALGGHRASHKRQKLEGEELKEQAKSLSLWNKPKMHECSICGLEFSLGQALGGHMRKHRASLNEGFPIIPSIDQVIAKIPVLKRSNSTRVMCLDLELHL

SEQ ID NO: 93 - DNA, 537 bp, Glycine max
  Glyma10g05210.1
atggtagcaattctcaagagacagggagaaaacgaatccgaagaaaccatcataggcttggcaaaaagtctcatgcaactctcgcgtgtccaacaacaaagcaataagcctcttctcaaaaccttttctccaacggagttcgagtgcaaaacctgtaaccgcaagttttcatcttttcaagctcttggtggccacagggctagccacaagaagcccaagttcgaagctgaagaactcaaagaagaagccaagaagactaaacccaaaatgcacgagtgttcaatttgtggcatggaattctctctgggccaggcactggggggtcacatgagaaaacacagaggtgccattagtgagaacgacaataataatgaagcgttgtcttctataaagcaagcaattgcaaaagctccggttttgaaacgatcgaatagcaagagggtcatgtgcttggagatggacctgaatttgacgcctttggagaatgacttgaagttgttgttcggaaacaaggctcctagagtcgatctttctttg

SEQ ID NO: 94 - protein, 179 aa, Glycine max
  Glyma10g05210.1
MVAILKRQGENESEETIIGLAKSLMQLSRVQQQSNKPLLKTFSPTEFECKTCNRKFSSFQALGGHRASHKKPKFEAEELKEEAKKTKPKMHECSICGMEFSLGQALGGHMRKHRGAISENDNNNEALSSIKQAIAKAPVLKRSNSKRVMCLEMDLNLTPLENDLKLLFGNKAPRVDLSL

SEQ ID NO: 95 - DNA, 546 bp, Glycine max
  Glyma13g19570.1
atggtagccattctgaagagacaaagagaaaccgaagccgaggagagcatcataagactggcagaaagtctcatgcaactgtcgcgagtccaacaaaaaagcaagcctcttctcaaaaccttttctccaacggagttcgagtgcaaaacctgtaaccgcaagtttccatcttttcaagcccttggtggtcacagggcgagccacaagaagcccaagttcgaaggtgaagaactcaaagaggaggccaagaagggtctgagtttggggaacaaacccaaaatgcacgagtgttccatttgcggcatggaattctctctgggtcaggcactggggggtcacatgagaaaacacaggggtgccaccagtgagaataataacgaagcgttttcttcttctataaagcaagcaatttcaaaagttccagttttgaaacgatcgaatagcaagagggtcatgtgcttggagatggacctgaatttaacgcctttggaaaatgacttgaagttgttgttcggaaacaaggctcctagagtcgatctttctttg

SEQ ID NO: 96 - protein, 182 aa, Glycine max
  Glyma13g19570.1
MVAILKRQRETEAEESIIRLAESLMQLSRVQQKSKPLLKTFSPTEFECKTCNRKFPSFQALGGHRASHKKPKFEGEELKEEAKKGLSLGNKPKMHECSICGMEFSLGQALGGHMRKHRGATSENNNEAFSSSIKQAISKVPVLKRSNSKRVMCLEMDLNLTPLENDLKLLFGNKAPRVDLSL

SEQ ID NO: 97 - DNA, 474 bp, Glycine max
  Glyma10g05180.1
atgaagagacagagagatggagtagagagcatagatttagtaaattgtctaatgttgctctctcatcacagagaaatcaaaccccaaaaacttctgggccctgaagaatttgagtgtatgacatgcaaccggaagttcacttcgtttcaggccctcggaggccatagggcaagccacaaaaagcccaaattacacgtaaaagaacagggcaaaattctgatgttggggaataagcccaaaaaacacgaatgcaccatttgtggtagggaattcactttgggccaggcacttggaggacacatgaaaaaacacagaattgccgttgaccaagggttttctttgataaacgaggttgttgtaaaagtaccgtttcttaaaaggtctaatagtaagagggttttgttcttggacttgaacttgaacttgactcctctgcagaatgacttgaagttattatttggagaaaaggcaccc

SEQ ID NO: 98 - protein, 159 aa, Glycine max
  Glyma10g05180.1
MKRQRDGVESIDLVNCLMLLSHHREIKPQKLLGPEEFECMTCNRKFTSFQALGGHRASHKKPKLHVKEQGKILMLGNKPKKHECTICGREFTLGQALGGHMKKHRIAVDQGFSLINEVVVKVPFLKRSNSKRVLFLDLNLNLTPLQNDLKLLFGEKAPK

SEQ ID NO: 99 - DNA, 504 bp, Glycine max
  Glyma13g19550.1
acgagagatggagaagagaacatagatttgggaaattgtctactgttgctctctcatcccagagaaatcaaaccccaaaaacttttgggccctaaagaatttgagtgtatgacatgcaacctcaaattttcttcatttcaggccctcggtggccacagggccagccacaaaaagcccaaactatacgtgaaagaacagtgtaaaattctgatgttgaggaataagcccaaaaaacacgagtgctccatttgtggtagggaattcactttgggccaggcactgggtggacacatgaaaaagcacagaattgccgttgaccaagggctttcttcaataaacaaggttgttgtaaaagtaccggttcttaaaaggtcgaatagtaagagggttttgtgcttggacttgaacttgactcctctgcagaatgacttgaagttattgtttggagacaaggcacccaaaaaaaataaatctattttttaccataataaaaatgcttcttca

SEQ ID NO: 100 - protein, 168 aa, Glycine max
  Glyma13g19550.1
TRDGEENIDLGNCLLLLSHPREIKPQKLLGPKEFECMTCNLKFSSFQALGGHRASHKKPKLYVKEQCKILMLRNKPKKHECSICGREFTLGQALGGHMKKHRIAVDQGLSSINKVVVKVPVLKRSNSKRVLCLDLNLTPLQNDLKLLFGDKAPKKNKSIFYHNKNASS

SEQ ID NO: 101 - DNA, 537 bp, Glycine max
  Glyma10g05190.1
atgaagagacatagagagaatgaaggaacaacattagaaagctggggcatgcaaaattgttcaatttcaatcacacccgacacaacaagtgtttcaagttccaccacttcccctgaagaagtatttgagtgcaaaacgtgcaaccgcaagttcaactcttttcaagcactgggtggccacagggctagtcacaacaagagggtggagatggaaggtgaagaacaacaactcaaactcaaaaacaagggcaaaatctatgggttgggaaaacaaagtgagcccaaaattcataattgcttcatttgtggtcagggtttttctctgggccaggccttgggaggacacatgagaagacacagagatgcaaccaacgatgttttctcgtccataaaccaggttgttgctaaagtttcagttctcaagagatcgtgtaatggcaaggttttctgcttggacctcaacttaagtcctctcgagaatgacttgaagttattgctgttcgggaaagtgtcacccaaagttaatccttcttccttc

SEQ ID NO: 102 - protein, 179 aa, Glycine max
  Glyma10g05190.1
MKRHRENEGTTLESWGMQNCSISITPDTTSVSSSTTSPEEVFECKTCNRKFNSFQALGGHRASHNKRVEMEGEEQQLKLKNKGKIYGLGKQSEPKIHNCFICGQGFSLGQALGGHMRRHRDATNDVFSSINQVVAKVSVLKRSCNGKVFCLDLNLSPLENDLKLLLFGKVSPKVNPSSF

SEQ ID NO: 103 - DNA, 528 bp, Glycine max
  Glyma13g19560.1
atgaagagacagagagagaacgaagtaacaacgttggaaagctgggacatgcaaatttgttcaacttcaatcacacccgacacaagtgtttccagttccaccatatctccggaagatgtatttgagtgcaaaacgtgcaaccgcaagttcaactcttttcaagcgctgggtggccatagggcttgtcacaacaagagggtgaagatggaaggtgaagaacaacaactcaaaacaagggcaaaatatctgggtttgggaaaacacagtgagcccaaaatgcataattgctccatttgtggtcaaggtttctctctgggccaggccttgggaggacacatgagaagacacagagcttcgaccaacgatgttttctcttccataaaccaggttgttgcaaaagtttcggttttaaaaagatcgtgtaatgacaaggttttctacttggacctcaacttaactcccctcgagaatgacttgaaattgttgttgttcgggaaattgtcacccaaagttaatctttcttccttc

SEQ ID NO: 104 - protein, 176 aa, Glycine max
  Glyma13g19560.1
MKRQRENEVTTLESWDMQICSTSITPDTSVSSSTISPEDVFECKTCNRKFNSFQALGGHRACHNKRVKMEGEEQQLKTRAKYLGLGKHSEPKMHNCSICGQGFSLGQALGGHMRRHRASTNDVFSSINQVVAKVSVLKRSCNDKVFYLDLNLTPLENDLKLLLFGKLSPKVNLSSF

SEQ ID NO: 105 - DNA, 462 bp, Solanum lycopersicum
  Solyc11g073060.1.1
atgacaaccatgaaaagaagcagagaagataatggacaagtggaagcagaagccatggctaattgcgccttgatgcttttatcgcgtttaaacaataacaatgactttgcatgcaagacttgtaataaacgatttccatctttccaagcccttggtggacatcgtacaagtcataataaaaaaccaaaattacttggagaaaccaaccaaaagagtaaggtgcataaatgttctatttgtggtatggagtttgcattgggtcaagcattaggcggacacatgagacggcaccgtgatgaaattaataaagttacgtctcatgaaaagactataattccaattttgcacagcagcaagaggattagcatttttggggttaacttaaacataacacccaatgttgatgatttgaagttatggccgatcgaagaggctccatcacctgtcttgcgaatatttttt

SEQ ID NO: 106 - protein, 154 aa, Solanum lycopersicum
  Solyc11g073060.1.1
MTTMKRSREDNGQVEAEAMANCALMLLSRLNNNNDFACKTCNKRFPSFQALGGHRTSHNKKPKLLGETNQKSKVHKCSICGMEFALGQALGGHMRRHRDEINKVTSHEKTIIPILHSSKRISIFGVNLNITPNVDDLKLWPIEEAPSPVLRIFF

SEQ ID NO: 107 - DNA, 534 bp, Eucalyptus grandis
  Eucgr.B02390.1
cttccagagatggtgaagagagacagagaggacacggaggtcgaagccctggccagggtcaattgcttgatgctcctctcccgagttggcgagagcaccgactcggcgtcgccggaccgcaaatcgcggcctaccgagcgaatgttcgcgtgcaagacttgcaaccgcgagttctcctcgttccaggcgctcggagggcacaaagccagccacaagaagccgaagttgatctccggcgatctcttccacctcggccacgcagcagattcctcgccggccaagccgaagacgcacgagtgctcgatatgcggcctcgatttcccgatgggccaagccctcggcggtcacatgaggaggcacagggcggccatgctggaaagcttggcagcagcagccgcaaagcctgtgccagtgttgaagaaatcaaacagcaagagagtcacgggcttggatttgaactcgttgccgatggaggacgacttgaccttgcgtttagggaaggttgcgccgccattggtgctagatctcgttttg

SEQ ID NO: 108 - protein, 178 aa, Eucalyptus grandis
  Eucgr.B02390.1
LPEMVKRDREDTEVEALARVNCLMLLSRVGESTDSASPDRKSRPTERMFACKTCNREFSSFQALGGHKASHKKPKLISGDLFHLGHAADSSPAKPKTHECSICGLDFPMGQALGGHMRRHRAAMLESLAAAAAKPVPVLKKSNSKRVTGLDLNSLPMEDDLTLRLGKVAPPLVLDLVL

SEQ ID NO: 109 - DNA, 525 bp, Eucalyptus grandis
  Eucgr.B02392.1
atggtgaagagagacagagaggacacggaggtcgaagccctggccagggccaattgcttgatgctcctctcccgtgttggcgagagcaccgactcggcgtcgctggaccgcaaatcgcaccctacagagcgaatgttcgcgtgcaagacttgcaaccgcgaattctcctcgttccaggccctcggagggcacaaagccagccacaagaagccgaagctgatctccggtgacctcttccacctcggccacgcagcagattcctcgccggccaagccgaagacgcacgagtgctcgatatgcggcctcgatttcccgatgggccaagccctcggcggtcacatgaggaagcacagggcggccatgctggaaagcttggcagcagcggccgcaaagcctgtgccagtgttgaagaaatcaaacagcaagagagtcacgggcttcgatttgaactcgttgccgatgcaggacgacttgaccttgcgtttaggaaaggttgcgccgcctttggtgcttgatctcgttttg

SEQ ID NO: 110 - protein, 175 aa, Eucalyptus grandis
  Eucgr.B02392.1
MVKRDREDTEVEALARANCLMLLSRVGESTDSASLDRKSHPTERMFACKTCNREFSSFQALGGHKASHKKPKLISGDLFHLGHAADSSPAKPKTHECSICGLDFPMGQALGGHMRKHRAAMLESLAAAAAKPVPVLKKSNSKRVTGFDLNSLPMQDDLTLRLGKVAPPLVLDLVL

SEQ ID NO: 111 - DNA, 981 bp, Eucalyptus grandis
  Eucgr.B02393.1
atgaacgtaagcggtgcacatgaaacgtatgcactctttgaaatacccgttccttgtgtatctgatgttcttggtgttaccgatcgtgtcgaatctgtaaatgacaaatgcaggcgaaaagcttttagaaaagtcaaagcaagtaccgcctcgctcacctgtgacgacttgcccagttttcacacgcgttcacacggtatcctagctctccctttggcggcacaggctgccacgtttgcccttcatcttcgcgcaaagctgccacgatatcactgtccttcctactcattccccaagaaactcgagggccttttcgtcacttcagttagcaagattcgcccgcactccacttcacactgtcgtaccagtcatcccgactcagcagagcaagcaaaagaaggaaaccagaaaaatcagacactccgatttcacatcctctactacagacttcaagagatggtgaagagagacagagaggacgcgggggtcgaagccctggccagggccaattgcttgatgctcctctcccaagtcggcgagagcaccaactcgtcgtcgccgaatcacaaatcgcggcctacagagcgaatgttcaagtgcaagacgtgcaaccgcgagttctcgtcctcccaggcgctcggagggcacagagccagccacaagaagccaaagcttatctccggcgacctcttacacctcggccacgcagcgtattcctcgccggccaagccgaagaagcacgagtgctcgatatgcggcctcgagttcccgattggccaagcccttggcggtcacgtgaggaggcacagggccgccatgctggagagcttggcggcggtggccacaaagcccgtgccggtgttgaagaaatcgaacagcaagagggtcatgggcttggatttgaactcgtcgccaatggaggacgacttgaccttgcgtttagggaaggttgcgccacctttggtgctagatctcgttttg

SEQ ID NO: 112 - protein, 327 aa, Eucalyptus grandis
  Eucgr.B02393.1
MNVSGAHETYALFEIPVPCVSDVLGVTDRVESVNDKCRRKAFRKVKASTASLTCDDLPSFHTRSHGILALPLAAQAATFALHLRAKLPRYHCPSYSFPKKLEGLFVTSVSKIRPHSTSHCRTSHPDSAEQAKEGNQKNQTLRFHILYYRLQEMVKRDREDAGVEALARANCLMLLSQVGESTNSSSPNHKSRPTERMFKCKTCNREFSSSQALGGHRASHKKPKLISGDLLHLGHAAYSSPAKPKKHECSICGLEFPIGQALGGHVRRHRAAMLESLAAVATKPVPVLKKSNSKRVMGLDLNSSPMEDDLTLRLGKVAPPLVLDLVL

SEQ ID NO: 113 - DNA, 516 bp, Eucalyptus grandis
  Eucgr.B02394.1
atggtgaagagagacagagaggacacggaggtcgaagccctggccgtggccaacagcttgatgctcctctcccgaatcggccggagcaccgactcaaaccgcaaatcgcggcctacagagcggatgttcacatgcaagacgtgcaaccgcgagttcccctcgttccaggcgctcggagggcacagagccagccacaagaagccaaagctgatctccggcgacctcttgcgccttggccgcacggcagattcctcgccggccaagctgaagatgcacgagtgctcgatatgcggcctcgatttcccgactggccaagcccttggtggtcacatgaggcggcacagggcggccatactggagagcttggtggcggccgccgcaaagcctgtgccggtgttgaagaaatcgaacagcaagagagtcaggggcttggatttgaactcgttgccgatggaggacgacttgaccttgcgtttaggaaaggttgcgccgcctttagtgccagatctcgttttg

SEQ ID NO: 114 - protein, 172 aa, Eucalyptus grandis
  Eucgr.B02394.1
MVKRDREDTEVEALAVANSLMLLSRIGRSTDSNRKSRPTERMFTCKTCNREFPSFQALGGHRASHKKPKLISGDLLRLGRTADSSPAKLKMHECSICGLDFPTGQALGGHMRRHRAAILESLVAAAAKPVPVLKKSNSKRVRGLDLNSLPMEDDLTLRLGKVAPPLVPDLVL

SEQ ID NO: 115 - DNA, 516 bp, Eucalyptus grandis
  Eucgr.B02396.1
atggtgaagagagacagagaggacatggaggtcgaagccctggccgtggccaacagcttgatgctcctctcccgagttggccagagcaccgactcaaaccgcaaatggcagccaacagagcggatgttcacgtgcaagacgtgcaaccgcgagttctcatccttccaggcgctcggagggcacagagctagccacaagaagccgaagctgatctccggcgacctcttgcgccttggccacgaagcggattcctcgccggccaagccgaagacgcatgagtgcccgatatgtggcctcgatttcccgatcggccaagccctaggtggtcacatgaggaggcacagggccgccatgctggagagcttggcggcggcagccacaaagcccgtgccggtgttgaagaaatcgaacagcaagagagtcacgggcttggatttgaactcgtcgcccatggaggacgacttgaccttgcgtttaggaaaggttgcgccgcctttggtgctagatctcgttttg

SEQ ID NO: 116 - protein, 172 aa, Eucalyptus grandis
  Eucgr.B02396.1
MVKRDREDMEVEALAVANSLMLLSRVGQSTDSNRKWQPTERMFTCKTCNREFSSFQALGGHRASHKKPKLISGDLLRLGHEADSSPAKPKTHECPICGLDFPIGQALGGHMRRHRAAMLESLAAAATKPVPVLKKSNSKRVTGLDLNSSPMEDDLTLRLGKVAPPLVLDLVL

SEQ ID NO: 117 - DNA, 516 bp, Eucalyptus grandis
  Eucgr.L02150.1
atggtgaagagagacagagaggacatggaggtcgaagccctggccgtggccaacagcttgatgctcctctcccgagttggccagagcaccgactcgaactgcaaatggcagcctacagagcggatgttcgcgtgcaagacgtgcaaccgcgagttctcatccttccaggcgctgggagggcacagagccagccacaagaagccgaagctgatctccggcgacctcttgcgccttggccacgaagcggattcctcgccagccaagccgaagacgcatgagtgcccgatatgtggcctcgatttcccgatcggccaagccctaggtggtcacatgaggaggcacagggccgccatgctggagagcttggcggcggcagccacaaagcccgtgccggtgttgaagaaatcgaacagcaagagagtcacgggcttggatttgaactcgtcgcccatggaggacgacttgaccttgcgtttaggaaaggttgcgccgcctttggtgctagatctcgttttg

SEQ ID NO: 118 - protein, 172 aa, Eucalyptus grandis
  Eucgr.L02150.1
MVKRDREDMEVEALAVANSLMLLSRVGQSTDSNCKWQPTERMFACKTCNREFSSFQALGGHRASHKKPKLISGDLLRLGHEADSSPAKPKTHECPICGLDFPIGQALGGHMRRHRAAMLESLAAAATKPVPVLKKSNSKRVTGLDLNSSPMEDDLTLRLGKVAPPLVLDLVL

SEQ ID NO: 119 - DNA, 582 bp, Eucalyptus grandis
  Eucgr.B02395.1
agcaaaagaagaaaccagaaaaatcagacgcttcaatttcacattctctactacagaattccagagatggtgaagagagacagagaggacacggaggtcgaggccctggccgtggccaacagcttgatgctcctctcccgagtcggccagagcagcgactcgaactgcaaatcgtggcctacagagcggatgttcgcgtgcaagacgtgcaaccgcgagttctcctccttccaggcgctgggagggcacagagccagccacaagaagccgaagctgatctccggcgacctcttccacctcggccacgcagcggattcctcgcaggccaagccgaagaagcacgagtgctcgatatgcggcctcgatttcccgattggccaagctcttggtggacacatgaggaggcacagggccgccatgctggagagattggcgacggccaccgcaaagcccgtgccggtgttgaagaaatcgaacagcaagagagtcatgggcttggatttgaactcgtcgccgacagaggacgacttgaccttgcgtttaggaaaggttacgccgcctttggcgctagatcttgttttg

SEQ ID NO: 120 - protein, 194 aa, Eucalyptus grandis
  Eucgr.B02395.1
SKRRNQKNQTLQFHILYYRIPEMVKRDREDTEVEALAVANSLMLLSRVGQSSDSNCKSWPTERMFACKTCNREFSSFQALGGHRASHKKPKLISGDLFHLGHAADSSQAKPKKHECSICGLDFPIGQALGGHMRRHRAAMLERLATATAKPVPVLKKSNSKRVMGLDLNSSPTEDDLTLRLGKVTPPLALDLVL

SEQ ID NO: 121 - DNA, 483 bp, Eucalyptus grandis
  Eucgr.B02397.1
atggtgaagagagacagagaagacacggaggtcgaagccctggctgtggccaacagcttgatgctcctctcccgagtcgagcggatcttcgcgtgcaagacgtgcaaccgcgagttctcgtccttccaggcgctcggagggcacagagccagccacaagaagccgaagctgatctctggcgacctcttacacctcggccactcagtggattcctcgctggacaagccgaagatgcacaagtgctcgatatgtggcctcgagttcccgctaggccaagcccttggcggtcacatgaggaggcacagggctgccatactgaagagattggctgcagcggccgcagctgcaaagcctgtgccggtgttgaagaaatcgaacagcaagatagtcacgggcttggatttgaactcgtcgccgatggaggacgacttgaccttgcgtttaggaaagtttgcgccgcctttggcgctagatctcgttttg

SEQ ID NO: 122 - protein, 161 aa, Eucalyptus grandis
  Eucgr.B02397.1
MVKRDREDTEVEALAVANSLMLLSRVERIFACKTCNREFSSFQALGGHRASHKKPKLISGDLLHLGHSVDSSLDKPKMHKCSICGLEFPLGQALGGHMRRHRAAILKRLAAAAAAAKPVPVLKKSNSKIVTGLDLNSSPMEDDLTLRLGKFAPPLALDLVL

SEQ ID NO: 123 - DNA, 519 bp, Eucalyptus grandis
  Eucgr.B02399.1
atggtgaagagagacagagaggacacggaggtcgaagccctggccctggccaactgcttgatgctcctctcccgagtcggcgagagcaccgactcgccatggctgaaccacaaatcccggcctacggagcggatgttcgcgtgcaagacgtgcaaccgcgagttttcatccttccaggcactcggagggcacagagccagccacaagaagccgaagctgtccggcgatctcttccacctagggcgcaccgcggattcctcaccggccaagccgaagacgcacgagtgcgcgatatgcggcctcgagttcccgctcggccaagcccttggcggtcacatgaggaggcacagggccgccatggcggagagcttggcgacggccgaaaagcctgtgccggtgttaaagaaatcaaacagtaagagagtcatgtgtttggatttgaactcgtcaccgacggaggacgacttgaccttgcgtttaggaaaggccgcgccacctttggtgctagatctcgttttg

SEQ ID NO: 124 - protein, 173 aa, Eucalyptus grandis
  Eucgr.B02399.1
MVKRDREDTEVEALALANCLMLLSRVGESTDSPWLNHKSRPTERMFACKTCNREFSSFQALGGHRASHKKPKLSGDLFHLGRTADSSPAKPKTHECAICGLEFPLGQALGGHMRRHRAAMAESLATAEKPVPVLKKSNSKRVMCLDLNSSPTEDDLTLRLGKAAPPLVLDLVL

SEQ ID NO: 125 - DNA, 594 bp, Populus trichocarpa
  POPTR_0001s24250.1
atgaagagagatagagaacaggcagagatagacttggccaaatgcttgatgctactttctaaagttggccaagctgatcacgagatactaactaattatagatcagcagcagcagcagcagcagcagcaacggcaggggccggggccggggccggtcgctcattttcatgcaaaacatgcaacaagaatttcccttcatttcaagcattaggaggccaccgtgcaagtcacaagaaaccaaaactcaaggaatcaactgggaacttgttgaagctgcctaattcgccttcaaagccaaaaactcaccagtgctccatttgcggccttgaatttcctctcgggcaagcacttggaggtcacatgaggagacatcgggcgcctcataatgttgataccaccagtactagtagtaaagatcatgaattggcagctgtgactcagccgcctttcttacccgctgtcccagttttgaagagatccaatagcagcaagagagttctgtgcttggatttgagcttggccctgcctatgtatcagaatgactcggagttgcagttagagaaggtcgatcgtcccatgttgagatgttttatc

SEQ ID NO: 126 - protein, 198 aa, Populus trichocarpa
  POPTR_0001s24250.1
MKRDREQAEIDLAKCLMLLSKVGQADHEILTNYRSAAAAAAAATAGAGAGAGRSFSCKTCNKNFPSFQALGGHRASHKKPKLKESTGNLLKLPNSPSKPKTHQCSICGLEFPLGQALGGHMRRHRAPHNVDTTSTSSKDHELAAVTQPPFLPAVPVLKRSNSSKRVLCLDLSLALPMYQNDSELQLEKVDRPMLRCFI

SEQ ID NO: 127 - DNA, 534 bp, Citrus clementina
  clementine0.9_023362m
atgaagagagcttttcaagaatcatcagagcttgatcacagcttaaacatggcaaactgcttgatgtttttgtcgcatgggaggggctttaacgccgttaacggcgttaacacaatggcagctggtagggctttcgagtgcaagacgtgtaacaggcagttcccgtcgtttcaagctctgggagggcacagggcgagccacaagaagccgaggttcacggacggcaacggaggagtcgacatgcagcagttgccgataaaacccaagactcatgaatgttcagtttgtgggcttgagtttgctataggccaagccctaggtggccatatgaggagacacagagctgctggcttgcatggaaatgagaaactctcagatttgagtggtctttcggacaaggcgccgttggtgaagaaagctaatagcagagggggtttatgcttggacttgaacttgactccatatgagaatgatttggaaacgtttaggcttggtaacaaggtagatagtctggttaatctggaattgtgtgcg

SEQ ID NO: 128 - protein, 178 aa, Citrus clementina
  clementine0.9_023362m
MKRAFQESSELDHSLNMANCLMFLSHGRGFNAVNGVNTMAAGRAFECKTCNRQFPSFQALGGHRASHKKPRFTDGNGGVDMQQLPIKPKTHECSVCGLEFAIGQALGGHMRRHRAAGLHGNEKLSDLSGLSDKAPLVKKANSRGGLCLDLNLTPYENDLETFRLGNKVDSLVNLELCA

SEQ ID NO: 129 - DNA, 525 bp, Glycine max
  Glyma18g52410.1
atgaagagagaaagagaggttgatagcttaaccatggcgaattgtttgatgttgctttctcgtggaagtgaatttgaggccacctactcaagcacttctatgagcaatcgtgtctttgagtgcaagacatgtaataggcaattcccttcatttcaagcacttggtggccacagggctagccacaaaaagcctaggttgatggcaggagatatcgaaggccaattgcttcatgattcacccccaaagcctaagactcatgagtgttccatttgtgggttggagtttgctatagggcaagccttgggaggtcacatgaggaggcacagagcggcgaatttgaatggaaacgtgcacaattctacggctacgagtagtagtagtgggggtagcagttttgattcatcgccaaagaagaaagctgacaacaagagagttttggttttggatttgaatctgacaccctttgagaatgatttggagtttttgaagattggaaaaccaaccacttttgttgattatttgtat

SEQ ID NO: 130 - protein, 175 aa, Glycine max
  Glyma18g52410.1
MKREREVDSLTMANCLMLLSRGSEFEATYSSTSMSNRVFECKTCNRQFPSFQALGGHRASHKKPRLMAGDIEGQLLHDSPPKPKTHECSICGLEFAIGQALGGHMRRHRAANLNGNVHNSTATSSSSGGSSFDSSPKKKADNKRVLVLDLNLTPFENDLEFLKIGKPTTFVDYLY

SEQ ID NO: 131 - DNA, 519 bp, Glycine max
  Glyma20g23180.1
atgaagagagaaagagaagttgatagtataaccatggccaactacttgatgctgctttctcgaaccaccaccaacttgaacacttccaacaaccgtgtgtttgagtgtaagacatgtaaccggcggtttgcgtcgtttcaggcattgggtggccaccgtgcgagtcacaagaagccaaggttgatgggagagagtgatagccaagtgctaattcatggttcaccaccaaagcctaaaacacacgaatgttccatttgtggattggagtttgcaataggacaagctttgggagggcacatgaggcgtcatagagctgcagcagcatcaaatggaaacatgcacactactattaattcttggttgagttctagcaatagtggtggtagcacagttgataatactttaccaccaaacatgaacaacaaggctaacaacaccaagagggttttgtttcctgatttgaatttgacgcctttagagaatgatttggagtttttgaagtttggacactgctttaat

SEQ ID NO: 132 - protein, 173 aa, Glycine max
  Glyma20g23180.1
MKREREVDSITMANYLMLLSRTTTNLNTSNNRVFECKTCNRRFASFQALGGHRASHKKPRLMGESDSQVLIHGSPPKPKTHECSICGLEFAIGQALGGHMRRHRAAAASNGNMHTTINSWLSSSNSGGSTVDNTLPPNMNNKANNTKRVLFPDLNLTPLENDLEFLKFGHCFN

SEQ ID NO: 133 - DNA, 456 bp, Solanum lycopersicum
  Solyc05g054650.1.1
atggcaaattacttgatgttattttcacgtcaagaaaatcatttcaacactatggtaaacaactctcctagtcgagttttcgagtgcaagacttgtaatagacaattttcatcgtttcaagcactaggtggtcatcgagcaagtcataaaaagccgagattaatgggagaaatgaattttcatttgccgatttcaccgcctaagccaaaaacacatgagtgttcaatttgtggacttgaatttcctattggacaagctttaggtggacatatgagaagacatagaggtatgttaaatgaaaataataataataataatcaagttcctaatcacgatgttatgaagaaatcatcaaataatccaagagttttgtgtttggatttgaacttaacaccattggaaaatgatttagagttcaagttgaagaaggcaaatcctatagttgattgctttttg

SEQ ID NO: 134 - protein, 152 aa, Solanum lycopersicum
  Solyc05g054650.1.1
MANYLMLFSRQENHFNTMVNNSPSRVFECKTCNRQFSSFQALGGHRASHKKPRLMGEMNFHLPISPPKPKTHECSICGLEFPIGQALGGHMRRHRGMLNENNNNNNQVPNHDVMKKSSNNPRVLCLDLNLTPLENDLEFKLKKANPIVDCFL

SEQ ID NO: 135 - DNA, 570 bp, Arabidopsis thaliana
  AT1G07900.1
atggagagtaaaagtgacgcttctgtcgccaccactccaatcatatcttcttcctcttctcctccaccatcactttcaccgcgggtagtgcttagtccatgtgctgcttgcaaaatcttgaggcgacgttgtgcagagagatgcgttttggcaccgtacttccctccaacggatccggccaagttcactattgcacaccgcgtctttggagccagcaacatcattaagttcttgcaggaacttccagaatcacaaagaactgatgcggtcaacagtatggtgtatgaagccgaagctagaataagagatccagtgtatggatgtgcaggtgccatataccatttacaaagacaagtgagtgaactccaagcacaacttgcaaaagctcaagtggagatggtgaatatgcaatttcaaagatcaaatttactagagctgatttataacatggaccaacaacagaaacaagaacaagataatatgtcctttgagagcaatgatttgggattccttgaagacaagtccaacaccaactcatcaatgttgtggtgggatcctctttggacatgt

SEQ ID NO: 136 - protein, 190 aa, Arabidopsis thaliana
  AT1G07900.1
MESKSDASVATTPIISSSSSPPPSLSPRVVLSPCAACKILRRRCAERCVLAPYFPPTDPAKFTIAHRVFGASNIIKFLQELPESQRTDAVNSMVYEAEARIRDPVYGCAGAIYHLQRQVSELQAQLAKAQVEMVNMQFQRSNLLELIYNMDQQQKQEQDNMSFESNDLGFLEDKSNTNSSMLWWDPLWTC

SEQ ID NO: 137 - DNA, 696 bp, Arabidopsis thaliana
  AT2G28500.1
atgctaaagatggagattaacggtggggtcgctacacctactgcttccgccgtcgccaaggtgacagaaaccaccactcccgttaactctccttctcccacttcttcacctccgccgcctccttcgccgcaacagccgccacaaccaccggttgtactaagcccttgtgcggcttgcaagattttgcggcggcggtgcgccgataaatgtgttttggcaccgtactttcctcctacggacccggcgaagttcacaatcgctcaccgtgtctttggagctagcaacattattaagttcttgcaggaacttccagaatcgcaaagaacagatgctgttaatagcatggtctatgaagccggagctaggatgagagatccggtttacggatgtgcgggtgcaatttatcatttgcagagacaagtgagtgagcttcaagcacaacttgcaaaaactcaagtagagttagtaggcatgcaactccaaagatcaagtctactagaattgatatataatatggagcaaacaaagttgtcagtacaagagcaaggacaacagaagatgtcctttgagagttcatttgaaagcggcgatgagttcattagtagcccggacgaagagagcaatgatttggggttccttgaggacaacaacaacaacaataattcatcaatgtcgtggtgggatcctctttggaca

SEQ ID NO: 138 - protein, 232 aa, Arabidopsis thaliana
  AT2G28500.1
MLKMEINGGVATPTASAVAKVTETTTPVNSPSPTSSPPPPPSPQQPPQPPVVLSPCAACKILRRRCADKCVLAPYFPPTDPAKFTIAHRVFGASNIIKFLQELPESQRTDAVNSMVYEAGARMRDPVYGCAGAIYHLQRQVSELQAQLAKTQVELVGMQLQRSSLLELIYNMEQTKLSVQEQGQQKMSFESSFESGDEFISSPDEESNDLGFLEDNNNNNNSSMSWWDPLWT

SEQ ID NO: 139 - DNA, 639 bp, Brachypodium distachyon
  Bradi1g65760.1
atggagtacagcaacgaggccacgaacacggcggcgccgcgaaggccttccatgtcgccgccgtcgtcgaggccggtgtcgtcgtcatgctcgccgccgccccctgcagtgttcccgctggcgtcgtcgtcgccgaccgtggtgctgagcccgtgcgcggcgtgcaagctgctccgccgccgctgcgccgacggctgcatgctcgcgccctacttccccccgacggaccccgccaagttcaccaccgcccaccgcgtcttcggcgccagcaacatcatcaagctcctccaggaattgccggagagcgcgcgggcggacgcggtgagcagcatggtgtacgaggcggaggcgcggctgcgggacccggtgtacgggtgcgcgggggcggtgtgccggctgcaggaggaggccaacgacctcaaggtgcgcctggcgcgcgcgcaggccgatctcctcagcgtccaggcgcagcacgccaacctcctcgccctcgtctgcgtcgagcttgcccgctatcagcagccgcatccgtcgccgcctccactcgtcgacgacggcctggatcacggcgcgatgtaccagtcactctatgattcggacctcgacctggcggcgtgggaagagacccggctctggacc

SEQ ID NO: 140 - protein, 213 aa, Brachypodium distachyon
  Bradi1g65760.1
MEYSNEATNTAAPRRPSMSPPSSRPVSSSCSPPPPAVFPLASSSPTVVLSPCAACKLLRRRCADGCMLAPYFPPTDPAKFTTAHRVFGASNIIKLLQELPESARADAVSSMVYEAEARLRDPVYGCAGAVCRLQEEANDLKVRLARAQADLLSVQAQHANLLALVCVELARYQQPHPSPPPLVDDGLDHGAMYQSLYDSDLDLAAWEETRLWT

SEQ ID NO: 141 - DNA, 717 bp, Oryza sativa
  LOC_Os03g17810.1
atggatcacgctggcaacacggtcgcgaacgtgacggtggcgcagcagccgcattacgggcggtccgtgtcgccgccgtcgagggtgtcgtcgtgctcgccgccaccacctcctgtcggcaccgcctccttgctggtgggcaacacgtcgtcgtcgtcgtcaccgacgacgaccgtcgtgctgagcccgtgcgccgcgtgcaaggtgctccgccgccggtgcgccgacggctgcgtgctggctccttacttccctcctaccgaaccgaccaagttcactaccgcgcaccgcgtgttcggcgccagcaacatcatcaagctcctccaggaattgccggagagcgcgcgggcggacgcggtgagcagcatggtgtacgaggcggaggcgaggctgcgggacccggtgtacgggtgcgcgggggcggtgtgccggctgcagaaggaggcgaacgagctcaaggtgcagctcgcgcgcgcgcaggccgacctgctcaacgcgcgggcgcagcacgacaacctcgtcgccctcgtctgcgtcgagctcgcgcaccgccgccgggacgacgaccagcagctggaataccaggcgccggcgccgccgctgccgcacccggcggagtactgtagcggcggcgcaggcttcggcgccaccgtgtaccagccgttctacgactcggacctggactcggcggcgtggggcgagccccagctatggacg

SEQ ID NO: 142 - protein, 239 aa, Oryza sativa
  LOC_Os03g17810.1
MDHAGNTVANVTVAQQPHYGRSVSPPSRVSSCSPPPPPVGTASLLVGNTSSSSSPTTTVVLSPCAACKVLRRRCADGCVLAPYFPPTEPTKFTTAHRVFGASNIIKLLQELPESARADAVSSMVYEAEARLRDPVYGCAGAVCRLQKEANELKVQLARAQADLLNARAQHDNLVALVCVELAHRRRDDDQQLEYQAPAPPLPHPAEYCSGGAGFGATVYQPFYDSDLDSAAWGEPQLWT

SEQ ID NO: 143 - DNA, 705 bp, Zea mays
  GRMZM2G021095_T01
atggacgactacggcaacgcgagcgcgggcacggcggcgccgcagccgcagcaatattactgccgctccgtgtcgccgccgtccagggtgtcgtcgtcgtgctcgccgccaccgcctcctcctcctcccgctgtcctgcaggtggtgggcaacgtgccgccgccgaccgtcgtcctgagcccgtgcgcggcgtgcaagatcctccgccgccgctgcgccgacggctgcgtgctggctccctacttcccgccgaccgagcccgccaagttcaccacggcgcaccgcgtcttcggcgccagcaacatcatcaagctcctccaggatctgccggagagctcgcgcgcggacgcggtgagcagcatggtgtacgaggcggaggcgcggctgcgggacccagtgtacgggtgcgcgggggcggtgtgccggctgcagaagcaggccaacgagctcaaggtgcagctggcgcgcgcgcaggccgacctgctcaacgcgcaggccaagcacgccaacctgctcgccctcttctgcgtcgagatggccaatcgccgcggcaaccagcagcacccgtcgccgctgacgacgatgatggacggcggcggcggcggcggattcggcgcggcggcgtactaccagcagacgacgttgtacgactcggacctggactcggcgacgacgtggccggatcacgaagcccagctctggacc

SEQ ID NO: 144 - protein, 235 aa, Zea mays
  GRMZM2G021095_T01
MDDYGNASAGTAAPQPQQYYCRSVSPPSRVSSSCSPPPPPPPPAVLQVVGNVPPPTVVLSPCAACKILRRRCADGCVLAPYFPPTEPAKFTTAHRVFGASNIIKLLQDLPESSRADAVSSMVYEAEARLRDPVYGCAGAVCRLQKQANELKVQLARAQADLLNAQAKHANLLALFCVEMANRRGNQQHPSPLTTMMDGGGGGGFGAAAYYQQTTLYDSDLDSATTWPDHEAQLWT

SEQ ID NO: 145 - DNA, 717 bp, Zea mays
  GRMZM2G145568_T01
atggacgactacggcaacgcgatcgtcgtcacgggcacggcggctccgctcaaatacaactgtcgctccgtgtcgccgccgtcgagcgtgtcgtcgtcgtgctcgccgccaccgcctcctcctcctcctactcctcctgccgccgtccaggtggtggtgggcaacgtggcgccgaccgtcgtcctgagcccgtgcgcggcgtgcaagatcctccggcgccgctgcgccgacggctgcgtgctggctccctacttcccgccgacggagcccgccaagttcaccacagcgcaccgcgtcttcggcgccagcaacatcatcaagctcctccaggacttgccggagagctcgcgcgcggacgcggtgagcagcatggtgtacgaggcggaggcgcggctgcgggacccggtgtacgggtgcgcgggggcggtgtgccggctgcagaggcaggccaacgagctcaaggtgcagctggcgcgcgcgcaggccgacctgctcagcgcgcaggcgcagcacgccgacctgctagccctcttctgcgtcgagatggccaaccgccgcggcaaccggcagcagcagcagcagccgtcgccgccgacgacgacggtggacggcggtggcggaagcgagttcggcggcgcggcgtacgggcagacgttttacgactcggacgacctggactcggccacgtggccggatcacgaagcccagctctggacc

SEQ ID NO: 146 - protein, 239 aa, Zea mays
  GRMZM2G145568_T01
MDDYGNAIVVTGTAAPLKYNCRSVSPPSSVSSSCSPPPPPPPPTPPAAVQVVVGNVAPTVVLSPCAACKILRRRCADGCVLAPYFPPTEPAKFTTAHRVFGASNIIKLLQDLPESSRADAVSSMVYEAEARLRDPVYGCAGAVCRLQRQANELKVQLARAQADLLSAQAQHADLLALFCVEMANRRGNRQQQQQPSPPTTTVDGGGGSEFGGAAYGQTFYDSDDLDSATWPDHEAQLWT

SEQ ID NO: 147 - DNA, 708 bp, Setaria italica
  Si037280m
atggactacggcagcaacgcgagcacgggcacgacggccgcggcggcgcagcagcagcagcagtataataacagttgccgctccgcgtcgccgccgtcgcgggtgtcgtcgtgctcgccgccgccgccggccgcccaggtggtgggcaacgcggcgccgacggtggtgctgagcccgtgcgcggcgtgcaagatcctccggcgccgctgcgccgacgggtgcgtgctggcgccctacttcccgccggcggagccggccaagttcacgaccgcgcatcgcgtgttcggcgccagcaacatcatcaagctcctccaggacctgccggagtgctcgcgcgcggacgcggtgagcagcatggtgtacgaggcggaggcgcggctgcgggaccccgtgtacgggtgcgccggggcggtgtgccgcctgcagaggcaggccaacgagctcaaggtgcagctggcgcgcgcgcaggccgacctcctcaacgcgcaggcgcagcacgccaacctgctagcactcgtttgcgtggacatggtgaaccgccgggacggacaccaccagcaccagcagctgcagcagcagccatcgtcgccgctgatggacggcggcagcggtggcggcagcaacttcggcgcggcgtaccaccagacgttttacgactcggacctggactcagcgacgtggccggatcacgaggcccagctctggacc

SEQ ID NO: 148 - protein, 236 aa, Setaria italica
  Si037280m
MDYGSNASTGTTAAAAQQQQQYNNSCRSASPPSRVSSCSPPPPAAQVVGNAAPTVVLSPCAACKILRRRCADGCVLAPYFPPAEPAKFTTAHRVFGASNIIKLLQDLPECSRADAVSSMVYEAEARLRDPVYGCAGAVCRLQRQANELKVQLARAQADLLNAQAQHANLLALVCVDMVNRRDGHHQHQQLQQQPSSPLMDGGSGGGSNFGAAYHQTFYDSDLDSATWPDHEAQLWT

SEQ ID NO: 149 - DNA, 636 bp, Zea mays
  AC214648.3_FGT005
atggactgctccagcgacacggccgtctgcgccgtggccgtggccgcggccgcggcgccatcacctccttcgtcatcgccacggccgccggcgccggcgctgagcccgtgcgccgcgtgcaagatcctccgccgccgctgcgtggaccgctgcgtgctggcgccctacttcccgcccaccgagccgcacaagttcgccaccgcgcaccgggtgtttggcgccagcaacatcatcaagctcctacaggagctgccggaggcgcaccggggcgacgccgtgagcagcatggtgtacgaggcggcggcgcgcgtccgggaccccgtgtacggctgcgccggcgccatctggcagctgcagaggcaggtgaacgacctcaaggcgcagctggcgcgcgcccacgccgagctcgccggcgcccgcgcccagcacgcgcacctcctcgcgctcctctgcgtcgaggtcgccgcctcctcgccgccgtcctacgactgcgccgccggctactccgcctccccctcgcgtcaccagctagcggcggtcgtcgcggccaaccccgtgatggccgacgccgtcgacggcgccttgcatcagacgcaggccggccccgtcagctgggccgaggaggcgctctggaca

SEQ ID NO: 150 - protein, 212 aa, Zea mays
  AC214648.3_FGT005
MDCSSDTAVCAVAVAAAAAPSPPSSSPRPPAPALSPCAACKILRRRCVDRCVLAPYFPPTEPHKFATAHRVFGASNIIKLLQELPEAHRGDAVSSMVYEAAARVRDPVYGCAGAIWQLQRQVNDLKAQLARAHAELAGARAQHAHLLALLCVEVAASSPPSYDCAAGYSASPSRHQLAAVVAANPVMADAVDGALHQTQAGPVSWAEEALWT

SEQ ID NO: 151 - DNA, 663 bp, Zea mays
  GRMZM2G165805_T01
atggagtacagctccagcgacacggccgtctgcaccgtggccgcggccgcggccgcggcgtcgtcgtcacctccgtcgtcgccacagccacagccacagccggcggcggtggtgctgagcccgtgcgctgcgtgcaagatcctccgccgccgctgcgtcgaccgctgcgtgctggcgccatacttcccgcccacggagccgcacaagttcgcgaccgcgcaccgggtcttcggcgccagcaacatcatcaagctcctccaggagctgccggaggagcaccgcgccgacgccgtgagcagcatggtgtacgaggcggcggcgcgcatccgggaccccgtgtacggctgcgccggcgccatctgccagctgcagaagcaggccaacgagctcaaggcgcagctggcgcgcgcgcacgccgagctcgcctgcgcccgcgcccagcacgcgcacctcctcgcgctcctctgcgtcgaggtcgccgccgccgccgactcctcctcctactccgcctcgcaccaccagctagccgtcgtcgccgccaaccccatggtggccgtggcagccgccgacgcgcaggcagccgacgcgctctacgtcgtcgacggcgccggtgccgcctgcctgcagatgcaggccagctggggcgacgaggcgctctggaca

SEQ ID NO: 152 - protein, 221 aa, Zea mays
  GRMZM2G165805_T01
MEYSSSDTAVCTVAAAAAAASSSPPSSPQPQPQPAAVVLSPCAACKILRRRCVDRCVLAPYFPPTEPHKFATAHRVFGASNIIKLLQELPEEHRADAVSSMVYEAAARIRDPVYGCAGAICQLQKQANELKAQLARAHAELACARAQHAHLLALLCVEVAAAADSSSYSASHHQLAVVAANPMVAVAAADAQAADALYVVDGAGAACLQMQASWGDEALWT

SEQ ID NO: 153 - DNA, 630 bp, Setaria italica
  Si024430m
atggactcctcctcgagcgacactactgccaccgccgctctgccgcacggcggcggggcctcgacggcccccacgtcgccgccggcggcggccgtggtgctgagcccctgcgcggcgtgcaagatcctccgccgccgctgcgtcgaccgctgcgtcctggcgccatacttcccgcccaccgagccccacaagttcgctaccgcccaccgcgtcttcggcgccagcaacatcatcaagctcctgcaggacctgccggaggagcaccgggccgacgcggtgagcagcatggtgtacgaggcgagcgcgcggatccgggaccccgtgtacggctgcgccggcgccatctgccagctgcagaggcaggtgaacgacctcaaggcgcagctggcgcgcgcgcacgcggagctcgccggcgcccgcgcgcagcacgcgcacctcctcgcgctgctctgcgtcgaggtcgccgccgcgtccccggcctactgcggcgccgtcgactacacctcctcgcagctcgcggccgccgccacccccgcggcgcatgccgacgcgctgtacgtcgtcgacggcggcagcggcctgcagctgcaggccagccccgtcagctgggccgacgagccgctctggaca

SEQ ID NO: 154 - protein, 210 aa, Setaria italica
  Si024430m
MDSSSSDTTATAALPHGGGASTAPTSPPAAAVVLSPCAACKILRRRCVDRCVLAPYFPPTEPHKFATAHRVFGASNIIKLLQDLPEEHRADAVSSMVYEASARIRDPVYGCAGAICQLQRQVNDLKAQLARAHAELAGARAQHAHLLALLCVEVAAASPAYCGAVDYTSSQLAAAATPAAHADALYVVDGGSGLQLQASPVSWADEPLWT

SEQ ID NO: 155 - DNA, 609 bp, Citrus clementina
  clementine0.9_022179m
atgcacactacatttccccctctttcttcttctccttctccttcttttcaatcttctccaagcattaatgcctctccttcaaaatcttctccaaatcttgctgccccaccgcctattgttcttagtccatgcgcagcttgcaaaagccttcgccggagatgcgacgagaagtgtgttttagctccatattttccaccaactgaaccacaaaatttcatcattgttcatagagtcttcggagctagcaacatcatcaagtgcttgcagggactgccagagtgtcaacgatcagatgcagtgagcagcatggtctacgaagcaaacgctagaatccgaaatccggtgcatggctgcgcgggtgcaattagtcaactccagaaacaagtgattaagcttcaagcagagttggccaaggcacaagccgagacggtcagcatgcagtgccaacgagacaatttggttgccctaatttgcaaggaaatgacgacacaatttcctcaagaaaccatgaatagggtcttgccccaacagcaattcaatgacgacgacgccaccacatgttatttagatgacaaggattttgcctccacttgggatgctctttggact

SEQ ID NO: 156 - protein, 203 aa, Citrus clementina
  clementine0.9_022179m
MHTTFPPLSSSPSPSFQSSPSINASPSKSSPNLAAPPPIVLSPCAACKSLRRRCDEKCVLAPYFPPTEPQNFIIVHRVFGASNIIKCLQGLPECQRSDAVSSMVYEANARIRNPVHGCAGAISQLQKQVIKLQAELAKAQAETVSMQCQRDNLVALICKEMTTQFPQETMNRVLPQQQFNDDDATTCYLDDKDFASTWDALWT

SEQ ID NO: 157 - DNA, 585 bp, Citrus clementina
  clementine0.9_029047m
tactccactccatctttttcttctcctcgaagcattaatgcttcttcttcacaatcttctccaagttttgctaccccaccgtcgccgccgtctatagttcttagcccctgtgctgcttgcaaaatcctccgccgcagatgcgtcgagaaatgtgttttagctccatattttcctccaactgaaccacaaaagttcgtcatagctcatagagtctttggtgctagcaatatcatcaagttcttgcaggaattgccggaacctcaaagggcagacgcagtgaccagcatggtttatgaagcaaattccagaatcagggatcctgtctacggctgcgccggcgtggtttgccatctgcagaaacaagtcagtgagcttcaggctgagttagccaaggcacaggccgagctcgcttccatgcaaagccagcaacaaaatttgattgctttgatttgcatggaaatggctcaatctcaagaacaagtcctgcatcgtcatcagcagcagcagccgccacagcagttcattgatacaagctgttttttggacgaatacagtcttggctctacctgggaacctctctggaca

SEQ ID NO: 158 - protein, 195 aa, Citrus clementina
  clementine0.9_029047m
YSTPSFSSPRSINASSSQSSPSFATPPSPPSIVLSPCAACKILRRRCVEKCVLAPYFPPTEPQKFVIAHRVFGASNIIKFLQELPEPQRADAVTSMVYEANSRIRDPVYGCAGVVCHLQKQVSELQAELAKAQAELASMQSQQQNLIALICMEMAQSQEQVLHRHQQQQPPQQFIDTSCFLDEYSLGSTWEPLWT

SEQ ID NO: 159 - DNA, 558 bp, Citrus clementina
  clementine0.9_034418m
tcttctccaagctttaaagcttctccttcacaatcctctccaaatcttgcagctcccctctctccgccgcctatagttcttagcccttgtgctgcttgcaaaatcctccgccgcagatgcgtcgagaaatgtgttttagctccatattttccaccaaccgaaccatacaagttcaccattgctcatagagtcttcggtgctagcaatatcatcaagttcttgcaggaactgccagaatctcaacgagcagatgcagtgagcagcatggtctatgaagcaagtgccagaatccgggatcctgtttacggctgcgccggggctatttgccatctccagaaacaagtcagtgagcttcaggctcagttagccaaggcacaggctgagcttgtcaccatggaaagccagcaacgcaatttaataactctaatttgcatggaaatggcacaatctcaagaacaagtcttgcagcagcagcagcagcagcagcaacagttcatggatactagctgttttttggatgacaatggtattggatcagcttgggagcctctgtggaca

SEQ ID NO: 160 - protein, 186 aa, Citrus clementina
  clementine0.9_034418m
SSPSFKASPSQSSPNLAAPLSPPPIVLSPCAACKILRRRCVEKCVLAPYFPPTEPYKFTIAHRVFGASNIIKFLQELPESQRADAVSSMVYEASARIRDPVYGCAGAICHLQKQVSELQAQLAKAQAELVTMESQQRNLITLICMEMAQSQEQVLQQQQQQQQQFMDTSCFLDDNGIGSAWEPLWT

SEQ ID NO: 161 - DNA, 684 bp, Eucalyptus grandis
  Eucgr.J01123.1
atggaaatggaatacaaggcgagaacaaccactataccagcacccgtcacaattcccactaaagtcttcttcccttactcaacatcatcctcatcttcttcaccgccaccacaaccaccatcatctcagtcctcatctccaaccactcctcctcctcatcctccccctcctccttcttcccttcccattaccccactgccgccgccgccgccgccggcagtcctcagcccgtgtgccgcctgcaagatcctgcgccggcggtgcgtggacaagtgtgtcttggccccgtacttcccgcccaccgagccttacaagttcaccattgcgcatcgagtgttcggagctagcaacatcatcaagttcttgcaggaacttccagaaccgcagagagcggatgcagtgagcagcatggtgtacgaggccaacgcgaggatccgagacccggtctacggctgcgccggagccatctgccacctccagaagcaagtaagcgatctccaagagcagctcgccaagactcaagccgagctcgtcaacctcgagctgcagcgggtgaacctcgtcgcggcatgcatggaaatggctcaatcccaagagccgaacatcaatttccagcagcaactcgccgactcaaccggcttcttggaggatggctcggctagctgggaatcgatttactggacg

SEQ ID NO: 162 - protein, 228 aa, Eucalyptus grandis
  Eucgr.J01123.1
MEMEYKARTTTIPAPVTIPTKVFFPYSTSSSSSSPPPQPPSSQSSSPTTPPPHPPPPPSSLPITPLPPPPPPAVLSPCAACKILRRRCVDKCVLAPYFPPTEPYKFTIAHRVFGASNIIKFLQELPEPQRADAVSSMVYEANARIRDPVYGCAGAICHLQKQVSDLQEQLAKTQAELVNLELQRVNLVAACMEMAQSQEPNINFQQQLADSTGFLEDGSASWESIYWT

SEQ ID NO: 163 - DNA, 666 bp, Glycine max
  Glyma10g35760.1
atggagtacaaagtgaaaaccacaacatcaacaccttctccaccaatcccaatccatgttcccactatgctgtcaaactctcctccatcttcatcttcttcacctccttcacaatctcccactcctttcccttcaccctctctgggctctccctctgctgctccaccgtctccgccgccgcctctgccaccggtggtggttagcccttgtgctgcctgcaagatcctccgccgtaggtgtgtggagaagtgtgtgttggctccatatttccctcccactgatcctctcaagttcaccattgctcatagagtctttggagccagcaacatcatcaagttcttgcaggaactgccagaatcccagagagaagatgctgtgagcagcatggtttatgaggcaaatgctaggatcagagacccagtttatgggtgtgctggtgcaatatgccaacttcaaaagcaagttagtgagctacaagcacagctggccaaagcacaagctgaggtagtgaacatgcagtgccaacaagccaatttagtggcgcttatttgcatggaaatgagtcaatcacaggagcagcacgtgcttcagcctcaaactcacgttgatatgagctgcttcatagaggacaacagttttgggactgcttgggagcctctttggaca

SEQ ID NO: 164 - protein, 222 aa, Glycine max
  Glyma10g35760.1
MEYKVKTTTSTPSPPIPIHVPTMLSNSPPSSSSSPPSQSPTPFPSPSLGSPSAAPPSPPPPLPPVVVSPCAACKILRRRCVEKCVLAPYFPPTDPLKFTIAHRVFGASNIIKFLQELPESQREDAVSSMVYEANARIRDPVYGCAGAICQLQKQVSELQAQLAKAQAEVVNMQCQQANLVALICMEMSQSQEQHVLQPQTHVDMSCFIEDNSFGTAWEPLWT

SEQ ID NO: 165 - DNA, 666 bp, Glycine max
  Glyma20g31780.1
atggagtacaaagtgaaaaccacaacctcaacaccttctccaccaatcccaatccatcttcccactatgctctcaaactctcccccatcttcatcttcttcacctccttcacaatctcccactcctttcccttcaccctctcagggctctccctctgctgctccaccgtctcctccgccgccgccgccacccgtggtggttagcccttgtgctgcctgcaagatcctccgccgcaggtgtgtggagaagtgtgtgttggctccatattttcctcccactgatccactcaagttcaccattgctcatagagtctttggagccagcaacatcatcaagttcttgcaggaactgccagaatcccagagagcagatgctgtgagcagcatggtttatgaggcaaatgctaggatcagagacccagtttatgggtgtgcaggtgcaatatgccaacttcaaaagcaagttagtgagctacaagcacagctggccaaagcacaagctgaggtagtgaacatgcagtgccaacaagccaatttagtggccctaatttgcatggaaatgagtcagtcacaggagcagcacgtgcttcagcctcaacctcacgttgatatgagctgcttcatagaggacaacagttttggtactgcttgggagcctctttggaca

SEQ ID NO: 166 - protein, 222 aa, Glycine max
  Glyma20g31780.1
MEYKVKTTTSTPSPPIPIHLPTMLSNSPPSSSSSPPSQSPTPFPSPSQGSPSAAPPSPPPPPPPVVVSPCAACKILRRRCVEKCVLAPYFPPTDPLKFTIAHRVFGASNIIKFLQELPESQRADAVSSMVYEANARIRDPVYGCAGAICQLQKQVSELQAQLAKAQAEVVNMQCQQANLVALICMEMSQSQEQHVLQPQPHVDMSCFIEDNSFGTAWEPLWT

SEQ ID NO: 167 - DNA, 663 bp, Populus trichocarpa
  POPTR_0008s04350.1
atggatatgcttcagaaacctgcagcaatatcaccagtcaaagctccctcacaattctcctgctctccgtcttcttcttcttcaccaccttcttgtcatcattcttgtccaagtacttttcattctccttcgaagtctaattcaccaggtcttacttcaccttcagctgccactctccctcctcctccagttgttattaccccttgtgctgcctgcaaaatccttcgccggcgatgcgttgacaagtgtgttttagctccttatttccctccttctgagccatataagttcaccattgctcatagggtctttggagctagcaacatcatcaagtttttgcaggagctgccagagtctcagagagcagatgcagtaagcagcatggtttatgaggctagtgctaggattagagacccagtttacggctgtgctggtgcgatctctcagcttcaaaaacaagttagtgacctccaagcacaacttgctaaggcacaagctgaggtggtgaacatgcaatgccaacaagccaatctagttgctttactttgcatggaaatgaaacaatctcaacaagaacccatcttgcaacaacatcaatacattgacacgagctgctttcttgacgagaacaatctgggcgcatcatgggaacctctttggaca

SEQ ID NO: 168 - protein, 221 aa, Populus trichocarpa
  POPTR_0008s04350.1
MDMLQKPAAISPVKAPSQFSCSPSSSSSPPSCHHSCPSTFHSPSKSNSPGLTSPSAATLPPPPVVITPCAACKILRRRCVDKCVLAPYFPPSEPYKFTIAHRVFGASNIIKFLQELPESQRADAVSSMVYEASARIRDPVYGCAGAISQLQKQVSDLQAQLAKAQAEVVNMQCQQANLVALLCMEMKQSQQEPILQQHQYIDTSCFLDENNLGASWEPLWT

SEQ ID NO: 169 - DNA, 639 bp, Populus trichocarpa
  POPTR_0010s22470.1
atggatatgattgagcaatctgcagcaatatctccgatcaatgttccatctcaattctcctactctccatcctcttcttcaccaccttcttctcatcattcttctccttcaaagtcttctccaaatcttactccaccttcagctgccactccccctcctcctccgccagttgttagcccttgtgctgcctgcaaaatccttcgccggcgttgcgttgacaagtgtgttttagctccttattttcctccttctgagccatacaagttcaccattgctcatagggtgtttggagccagcaacatcatcaagtttttgcaggaactgccagagtcccagagagcagatgcagtgagcagcatggtttatgaagccaatgcgaggatcagagacccggtttatggctgtgctggtgcaatttctcagcttcaaaaacaagttagtgacctccaagcacagctagccaaggcacaagctgaggtggtgaacatgcaatgccagcaagccaatttagttgctttactctgcatggaaatgacacagtctcaacaagaacccatcttgcaacaacaccaatacgttgacacaagctgctttcttgacgagaacaacttgggcacatcatgggaacctctttggaca

SEQ ID NO: 170 - protein, 213 aa, Populus trichocarpa
  POPTR_0010s22470.1
MDMIEQSAAISPINVPSQFSYSPSSSSPPSSHHSSPSKSSPNLTPPSAATPPPPPPVVSPCAACKILRRRCVDKCVLAPYFPPSEPYKFTIAHRVFGASNIIKFLQELPESQRADAVSSMVYEANARIRDPVYGCAGAISQLQKQVSDLQAQLAKAQAEVVNMQCQQANLVALLCMEMTQSQQEPILQQHQYVDTSCFLDENNLGTSWEPLWT

SEQ ID NO: 171 - DNA, 627 bp, Citrus clementina
  clementine0.9_021862m
atgctaaaaatggagaactatgaggccgctgccacaagaaatcctagcaaagttaccagtagccgtgctggttcgtcatctcctcctccaatatcagctaattcttctgctccgccgccagttatcatgagcccttgtgctgcatgcaagattctgagacgtcgatgtgctgacaaatgtgttttggctccttattttcctccaaccgagcctgccaagttcactattgctcatcgtgttttcggtgccagcaatatcatcaagtttcttcaggaacttccagagtctcagagagcagatgctgtgagcagcatggtttacgaagcaagtgcaagaatccgggacccagtttacggatgtgcgggagcaatttgtcagctacagaagcaagtgagtgagctgcaggcacagctagctaaagcacaagccgaggttgtgagcatgcaatgccagcaagcaaaccttgtggccttgctctacaaggaaatgggaaaatcgccgcagcccaattcgccacaatctgttgaccactttattacaagcccagaaagccctgaagcaaatccctgcagcttctttgaggataacaacttatctgggtcattatgggaaccagctctttggaca

SEQ ID NO: 172 - protein, 209 aa, Citrus clementina
  clementine0.9_021862m
MLKMENYEAAATRNPSKVTSSRAGSSSPPPISANSSAPPPVIMSPCAACKILRRRCADKCVLAPYFPPTEPAKFTIAHRVFGASNIIKFLQELPESQRADAVSSMVYEASARIRDPVYGCAGAICQLQKQVSELQAQLAKAQAEVVSMQCQQANLVALLYKEMGKSPQPNSPQSVDHFITSPESPEANPCSFFEDNNLSGSLWEPALWT

SEQ ID NO: 173 - DNA, 612 bp, Glycine max
  Glyma11g15810.1
atggagagcagcgacacatacacccccacttcctctgccccactttctcactccccctctaattcctcttcttcctcaccaccaccacctcccactgttgtgatgagtccttgtgctgcatgcaagattttgaggagaaaatgtgcagagaaatgtgtgttggcaccttatttccctccaactgaacctgccaagtttactattgcacaccgtgtatttggtgctagcaacatcatcaagttccttcaggagcttccagagtctcagagggctgatgcagtgaccagcatggtgtatgaggctagtgcaagaataagagaccctgtatatggttgtgcaggggcaatttgccagctccaaaagcaggtcaatgaacttcaagcacaattggccaaggcacaaggtgagcttgtgaacatgcagcttcagcaagccaatcttgtggctctaatttgcatggaaatggcacagagtccacaggaatcaccacaacaatcagtggataatttcatttcaactcctccccagagtggtggtgcatatcaaagtggcatgaacttctttgaggacaacactagcctaaactcactatgggaacaacccctttggaca

SEQ ID NO: 174 - protein, 204 aa, Glycine max
  Glyma11g15810.1
MESSDTYTPTSSAPLSHSPSNSSSSSPPPPPTVVMSPCAACKILRRKCAEKCVLAPYFPPTEPAKFTIAHRVFGASNIIKFLQELPESQRADAVTSMVYEASARIRDPVYGCAGAICQLQKQVNELQAQLAKAQGELVNMQLQQANLVALICMEMAQSPQESPQQSVDNFISTPPQSGGAYQSGMNFFEDNTSLNSLWEQPLWT

SEQ ID NO: 175 - DNA, 606 bp, Glycine max
  Glyma12g07650.1
atggaaaacagtgacatttcctctgccccactttctcactcccccactaattcctcttcttcctcaccaacaccaccttcacctcctactgttgtgatgagtccttgtgctgcatgcaagattttgaggagaagatgtgctgagaaatgtgtcttggcaccttattttcctccaactgaacctgccaagtttaccattgcacaccgggtatttggtgccagcaacatcatcaagttccttcaggagcttccagagtctcagagagctgatgcagtgaccagcatggtgtatgaggctagtgcaagaataagagaccctgtttatggttgtgcaggggcaatttgccagctccaaaagcagatcaatgaacttcaagcacaattggccaaggcacaagctgagcttgtgaacatgcagattcagcaagccaatcttgtggctctaatttgcatgaaaatggcacagagtccacaggaatcaccacaacaattagtggatgatttcatttcaactcctccccacagtggtggtgcctatcaaagtggcatgaacttctttgaggacaacactagcctaaactcactatgggaacagcccctttggaca

SEQ ID NO: 176 - protein, 202 aa, Glycine max
  Glyma12g07650.1
MENSDISSAPLSHSPTNSSSSSPTPPSPPTVVMSPCAACKILRRRCAEKCVLAPYFPPTEPAKFTIAHRVFGASNIIKFLQELPESQRADAVTSMVYEASARIRDPVYGCAGAICQLQKQINELQAQLAKAQAELVNMQIQQANLVALICMKMAQSPQESPQQLVDDFISTPPHSGGAYQSGMNFFEDNTSLNSLWEQPLWT

SEQ ID NO: 177 - DNA, 500 bp, Glycine max
  Glyma13g40370.1
caagttgtcatgatcccttgtgctgcttgcaagattctgaggcgaagatgtgctgagaaatgtgtcttggcaccttatttccctcccactgaacctgccaagtttaccactgcacaccgagtcttcggtgccagcaacatcatcaagttcttgcaggaacttccagagtctcaaagagctgatgcagtggccagcatggtttatgaggctggtgcaagaataagagacccagtgtacggatgtgcaggtgcaatttgccacctccaaaagcaagtcaatgaacttcaagcacagttagcaaaggcacaagctgaggttgtaaacatgcaattccaacaagcgaatctcgtggctctaatttgcatggaaatggcacaaacacaaactccacaggaatcaccacaacaatctgtggacaacttcatttcaagcccttcacacagcagcggctatcaaaacaatctcaatttctttgaggagaacaccaataacctaaactc

SEQ ID NO: 178 - protein, 168 aa, Glycine max
  misc_feature (168)..(168): Xaa can be any naturally occurring amino acid
  Glyma13g40370.1
QVVMIPCAACKILRRRCAEKCVLAPYFPPTEPAKFTTAHRVFGASNIIKFLQELPESQRADAVASMVYEAGARIRDPVYGCAGAICHLQKQVNELQAQLAKAQAEVVNMQFQQANLVALICMEMAQTQTPQESPQQSVDNFISSPSHSSGYQNNLNFFEENTNNLNSX

SEQ ID NO: 179 - DNA, 503 bp, Glycine max
  Glyma15g05030.1
caagttgtcatgagcccttgtgctgcttgcaagattctgaggcgaagatgtgctgagaaatgtgtcttggcaccttatttccctctcactgaaccttccaagtttaccactgcacaccgagtcttcggtgccagcaacatcatcaagttcttgcaggaacttccagagtctcaaagagctgatgcagtggccagcatggtttatgaggctggtgcaagaataagagacccagtatatggatgtgcaggtgcaatttgccagcttcaaaagcaagtcaatgaacttcaagcacagttagcaaaggcacaagctgaggttgtaaacatgcaactccaacaagccaatctggtggctctaatttgcatggaaatggcacaaacacaaactccacaggaatattcaccacaacaatctgtggacaacttcatttcaagcacttcccacagcagtggctatcaaaacaatctcaatttctttgaggagaacaccaataacctaaactc

SEQ ID NO: 180 - protein, 169 aa, Glycine max
  misc_feature (169)..(169): Xaa can be any naturally occurring amino acid
  Glyma15g05030.1
QVVMSPCAACKILRRRCAEKCVLAPYFPLTEPSKFTTAHRVFGASNIIKFLQELPESQRADAVASMVYEAGARIRDPVYGCAGAICQLQKQVNELQAQLAKAQAEVVNMQLQQANLVALICMEMAQTQTPQEYSPQQSVDNFISSTSHSSGYQNNLNFFEENTNNLNSX

SEQ ID NO: 181 - DNA, 612 bp, Vitis vinifera
  GSVIVT01025126001
atggcgtgcagtgaccctacatccgcccccaaccccaccaccacctctccgtcgtctcctcactcactctctccaccctcatcctctactcctccccctcccaccgtcgtcctcagcccttgtgccgcctgcaagattctcaggcggcgctgcgccgaaaaatgtgtgttagctccctactttcctcccaccgaccccgccaaattcaccaccgctcatcgcgtcttcggcgccagcaacatcatcaagttcctacaggaacttccagagtatcagcgcgccgatgctgtgagtagcatggtttatgaagctcaagccaggattagagacccagtctatgggtgtacgggagcgatctgtcagctgcaaaaacaagtcagcgagcttcaagcgcaattagcaaaggcgcaagccgagctcgtaaacatgcaatgccagcaagcaaaccttatagctataatttgtatggaaatgtcaggatctcctcaaccctcttccttccaacagtcacttgacagctttatcagccctccaagctatcaaagcggctcctgcttccttgatgacaacatcaccggagctgcatgggagcctctctggacttcatcttta

SEQ ID NO: 182 - protein, 204 aa, Vitis vinifera
  GSVIVT01025126001
MACSDPTSAPNPTTTSPSSPHSLSPPSSSTPPPPTVVLSPCAACKILRRRCAEKCVLAPYFPPTDPAKFTTAHRVFGASNIIKFLQELPEYQRADAVSSMVYEAQARIRDPVYGCTGAICQLQKQVSELQAQLAKAQAELVNMQCQQANLIAIICMEMSGSPQPSSFQQSLDSFISPPSYQSGSCFLDDNITGAAWEPLWTSSL

SEQ ID NO: 183 - DNA, 606 bp, Vitis vinifera
  GSVIVT01025128001
atggagtgcagtgacagcacggccgccaccaacaacagctcttgctcatcatcgtctcctcgctcactctcgccatcttcatcctcttctcctccccctcccaacgtcgtccttagcccttgtgccgcttgcaagattctccggcgtcgctgcgccgataaatgtgtgttagcgccctactttccgcccaccgaccccgccaaattcaccaccgctcatcgtgtgttcggggccagcaatatcatcaagttcttacaggaacttcccgaatttcaaagagccgatgcagttagcagcatggtttatgaagcgcaagcgaggattagagacccggtttacggatgcgcgggagcgatttgtcagcttcaaaaacaacttgacgagctccaagcacaattagcaaagacgcaagccgagctagtgaacatgcaatgccaacaagcgaaccttgtaactatgatatgcatggaaatggaaatgtctcagtcccctcaaccttcctccgaagaatcccttgatagcttaattagcccacaaagctatcagagtaactccttcttcctcgatgacagcaatattggagccacatgggagcctctctggaca

SEQ ID NO: 184 - protein, 202 aa, Vitis vinifera
  GSVIVT01025128001
MECSDSTAATNNSSCSSSSPRSLSPSSSSSPPPPNVVLSPCAACKILRRRCADKCVLAPYFPPTDPAKFTTAHRVFGASNIIKFLQELPEFQRADAVSSMVYEAQARIRDPVYGCAGAICQLQKQLDELQAQLAKTQAELVNMQCQQANLVTMICMEMEMSQSPQPSSEESLDSLISPQSYQSNSFFLDDSNIGATWEPLWT

SEQ ID NO: 185 - DNA, 669 bp, Eucalyptus grandis
  Eucgr.B02465.1
atggctgtgcaagatatggaggtttcggacgcgagtgtcacgaacggaaacgcccacacgagctccacaaccacctcttctccgcagtctgtctcgcctacttcgtcgtcttctcctcctccccctcttcctccgccgacgccggtcatcataagcccttgcgcggcctgcaagattctgaggcgaaggtgtgccgtcgagaagtgcgtgctggcgccctattttcctcccaccgagcccgccaagttcactattgcccatcgcgtcttcggcgcaagcaacatcatcaagctcttgcaggaccttccagaatcacagcgagccgatgcggtgagtagcatggtgtatgaggctggggcgaggatcagggaccctgtctatggctgcgcaggcgcgatctgccaactccagaagcaagtgagcgagctccaggctcagctggccaaggcccaagccgagatcctcaccatgcaacaccagcaaaccaacctggtggccttgctgtgcatggaaatggctcagtcggcttctcagccgccagcgcaacaattcgtcgacaatctaatcgacaccagtccaaccatctaccagaacaacagtaacaacaacataagcccgttcctggacgagaccaacgtcatggggtccatgtgggagccgctttggaca

SEQ ID NO: 186 - protein, 223 aa, Eucalyptus grandis
  Eucgr.B02465.1
MAVQDMEVSDASVTNGNAHTSSTTTSSPQSVSPTSSSSPPPPLPPPTPVIISPCAACKILRRRCAVEKCVLAPYFPPTEPAKFTIAHRVFGASNIIKLLQDLPESQRADAVSSMVYEAGARIRDPVYGCAGAICQLQKQVSELQAQLAKAQAEILTMQHQQTNLVALLCMEMAQSASQPPAQQFVDNLIDTSPTIYQNNSNNNISPFLDETNVMGSMWEPLWT

SEQ ID NO: 187 - DNA, 591 bp, Vitis vinifera
  GSVIVT01016335001
atggaaagcgctgagaacaacaaagcaccggggactactgtttcaactcctcttccgttttctccaacttcttcttctaattcaggtctcccccggtctcctcctgcccttgtcgttctcagcccttgtgctgcctgcaagatcctccgccggcgatgcgccgataaatgtgttttggctccatactttcctcccaccgagcccctcaaattcaccattgcccacagagtcttcggagctagcaacattatcaagctcttgcaggatctcccggaatcccagagagcggatgctgtgagcagcatggtgtatgaagcaaatgcgagaattcgggaccccgtgtatggatgtgctggcgcaatttgtcaccttcagaaacaagtgagtgagctgcaggcacaattggctaaggcccaagcggatgtcatcaacatgcaatgccagcaagacaacttagtggccatactttgcatggactttcagcagcagcagcagcagccacaatatcagcagcaacaacaacaaccatttgagttcaatgggagcttcttccttgaggatggcaatcttgtcatggagcctctgtggaca

SEQ ID NO: 188 - protein, 197 aa, Vitis vinifera
  GSVIVT01016335001
MESAENNKAPGTTVSTPLPFSPTSSSNSGLPRSPPALVVLSPCAACKILRRRCADKCVLAPYFPPTEPLKFTIAHRVFGASNIIKLLQDLPESQRADAVSSMVYEANARIRDPVYGCAGAICHLQKQVSELQAQLAKAQADVINMQCQQDNLVAILCMDFQQQQQQPQYQQQQQQPFEFNGSFFLEDGNLVMEPLWT

SEQ ID NO: 189 - DNA, 594 bp, Solanum lycopersicum
  Solyc06g005090.2.1
atggagtctagtagtgacactaccaatgccaccactattacttcctcaccaccatcttctcgatccgtctcgccgtcctcttcctctcctcctaactctccaccatcgccacaagtggcggtagtcatcagcccttgtgcggcctgcaagatcttgaggaggaggtgcgccgagaaatgtgtgttggctccttattttcctcccaatgatcctatcaagttcactaccgctcatcgcgtctttggcgcaagcaatattatcaagttcttgcaggaactaccggaatttcaaagagcagatgctgtgagtagtatggtgtatgaagccaatgctaggttgagggatcctgtgtatggttgtgcaggagcaatatgtcaactacaaaagcaagtgaatgagcttcaagtacaattagctaaagcacaagctgaggttgtcaacatgcaatgtgaacaagctaactttatgacacttttttgtatggaaaatatgacacaatcaccaccacaacaatcattggataatttcacacaaatcaacatgagcatcttagatgataacaatgttggatctatatgggagactctttggaca

SEQ ID NO: 190 - protein, 198 aa, Solanum lycopersicum
  Solyc06g005090.2.1
MESSSDTTNATTITSSPPSSRSVSPSSSSPPNSPPSPQVAVVISPCAACKILRRRCAEKCVLAPYFPPNDPIKFTTAHRVFGASNIIKFLQELPEFQRADAVSSMVYEANARLRDPVYGCAGAICQLQKQVNELQVQLAKAQAEVVNMQCEQANFMTLFCMENMTQSPPQQSLDNFTQINMSILDDNNVGSIWETLWT

SEQ ID NO: 191 - DNA, 567 bp, Solanum lycopersicum
  Solyc11g072470.1.1
atggaatctacaatatcttcatcttcatctcgatccgtatcgccttcgtcttcatcttcacctaactcaccaccacccccgtcaatgacagtggtggtggtgagtccttgcgccgcctgtaaaatattacggcggcgctgtgctgagaaatgtgtgttggcaccttattttcctccaaatgatcctattaagttcactacggctcatcgtgtgtttggtgctagcaatattatcaagtttttacaggaattaccagaatctcaaagggcagatgctgtaagcagcatggtatatgaagcaaatgcaagactaagagatccagtatatggttgtgctggttcaatttgtcaattacaaaagcaagttagtgatcttcaagcacaattagctaaagcacaagctgaaattgtcaacatgcaatgtcaacaagcaaatctcatggcactaatttgtatggaaatgggccaatctaatccacaaccaatatcaccaccacaacaatctttagaaaatttccctatgaattacttagatgataacattggatcatgggaaaccctatggaca

SEQ ID NO: 192 - protein, 189 aa, Solanum lycopersicum
  Solyc11g072470.1.1
MESTISSSSSRSVSPSSSSSPNSPPPPSMTVVVVSPCAACKILRRRCAEKCVLAPYFPPNDPIKFTTAHRVFGASNIIKFLQELPESQRADAVSSMVYEANARLRDPVYGCAGSICQLQKQVSDLQAQLAKAQAEIVNMQCQQANLMALICMEMGQSNPQPISPPQQSLENFPMNYLDDNIGSWETLWT

SEQ ID NO: 193 - DNA, 726 bp, Solanum lycopersicum
  Solyc06g075330.1.1
atgttaagtacgaatgagggcattcgtttaataggacatttggccaccagttccaggcattttgaccatcaattcagtgttattattattattattattatgttttttgaccatctttttcttttgattttcagatggagtccaacaaaacgacgatcaccaccacaacaccgtcgtctccctgctctgtattgccgccaactaactctccatctccaccgcgggtggtggccacaccttgtgctgcctgtaagatattacgaaggagatgcgcggagaaatgtgttggcaccttattttcctcccagtgaacccatcaaattcaccattgctcatcgtgtttttggtgctagcaatattatcaagtttttgcaggaattgccagaatatcaaagagcagatgctgtaagtagcatggtctacgaggctaatgctaggatgagggatccagtgtatggttctgctggggcaatttgtcaacttcaaaaacaagtaaatgagctgcaagcacaattagccaaaacacaagctgaacttgtcaatatccaatgccaacaagctaatcttatggcctttgtttacatggaaatgggaccatctccaccaacatcaccccaacaatctttggacaagttcaccaatagtactacacatgacaccatccaaaataacatgagtttcctagatgaaaacaacagttatgggaccctcgagactctttggaca

SEQ ID NO: 194 - protein, 242 aa, Solanum lycopersicum
  Solyc06g075330.1.1
MLSTNEGIRLIGHLATSSRHFDHQFSVIIIIIIMFFDHLFLLIFRWSPTKRRSPPQHRRLPALYCRQLTLHLHRGWWPHLVLPVRYYEGDARRNVLAPYFPPSEPIKFTIAHRVFGASNIIKFLQELPEYQRADAVSSMVYEANARMRDPVYGSAGAICQLQKQVNELQAQLAKTQAELVNIQCQQANLMAFVYMEMGPSPPTSPQQSLDKFTNSTTHDTIQNNMSFLDENNSYGTLETLWT

SEQ ID NO: 195 - DNA, 495 bp, Solanum lycopersicum
  Solyc04g050010.1.1
atggaagacacgagtgagtattcttgtcctcatcatccttgtgcagcctgcaagatccttcgtaggagatgtgtggagaaatgtgtgttggcaccttactttccccccactcacccactcaagttcaccattgctcatagagtctttggtgctagcaacatcatcaaaatgctacaggagcttccagaggatcaaagagaagatgcagtgaatagcatggtgtatgaggcgaatgcaaggattagagatccagtatatggttgcgccgcgataatttgtcagcttcaaaaacaaataagtgagcttcaagcagatcttgtcaaggctcaagtagagattatgaatgttcaaatacaaaataccaatttggtggcattaatttgcacagaaatgacacaaaatcaagaaaataatgatcatcaacaagcttatggaaattccaacacttgtttggaagacaacaatttatatgcaccttggaaatcactttggaca

SEQ ID NO: 196 - protein, 165 aa, Solanum lycopersicum
  Solyc04g050010.1.1
MEDTSEYSCPHHPCAACKILRRRCVEKCVLAPYFPPTHPLKFTIAHRVFGASNIIKMLQELPEDQREDAVNSMVYEANARIRDPVYGCAAIICQLQKQISELQADLVKAQVEIMNVQIQNTNLVALICTEMTQNQENNDHQQAYGNSNTCLEDNNLYAPWKSLWT

SEQ ID NO: 197 - DNA, 645 bp, Solanum lycopersicum
  Solyc05g048740.2.1
atggaatgtagtgatcacaaaaccacaacaacaatttcttcaatgaattcatcatcatcaacatttgctagtactatatctaccactccaacaagtggattattgtcacctaaaagtagtatattattatcaactcctccaatgaatgttgttctttctccatgtgctgcttgtaaaatcctccgtaggagatgtgttgagaaatgtgtattggcaccttattttcctcccactgaccctcttaagttcaccattgctcatagagtctttggtgctagcaacatcatcaaaatgttacaggagcttccagaggaacaaagagtggacgcggtgaatagtatggtgtatgaagcaaatgcaagaataagagatccagtttatggttgtgctggtgcaatttgtcaattacaaaaacaaataagtgaactccaagcagaatttgcaaaggcacaagcagaaatcttgaatttaaaatgtcaaaattcaaatttattggctttagtttgcatggaagtatcagaaaatagcagcaatagcttattattatcttcagatcatattaatgattatgaaaataataatgataatactagcatgtttttggaagacaacaatttatatggagcttgggaaccactttggaca

SEQ ID NO: 198 - protein, 215 aa, Solanum lycopersicum
  Solyc05g048740.2.1
MECSDHKTTTTISSMNSSSSTFASTISTTPTSGLLSPKSSILLSTPPMNVVLSPCAACKILRRRCVEKCVLAPYFPPTDPLKFTIAHRVFGASNIIKMLQELPEEQRVDAVNSMVYEANARIRDPVYGCAGAICQLQKQISELQAEFAKAQAEILNLKCQNSNLLALVCMEVSENSSNSLLLSSDHINDYENNNDNTSMFLEDNNLYGAWEPLWT

SEQ ID NO: 199 - DNA, 999 bp, Arabidopsis thaliana
  AT1G74080.1
atggtacggacgccgtgttgtagagcagaagggttgaagaaaggagcatggactcaagaagaagaccaaaagcttatcgcctatgttcaacgacatggtgaaggcggttggcgaacccttccggacaaagctggactcaaaagatgtggcaaaagctgcagattgagatgggcgaattacttaagacctgacattaaacgtggagagtttagccaagacgaggaagattccatcatcaacctccacgccattcatggcaacaaatggtcggccatagctcgtaaaataccaagaagaacagacaatgagatcaagaaccattggaacactcacatcaagaaatgtctggtcaagaaaggtattgatccgttgacccacaaatcccttctcgatggagccggtaaatcatctgaccattccgcgcatcccgagaaaagcagcgttcatgacgacaaagatgatcagaattcaaataacaaaaagttgtcaggatcatcatcagctcggtttttgaacagagtagcaaacagattcggtcatagaatcaaccacaatgttctgtctgatattattggaagtaatggcctacttactagtcacactactccaactacaagtgtttcagaaggtgagaggtcaacgagttcttcctccacacatacctcttcgaatctccccatcaaccgtagcataaccgttgatgcaacatctctatcctcatccacgttctctgactcccccgacccgtgtttatacgaggaaatagtcggtgacattgaagatatgacgagattttcatcaagatgtttgagtcatgttttatctcatgaagatttattgatgtccgttgagtcttgtttggagaatacttcattcatgagggaaattacaatgatctttcaagaggataaaatcgagacgacgtcgtttaatgatagctacgtgacgccgatcaatgaagttgatgactcctgtgaagggattgacaattattttgga

SEQ ID NO: 200 - protein, 333 aa, Arabidopsis thaliana
  AT1G74080.1
MVRTPCCRAEGLKKGAWTQEEDQKLIAYVQRHGEGGWRTLPDKAGLKRCGKSCRLRWANYLRPDIKRGEFSQDEEDSIINLHAIHGNKWSAIARKIPRRTDNEIKNHWNTHIKKCLVKKGIDPLTHKSLLDGAGKSSDHSAHPEKSSVHDDKDDQNSNNKKLSGSSSARFLNRVANRFGHRINHNVLSDIIGSNGLLTSHTTPTTSVSEGERSTSSSSTHTSSNLPINRSITVDATSLSSSTFSDSPDPCLYEEIVGDIEDMTRFSSRCLSHVLSHEDLLMSVESCLENTSFMREITMIFQEDKIETTSFNDSYVTPINEVDDSCEGIDNYFG

SEQ ID NO: 201 - DNA, 1056 bp, Arabidopsis thaliana
  AT1G18570.1
atggtgcggacaccgtgttgcaaagctgaactagggttaaagaaaggagcttggactcccgaggaagatcagaagcttctctcttaccttaaccgccacggtgaaggtggatggcgaactctccccgaaaaagctggactcaagagatgcggcaaaagctgcagactgagatgggccaattatcttagacctgacatcaaaagaggagagttcactgaagacgaagaacgttcaatcatctctcttcacgcccttcacggcaacaaatggtctgctatagctcgtggactaccaggaagaaccgataacgagatcaagaactactggaacactcatatcaaaaaacgtttgatcaagaaaggtattgatccagttacacacaagggcataacctccggtaccgacaaatcagaaaacctcccggagaaacaaaatgttaatctgacaactagtgaccatgatcttgataatgacaaggcgaagaagaacaacaagaattttggattatcatcggctagtttcttgaacaaagtagctaataggttcggaaagagaatcaatcagagtgttctgtctgagattatcggaagtggaggcccacttgcttctactagtcacactactaatactacaactacaagtgtttccgttgactctgaatcagttaagtcaacgagttcttccttcgcaccaacctcgaatcttctctgccatgggaccgttgcaacaacaccagtttcatcgaactttgacgttgatggtaacgttaatctgacgtgttcttcgtccacgttctctgattcctccgttaacaatcctctaatgtactgcgataatttcgttggtaataacaacgttgatgatgaggatactatcgggttctccacatttctgaatgatgaagatttcatgatgttggaggagtcttgtgttgaaaacactgcgttcatgaaagaacttacgaggtttcttcacgaggatgaaaacgacgtcgttgatgtgacgccggtctatgaacgtcaagacttgtttgacgaaattgataactattttgga

SEQ ID NO: 202 - protein, 352 aa, Arabidopsis thaliana
  AT1G18570.1
MVRTPCCKAELGLKKGAWTPEEDQKLLSYLNRHGEGGWRTLPEKAGLKRCGKSCRLRWANYLRPDIKRGEFTEDEERSIISLHALHGNKWSAIARGLPGRTDNEIKNYWNTHIKKRLIKKGIDPVTHKGITSGTDKSENLPEKQNVNLTTSDHDLDNDKAKKNNKNFGLSSASFLNKVANRFGKRINQSVLSEIIGSGGPLASTSHTTNTTTTSVSVDSESVKSTSSSFAPTSNLLCHGTVATTPVSSNFDVDGNVNLTCSSSTFSDSSVNNPLMYCDNFVGNNNVDDEDTIGFSTFLNDEDFMMLEESCVENTAFMKELTRFLHEDENDVVDVTPVYERQDLFDEIDNYFG

SEQ ID NO: 203 - DNA, 885 bp, Arabidopsis thaliana
  AT5G60890.1
atggtgaggacaccatgttgcaaagaagaaggaataaagaaaggagcttggactcctgaggaagatcaaaagcttattgcttatcttcacctacatggtgaaggtggatggcgtactctccctgaaaaagctggattgaagagatgtggaaagagttgtagattgagatgggctaattacttaagacccgacattaagagaggagagtttagtcctgaagaagacgacactatcatcaagcttcatgctcttaagggtaacaagtgggccgcaatcgccactagcttggcgggacgaactgacaacgaaataaaaaactattggaacacaaatctcaagaagcggttgaagcaaaaaggcatcgatgcaatcactcacaaaccgatcaattcaaccggtcaaaccggtttcgaaccaaaagtaaataaaccggtatattcatccggttccgctaggcttcttaaccgcgtcgcaagcaaatacgcggttgaattaaaccgggacttactgaccgggatcatcagtggaaactccaccgtcgccgaagattcacaaaactccggcgacgttgattctccgacctccacattgctcaacaaaatggcggcaacatcagttttgatcaacactacgactacatattccggcttctccgacaactgttctttcactgatgaattcaacgaattctttaacaatgaagagatctccgatatttacacgactgtcgataattttgggtttatggaagagttaaagagtattttaagctacggcgatgccagcgccggagttattgaaaattcgccggaggtcaatgtagctgatgcaatggagttcattgattcctggaacgaagatgacaatatggttggagtctttgtc

SEQ ID NO: 204 - protein, 295 aa, Arabidopsis thaliana
  AT5G60890.1
MVRTPCCKEEGIKKGAWTPEEDQKLIAYLHLHGEGGWRTLPEKAGLKRCGKSCRLRWANYLRPDIKRGEFSPEEDDTIIKLHALKGNKWAAIATSLAGRTDNEIKNYWNTNLKKRLKQKGIDAITHKPINSTGQTGFEPKVNKPVYSSGSARLLNRVASKYAVELNRDLLTGIISGNSTVAEDSQNSGDVDSPTSTLLNKMAATSVLINTTTTYSGFSDNCSFTDEFNEFFNNEEISDIYTTVDNFGFMEELKSILSYGDASAGVIENSPEVNVADAMEFIDSWNEDDNMVGVFV

SEQ ID NO: 205 - DNA, 1659 bp, Arabidopsis thaliana
  AT1G62300.1
atggacagaggatggtctggtctcactcttgattcatcttctcttgatcttttaaaccctaatcgtatttctcataagaatcaccgacgtttctcaaatcctttggcgatgtctagaattgacgaagaagatgatcagaagacgagaatatcaaccaacggtagtgaatttaggtttccggtgagtctctcaggtattcgtgatcgtgaagatgaagatttttcatctggcgttgctggagataatgaccgtgaagttcccggcgaagtggatttcttctccgacaagaaatctagggtttgtcgtgaagacgacgaaggatttcgtgtgaagaaggaagaacaagatgatcgaacggacgtaaataccggtttgaatcttcgaacaactggtaatacaaagagtgatgagtcaatgatcgatgatggagaatcttccgaaatggaagataagcgtgcgaaaaatgagttggtgaaattacaagatgagttgaagaaaatgacaatggataatcaaaagcttagagaattgcttacacaagttagcaacagttacacttcacttcagatgcatcttgtttcactaatgcagcaacagcaacaacagaacaataaggtaatagaagctgctgagaagcctgaggagacgatagtaccaaggcaatttattgatttaggccctacgagagcagtaggtgaggccgaggatgtgtcaaattcttcatccgaagatagaactcgttcggggggttcttctgcagccgagaggcgtagtaacgggaagagacttgggcgtgaagaaagccccgaaactgagtccaacaaaattcagaaggtgaattctactaccccgacgacatttgatcaaaccgctgaagctacgatgaggaaagcccgtgtctccgttcgtgcccgatcggaagctccgatgataagcgatggatgtcaatggagaaaatatggccagaagatggccaaagggaatccttgtccgcgggcatattaccgctgcacgatggccacgggctgtcccgttcgcaaacaagttcaacgttgcgcggaagacagatcaattctgattacaacctacgagggaaaccataaccatccgttgccgccagccgcggtagccatggcttctaccaccacggcggcggctaacatgttgctatccgggtcaatgtctagtcacgacgggatgatgaaccctacaaatttactagctagggctgttcttccttgctccacaagcatggcaacaatctcagcctccgcgccgtttccaaccgtcacattagacctcacccactcacctccgcctcctaatggttccaatccttcctcttccgcggctaccaacaacaaccacaactcactgatgcagcggccgcaacaacaacaacagcaaatgacgaacttacctccgggaatgctacctcatgtaataggccaggcattgtataaccaatccaagttctcggggctgcagttctctggtggctctccctcgacggcagcgttttctcagtcacacgcggtggctgatacaataacggcactcacagctgacccgaatttcacggcggctcttgcagccgttatttcttctatgatcaatggtacgaaccaccacgacggcgaaggaaacaacaaaaatcaa

SEQ ID NO: 206 - protein, 553 aa, Arabidopsis thaliana
  AT1G62300.1
MDRGWSGLTLDSSSLDLLNPNRISHKNHRRFSNPLAMSRIDEEDDQKTRISTNGSEFRFPVSLSGIRDREDEDFSSGVAGDNDREVPGEVDFFSDKKSRVCREDDEGFRVKKEEQDDRTDVNTGLNLRTTGNTKSDESMIDDGESSEMEDKRAKNELVKLQDELKKMTMDNQKLRELLTQVSNSYTSLQMHLVSLMQQQQQQNNKVIEAAEKPEETIVPRQFIDLGPTRAVGEAEDVSNSSSEDRTRSGGSSAAERRSNGKRLGREESPETESNKIQKVNSTTPTTFDQTAEATMRKARVSVRARSEAPMISDGCQWRKYGQKMAKGNPCPRAYYRCTMATGCPVRKQVQRCAEDRSILITTYEGNHNHPLPPAAVAMASTTTAAANMLLSGSMSSHDGMMNPTNLLARAVLPCSTSMATISASAPFPTVTLDLTHSPPPPNGSNPSSSAATNNNHNSLMQRPQQQQQQMTNLPPGMLPHVIGQALYNQSKFSGLQFSGGSPSTAAFSQSHAVADTITALTADPNFTAALAAVISSMINGTNHHDGEGNNKNQ

SEQ ID NO: 207 - DNA, 1584 bp, Arabidopsis thaliana
  AT4G04450.1
atgtttcgttttccggtaagtcttggaggaggtccacgtgagaatctgaagccatcagatgagcagcatcaacgtgcggtggtgaatgaggttgactttttccgatcagcggagaagagagatagggtttcacgtgaagaacaaaacattatcgccgatgagactcatagggttcatgtcaaaagggagaattcacgtgttgatgatcatgacgatcgttctactgatcacatcaatattggacttaatcttctcactgcgaatacgggaagcgacgagtcaatggtggatgatggattgtctgtggatatggaagagaaacgtacaaagtgtgagaatgcacaacttcgcgaagagctaaagaaggcgagtgaagataatcaaagactaaagcaaatgctaagtcaaacaaccaacaacttcaattccttgcagatgcaacttgttgctgtcatgaggcaacaagaagatcatcatcacctagctacgaccgagaacaatgacaatgtaaagaaccgacatgaagtgcctgaaatggttccaagacagttcatcgatttgggaccgcattctgacgaagtgtcgtccgaggagaggacgacggttcggtcgggatctcctccctcgcttctagagaaatctagctcacgtcaaaacggaaagagagtgcttgtaagagaagaaagcccggaaaccgaatccaacggctggagaaaccctaacaaagttcctaaacaccatgcatcatccagcatttgcggtggcaatggcagtgaaaatgcaagtagcaaggtcattgagcaagcggccgccgaagccaccatgcgtaaagcccgtgtctcggttcgtgctcgatccgaagctcccatgttaagcgatggatgtcaatggagaaaatacggacaaaaaatggcgaaaggaaacccgtgccctcgagcttattaccgttgcacaatggctgttggatgtcctgttcgcaagcaagtgcaacgttgcgcggaagatagaaccattctcataacaacctacgaaggaaaccataaccatccattacctcctgcggctatgaacatggcttcaactacaacagcagccgcaagcatgcttctctcaggctccaccatgtcgaaccaagacggtttaatgaacccaacaaatctcttggctcgaaccatattaccgtgttcctcaagcatggctactatctcagcctctgcaccattcccaaccattacattagacctcacagagtcacccaacgggaacaatccaaccaataacccgctgatgcaattctctcaacggtctggtttggtggagttgaaccaatcggttttgcctcatatgatgggtcaggctttgtactacaaccaacagtctaagttttcgggtttacatatgccgtctcagccgctaaacgctggtgagagtgttagcgccgctactgccgcaatcgcctccaatcccaactttgccgcggctctagctgcagccataacttcgattatcaacggttcgaacaatcagcagaatgggaacaacaataacagtaatgttacaacgagcaacgttgacaataggcaa

SEQ ID NO: 208 - protein, 528 aa, Arabidopsis thaliana
  AT4G04450.1
MFRFPVSLGGGPRENLKPSDEQHQRAVVNEVDFFRSAEKRDRVSREEQNIIADETHRVHVKRENSRVDDHDDRSTDHINIGLNLLTANTGSDESMVDDGLSVDMEEKRTKCENAQLREELKKASEDNQRLKQMLSQTTNNFNSLQMQLVAVMRQQEDHHHLATTENNDNVKNRHEVPEMVPRQFIDLGPHSDEVSSEERTTVRSGSPPSLLEKSSSRQNGKRVLVREESPETESNGWRNPNKVPKHHASSSICGGNGSENASSKVIEQAAAEATMRKARVSVRARSEAPMLSDGCQWRKYGQKMAKGNPCPRAYYRCTMAVGCPVRKQVQRCAEDRTILITTYEGNHNHPLPPAAMNMASTTTAAASMLLSGSTMSNQDGLMNPTNLLARTILPCSSSMATISASAPFPTITLDLTESPNGNNPTNNPLMQFSQRSGLVELNQSVLPHMMGQALYYNQQSKFSGLHMPSQPLNAGESVSAATAAIASNPNFAAALAAAITSIINGSNNQQNGNNNNSNVTTSNVDNRQ

SEQ ID NO: 209 - DNA, 1614 bp, Arabidopsis thaliana
  AT4G22070.1
atgttccggtttccagtgagtctaggcggttcacgtgacgaagaccgtcacgatcagatcacaccgttggatgaccatcgtgtggtggttgatgaggttgacttcttctcagagaagagagatagggtttcacgtgagaacatcaacgacgacgacgacgaaggcaataaggttctcatcaaaatggagggttcacgagttgaagaaaacgatcgttccagagatgtcaatatcggtctgaatcttctgaccgcgaatacgggaagcgatgagtcaacggtggatgatggactatcaatggatatggaagataaacgtgcaaagattgagaacgcacaactacaagaagagctcaagaagatgaaaatagagaatcaaaggctaagagatatgttgagccaagcgacgaccaacttcaatgccttacaaatgcaacttgttgccgtcatgaggcaacaagaacaacgtaactcttcacaagatcatctcctggctcaggagagcaaagcagaaggaaggaaacggcaggaactgcaaatcatggtgccaaggcagttcatggaccttgggccgtcgtctggagcagcagagcatggagccgaagtgtcatctgaagagaggacaacggttcgttcaggttctcctccttcgcttctagaaagttccaatccccgagagaacggaaagaggttgcttggaagagaagaaagctcagaggaatcagagtctaacgcctggggaaaccctaacaaagtccccaaacataatccatcctctagcaatagcaatggaaacagaaacggaaatgttattgatcagtcggccgcagaagccaccatgcggaaagcccgtgtctcagttcgtgcccgatctgaagctgccatgataagcgatggatgtcaatggagaaagtacggacaaaaaatggctaaaggaaacccgtgtccgcgggcttattatcgttgcacaatggccggtggatgtccagttcgcaagcaagtgcagcgttgcgcagaagacagatctattctcataaccacctacgaaggaaaccacaaccatccactcccaccagccgctacggccatggcctcaacaaccaccgcagctgcaagcatgctcctctcgggctcaatgtcgagtcaagacggtttaatgaacccaacaaacctcctagctcgagctatcttgccttgctcctcaagcatggctacaatctcagcctccgcaccattcccaaccatcacattggacctcaccaattcacccaacggtaacaaccctaatatgaccactaataacccgttgatgcagttcgctcaacggcccggtttcaacccggcagttttgcctcaagtggttggtcaagctatgtacaataaccaacaacagtccaagttttctggtttacagttaccggctcagccactgcagatcgcggccacttcctcggtggccgagagcgttagtgctgccagtgcagcaattgcgtccgatccaaactttgcggcggctctagcggcagcgatcacgtccattatgaacggttccagtcatcaaaataataacaccaataataataatgtggctacgagcaacaatgacagtaggcaa

SEQ ID NO: 210 - protein, 538 aa, Arabidopsis thaliana
  AT4G22070.1
MFRFPVSLGGSRDEDRHDQITPLDDHRVVVDEVDFFSEKRDRVSRENINDDDDEGNKVLIKMEGSRVEENDRSRDVNIGLNLLTANTGSDESTVDDGLSMDMEDKRAKIENAQLQEELKKMKIENQRLRDMLSQATTNFNALQMQLVAVMRQQEQRNSSQDHLLAQESKAEGRKRQELQIMVPRQFMDLGPSSGAAEHGAEVSSEERTTVRSGSPPSLLESSNPRENGKRLLGREESSEESESNAWGNPNKVPKHNPSSSNSNGNRNGNVIDQSAAEATMRKARVSVRARSEAAMISDGCQWRKYGQKMAKGNPCPRAYYRCTMAGGCPVRKQVQRCAEDRSILITTYEGNHNHPLPPAATAMASTTTAAASMLLSGSMSSQDGLMNPTNLLARAILPCSSSMATISASAPFPTITLDLTNSPNGNNPNMTTNNPLMQFAQRPGFNPAVLPQVVGQAMYNNQQQSKFSGLQLPAQPLQIAATSSVAESVSAASAAIASDPNFAAALAAAITSIMNGSSHQNNNTNNNNVATSNNDSRQ

SEQ ID NO: 211 - DNA, 1899 bp, Brachypodium distachyon
  Bradi2g08620.1
atggctagaccgaccctaaaatgcttttgcctatccgcgacttcgcttcgacttggccatgttttgatgctagattctcgatccattccaatcccccgtttcccgttctctcttctctctagtggtgtcttctctgagggaggaggcgtttccatttgcatggacaagggccacctcgggggtggcggaggaggaggagggctggtcgctctggacgcgtcgccgcggcctctcgggttcctcaacttgctatcgccggcgccgtcgttccacaggagcatggaggcggacgacgttggcaccggcgccggtggcggcggcggcggcagggggcggaggtccgtcgaggtggacttcttctcggacgagaagaagaacatgaagaagagccgggtctcggccggcggcaccgatgcggaggggcacaaggacgccggcgccggactcgccatcaagaaggaggacctcaccattaacctccttccggggaggagcgaccggtcgatggtggtcgacgacgacgcggcgtcccggcccgacaacgacaagaacggcaggcaagacaccaacgagctcgcggcgatgcaggcggagctgggccgcatgaacgaggagaaccagcgcctgcgggggatgttgacccaggtcaccaacagctaccaagcgctgcagatgcatctcgtcgcgctcatgcagcaaaggacccagctacttccgacccaaccgcagcaacaacaaccgcctcccactcacgaggatggcaagatcgagggtgctatcgtgccaaggcaattccttgacctgggcccttccggcgccggcgcaggcagcgaggtggccgaggagccgtccaactcgtccacggaggtcggcagcccgcgccggtcgtcttccaacgggaacgaggaccctgagcgcagcgacaacccggaaggcccgtcaaccgcgggatggttgccgggacgggcaatgaaccagcagcaactgggagcggcggccaagggccacgaccagcaagcccaggaggccaccatgaggaaggcccgcgtctccgtgcgcgcgcgatccgaagccccaattatcgccgatggatgccagtggaggaagtacggccagaagatggccaagggaaacccttgtccacgcgcgtactaccgctgcaccatggccaccggctgcccggtgcgcaagcaggtccagcgatgcgccgaggaccggaccatcctgatcacgacgtacgagggcacccacaaccacccgctcccgccggccgccatggcgatggcgtccaccacgtcggccgccgcgtccatgctgctctcgggctccatgcccagcgccgacggcagcgcgggcctcatgagctccaacttcctcgcgcgcaccgtgctgccgtgctcctccagcatggccaccatctcggcgtccgcgccgttcccgacggtcacgctcgacctcacccacgctccgcccggcgcgcccaacgccatgccgctcagcgcgctgcggccgccggcgccggcccccgggcagttccaggtgccgttgcccggcgccggcggcgggatggccgggccgacattcgcgatgccgcagcagatgctgtacaaccagtccaagttctccggcttgcacatgtcgtcgtcttccgacaccgcggagttcgcgcagccgaggccgcagatgggccagctctccgacaccgtcagtgcggcggctgcggcgatcaccgctgacccaaacttcacggtggcgctggccgcggccatcacgtccatcattggcggccaacacgcggccgccgctgccggcaacaacaacggaagtaacaacaacgtcacgaccaccagcaacaacaccaccaccaccaccagcaacaacaccaacagcgagacccaa

SEQ ID NO: 212 - protein, 633 aa, Brachypodium distachyon
  Bradi2g08620.1
MARPTLKCFCLSATSLRLGHVLMLDSRSIPIPRFPFSLLSSGVFSEGGGVSICMDKGHLGGGGGGGGLVALDASPRPLGFLNLLSPAPSFHRSMEADDVGTGAGGGGGGRGRRSVEVDFFSDEKKNMKKSRVSAGGTDAEGHKDAGAGLAIKKEDLTINLLPGRSDRSMVVDDDAASRPDNDKNGRQDTNELAAMQAELGRMNEENQRLRGMLTQVTNSYQALQMHLVALMQQRTQLLPTQPQQQQPPPTHEDGKIEGAIVPRQFLDLGPSGAGAGSEVAEEPSNSSTEVGSPRRSSSNGNEDPERSDNPEGPSTAGWLPGRAMNQQQLGAAAKGHDQQAQEATMRKARVSVRARSEAPIIADGCQWRKYGQKMAKGNPCPRAYYRCTMATGCPVRKQVQRCAEDRTILITTYEGTHNHPLPPAAMAMASTTSAAASMLLSGSMPSADGSAGLMSSNFLARTVLPCSSSMATISASAPFPTVTLDLTHAPPGAPNAMPLSALRPPAPAPGQFQVPLPGAGGGMAGPTFAMPQQMLYNQSKFSGLHMSSSSDTAEFAQPRPQMGQLSDTVSAAAAAITADPNFTVALAAAITSIIGGQHAAAAAGNNNGSNNNVTTTSNNTTTTTSNNTNSETQ

SEQ ID NO: 213 - DNA, 810 bp, Triticum aestivum
  misc_feature (727)..(727): n is a, c, g, or t
  ACD69419.1
tcggccggggccgacgcggaggaccacaaggatcaagcctccgccgccggactcgccatcaagaaggaggacctcaccattaacctccttcccgggaacaacacgaggagcgaccggtccatggtggtcgacgacgacggagcgtcccgggccgaccaagacaggaacggcaggaacaccggcgagctggcggtgatacaggccgagctgagccgcatgaacgaggagaaccagcggctgcgagggatgttgacccaggtcaacaacagctaccatgcgctgcagatgcatctcgtcgcgctaatgcagcaaaggacccagatgcctccggtccagccgcaacaacctccgacccacgaggatggcaagaacgagagtgccatcgtgccgaggcagttcctgggtctgggcccgtcgggagccagcgctgacgtggcggaagagccgtccaactcgtccacggaggtcgggagcccgcgccggtcgtcgtccaacgggaacgaggaccctgagcgcggcgacaaccctgacggcccgtccaccgcggggtggttgcccgggcgcgggatgacccagcagcagcagcagctgggagcggcggcaaagggccacgaccagcaagcgcaggaggccaccatgaggaaggcccgtgtctccgttcgcgcacgttccgaagccccgattatcgccgatggatgccaatggaggaagtacggtcagaagatgnccaagggaaacccttgcccacgcgcatactaccgctgcaccatggccaccggctgcccggtgcgcaagcaggtgcaacgatgc

SEQ ID NO: 214 - protein, 271 aa, Triticum aestivum
  misc_feature (243)..(243): Xaa can be any naturally occurring amino acid
  ACD69419.1
SAGADAEDHKDQASAAGLAIKKEDLTINLLPGNNTRSDRSMVVDDDGASRADQDRNGRNTGELAVIQAELSRMNEENQRLRGMLTQVNNSYHALQMHLVALMQQRTQMPPVQPQQPPTHEDGKNESAIVPRQFLGLGPSGASADVAEEPSNSSTEVGSPRRSSSNGNEDPERGDNPDGPSTAGWLPGRGMTQQQQQLGAAAKGHDQQAQEATMRKARVSVRARSEAPIIADGCQWRKYGQKMXKGNPCPRAYYRCTMATGCPVRKQVQRCA

SEQ ID NO: 215 - DNA, 1749 bp, Oryza sativa
  LOC_Os01g14440.1
atggaggccgacgacagcggcggtggcggcggcagggcacgcaggtccgtcgaggtggacttcttctccgacgagaagaagaacatgaagaagagccgtgtctcgggcggcgtcgccgccgaggcggacgacgccaagggacccgccgccgccggcctcgccatcaagaaggaggacctcaccattaacgttagccgccgccgccttcttcgctcgtcgatcgccagacacctgtttaactcacggcgatctaacgcgtgtgctcgtccgtgttcgttgcagcttcttcccgccgggaacaacgcgaggagcgaccggtcgatggtggtcgacgacgacgcggcgtcgcggccggatcacgaggagaagagccggagcagcaacgagctcgcggcgatgcaggcggagctgggccgcatgaacgaggagaaccagcggctccgggggatgctgacccaggtgaccaccagctaccaggcgctgcagatgcatctcgtcgcgctcatgcagcaaaggcctcaaatgatgcagcctccgacccagccggagccacctccgcctcaccaggatggcaaggccgagggcgcggtcgtgccgaggcaattcctcgatctgggcccgtcctccggcgccggcggcgaggcggcggaggagccgtccaactcgtcgacggaggccggcagcccgcgtcggtcgtcgtctaccggcaacaaggaccaagaacgtggtgacagcccggacgcgccgtcgacggcggcggcgtggttgccgggacgcgccatggcgccgcagatgggcgccgccggcgcggcgggcaagagccatgatcagcaagcccaggatgccaacatgaggaaggcccgcgtctccgttcgcgcgcgatccgaagcgccaatcatcgccgatgggtgccaatggaggaagtacggtcagaagatggcgaagggaaacccttgtccacgcgcgtactaccgctgcaccatggccaccggctgcccggtgcggaagcaggtgcaacggtgcgcggaggaccggtccatcctgatcaccacgtacgagggcacgcacaaccacccgctgccgccggccgcgatggcgatggcgtccaccacgtcggcggcggcgtcgatgcttctgtcggggtccatgccgagcgccgacggcgccgcggggctcatgagctccaacttcctggcgcgcaccgtgctgccgtgctcgtccagcatggccaccatctcggcgtcggccccgttcccgacggtcacgctcgacctcacccacgcgccgccgggcgcgccgaacgccgtgccgctcaacgccgcgcggccgggcgcgccggcgccgcagttccaggtgccgctgccaggcggagggatggcgccggcgttcgccgtgccgccgcaggtgctgtacaaccagtccaagttctccggcctgcagatgtcctccgattcagccgaggccgccgccgccgccgccgccgccgcgcagttcgcgcaaccgaggccgccgatcgggcagctgcctggccctctctccgacaccgtcagcgcggcggcggcggcgatcaccgctgaccccaacttcacggtggcgctcgcggcggcgatcacgtccatcataggcggccagcacgcggcggcagctggcaacagcaacgcgaacaacaccaacaccaacaccacgagcaacaccaacaacacaagcagcaacaacacgacgagcaacaacaccaacagcgagacgcag

SEQ ID NO: 216 - protein, 583 aa, Oryza sativa
  LOC_Os01g14440.1
MEADDSGGGGGRARRSVEVDFFSDEKKNMKKSRVSGGVAAEADDAKGPAAAGLAIKKEDLTINVSRRRLLRSSIARHLFNSRRSNACARPCSLQLLPAGNNARSDRSMVVDDDAASRPDHEEKSRSSNELAAMQAELGRMNEENQRLRGMLTQVTTSYQALQMHLVALMQQRPQMMQPPTQPEPPPPHQDGKAEGAVVPRQFLDLGPSSGAGGEAAEEPSNSSTEAGSPRRSSSTGNKDQERGDSPDAPSTAAAWLPGRAMAPQMGAAGAAGKSHDQQAQDANMRKARVSVRARSEAPIIADGCQWRKYGQKMAKGNPCPRAYYRCTMATGCPVRKQVQRCAEDRSILITTYEGTHNHPLPPAAMAMASTTSAAASMLLSGSMPSADGAAGLMSSNFLARTVLPCSSSMATISASAPFPTVTLDLTHAPPGAPNAVPLNAARPGAPAPQFQVPLPGGGMAPAFAVPPQVLYNQSKFSGLQMSSDSAEAAAAAAAAAQFAQPRPPIGQLPGPLSDTVSAAAAAITADPNFTVALAAAITSIIGGQHAAAAGNSNANNTNTNTTSNTNNTSSNNTTSNNTNSETQ

SEQ ID NO: 217 - DNA, 855 bp, Zea mays
  GRMZM5G871347_T01
atgcaatcagagcttgcgcgcatgaacgacgagaaccagcggctgcgcgggatgctcacccaggtcaccaccagctaccaggcgctccagatgcatctcgtggcgctcatgcaggcgcgggccgacggccagccgatgatgcctcctgcagtggcccagacactgccggtgaccgacgccgctgctgtcatgccatcgccgagacagttcctcggcctaggaccagcggcggctgccgaggagacgtcaaactcgtccacggaggtgggcagcccgcggccgtcgtcgtccgcaggcaggcggcaggaccaacagcaacaggcggcggagcgcggcgacagcccggacccggcggatccgtcgacaacagcaaggcagctagcgcagcagcaggaggccagcatgaggaaggcgcgcgtctcggtgcgcgcgcgatccgaagctcccatcatcgccgacggctgccagtggcgcaagtacgggcagaagatggccaagggcaacccatgcccgcgagcctactaccggtgcaccatggccaacggctgccccgtgcggaagcaggttcagcgctgcgccgacgaccgctccatcctcatcactacctacgagggcacccacaaccacccgctcccgcccgccgccgtggccatggcctccaccacctccgccgccgcctccatgctgctgtccggctccatgcccagcggggacaacttcctggcgcgggccgtgctgccgtgctcctccggcatggccaccatctccgcctccgcgccattccccaccgtcacgctcgacctcaccaacgggcccgcccggtgctcctcctcccgcgcgaccgccgccgcacct

SEQ ID NO: 218 - protein, 286 aa, Zea mays
  GRMZM5G871347_T01
MQSELARMNDENQRLRGMLTQVTTSYQALQMHLVALMQARADGQPMMPPAVAQTLPVTDAAAVMPSPRQFLGLGPAAAAEETSNSSTEVGSPRPSSSAGRRQDQQQQAAERGDSPDPADPSTTARQLAQQQEASMRKARVSVRARSEAPIIADGCQWRKYGQKMAKGNPCPRAYYRCTMANGCPVRKQVQRCADDRSILITTYEGTHNHPLPPAAVAMASTTSAAASMLLSGSMPSGDNFLARAVLPCSSGMATISASAPFPTVTLDLTNGPARCSSSRATAAAPA

SEQ ID NO: 219 - DNA, 1227 bp, Zea mays
  GRMZM5G871347_T02
atggacaaggcccacctcggaggaggcctgttagctctcgacgcgtcgccgcggcctctcggcttcctcaacctgctatcgccgccgacgtcgtccccgccgtttcacaggacaagaacgatggaggccgacgacgtccccgccgttccaggcaacaagggccgtaggtccatcgaggtggacttcttctccgacgacaaggacaagaagagcgctgccgctgcagctaacgacaagaaggaagacctgacgaccattaaccttcttcccggcagcaacgccaacgacgacgacgacgacgaggcggcgacccggctccggctgccgaacgaccaagacaggcagaacaggaacaccaacgagctttcggccatgcaatcagagcttgcgcgcatgaacgacgagaaccagcggctgcgcgggatgctcacccaggtcaccaccagctaccaggcgctccagatgcatctcgtggcgctcatgcaggcgcgggccgacggccagccgatgatgcctcctgcagtggcccagacactgccggtgaccgacgccgctgctgtcatgccatcgccgagacagttcctcggcctaggaccagcggcggctgccgaggagacgtcaaactcgtccacggaggtgggcagcccgcggccgtcgtcgtccgcaggcaggcggcaggaccaacagcaacaggcggcggagcgcggcgacagcccggacccggcggatccgtcgacaacagcaaggcagctagcgcagcagcaggaggccagcatgaggaaggcgcgcgtctcggtgcgcgcgcgatccgaagctcccatcatcgccgacggctgccagtggcgcaagtacgggcagaagatggccaagggcaacccatgcccgcgagcctactaccggtgcaccatggccaacggctgccccgtgcggaagcaggttcagcgctgcgccgacgaccgctccatcctcatcactacctacgagggcacccacaaccacccgctcccgcccgccgccgtggccatggcctccaccacctccgccgccgcctccatgctgctgtccggctccatgcccagcggggacaacttcctggcgcgggccgtgctgccgtgctcctccggcatggccaccatctccgcctccgcgccattccccaccgtcacgctcgacctcaccaacgggcccgcccggtgctcctcctcccgcgcgaccgccgccgcacct

SEQ ID NO: 220 - protein, 410 aa, Zea mays
  GRMZM5G871347_T02
MDKAHLGGGLLALDASPRPLGFLNLLSPPTSSPPFHRTRTMEADDVPAVPGNKGRRSIEVDFFSDDKDKKSAAAAANDKKEDLTTINLLPGSNANDDDDDEAATRLRLPNDQDRQNRNTNELSAMQSELARMNDENQRLRGMLTQVTTSYQALQMHLVALMQARADGQPMMPPAVAQTLPVTDAAAVMPSPRQFLGLGPAAAAEETSNSSTEVGSPRPSSSAGRRQDQQQQAAERGDSPDPADPSTTARQLAQQQEASMRKARVSVRARSEAPIIADGCQWRKYGQKMAKGNPCPRAYYRCTMANGCPVRKQVQRCADDRSILITTYEGTHNHPLPPAAVAMASTTSAAASMLLSGSMPSGDNFLARAVLPCSSGMATISASAPFPTVTLDLTNGPARCSSSRATAAAPA

SEQ ID NO: 221 - DNA, 1356 bp, Zea mays
  GRMZM5G871347_T03
atggacaaggcccacctcggaggaggcctgttagctctcgacgcgtcgccgcggcctctcggcttcctcaacctgctatcgccgccgacgtcgtccccgccgtttcacaggacaagaacgatggaggccgacgacgtccccgccgttccaggcaacaagggccgtaggtccatcgaggtggacttcttctccgacgacaaggacaagaagagcgctgccgctgcagctaacgacaagaaggaagacctgacgaccattaaccttcttcccggcagcaacgccaacgacgacgacgacgacgaggcggcgacccggctccggctgccgaacgaccaagacaggcagaacaggaacaccaacgagctttcggccatgcaatcagagcttgcgcgcatgaacgacgagaaccagcggctgcgcgggatgctcacccaggtcaccaccagctaccaggcgctccagatgcatctcgtggcgctcatgcaggcgcgggccgacggccagccgatgatgcctcctgcagtggcccagacactgccggtgaccgacgccgctgctgtcatgccatcgccgagacagttcctcggcctaggaccagcggcggctgccgaggagacgtcaaactcgtccacggaggtgggcagcccgcggccgtcgtcgtccgcaggcaggcggcaggaccaacagcaacaggcggcggagcgcggcgacagcccggacccggcggatccgtcgacaacagcaaggcagctagcgcagcagcaggaggccagcatgaggaaggcgcgcgtctcggtgcgcgcgcgatccgaagctcccatcgtaaggaggagtttttgtttttcctttctctttctttctttctttctttctttcttctatctttctttattttttcctttctttctttctttctttctttcttctcatatggaagatgatcgtgggcagatcgccgacggctgccagtggcgcaagtacgggcagaagatggccaagggcaacccatgcccgcgagcctactaccggtgcaccatggccaacggctgccccgtgcggaagcaggttcagcgctgcgccgacgaccgctccatcctcatcactacctacgagggcacccacaaccacccgctcccgcccgccgccgtggccatggcctccaccacctccgccgccgcctccatgctgctgtccggctccatgcccagcggggacaacttcctggcgcgggccgtgctgccgtgctcctccggcatggccaccatctccgcctccgcgccattccccaccgtcacgctcgacctcaccaacgggcccgcccggtgctcctcctcccgcgcgaccgccgccgcacct

SEQ ID NO: 222 - protein, 453 aa, Zea mays
  GRMZM5G871347_T03
MDKAHLGGGLLALDASPRPLGFLNLLSPPTSSPPFHRTRTMEADDVPAVPGNKGRRSIEVDFFSDDKDKKSAAAAANDKKEDLTTINLLPGSNANDDDDDEAATRLRLPNDQDRQNRNTNELSAMQSELARMNDENQRLRGMLTQVTTSYQALQMHLVALMQARADGQPMMPPAVAQTLPVTDAAAVMPSPRQFLGLGPAAAAEETSNSSTEVGSPRPSSSAGRRQDQQQQAAERGDSPDPADPSTTARQLAQQQEASMRKARVSVRARSEAPIVRRSFCFSFLFLSFFLSFFYLSLFFPFFLSFFLSSHMEDDRGQIADGCQWRKYGQKMAKGNPCPRAYYRCTMANGCPVRKQVQRCADDRSILITTYEGTHNHPLPPAAVAMASTTSAAASMLLSGSMPSGDNFLARAVLPCSSGMATISASAPFPTVTLDLTNGPARCSSSRATAAAPA

SEQ ID NO: 223 - DNA, 1686 bp, Brachypodium distachyon
  Bradi2g16150.1
atggagtcgcggccgtcgtcgggcttcgtcgcgggcgtgaagcgcggcagcgtcggcgagatggacttcttcgagacggagatgcgcaaggagaagcgcgacaggaaggagcttgccggcgccggggacgacgacggtctcggcatcaagaatggggacgacctcacaatcgacatggggctgcacgtggggaggaggacgacggtgaggaggaacagcggcagcgaggagtccaccgtcgacgacggcggcgtctcctccaacgacgaacttgatcatcatcactacatggaggccaaagccgagttggcagcgacgaaatcggagcttgcgcgggtgagagaggagaacaagcgactgaagagcatgctgagcagcgccaacagcaagtgcaactccctccacatgcacctcacccacctccagcagcagcagcagaggtccagcagcagccatggcggccacagggttcacgagctactcgacccggacaagcaccaccacctggatcagctgccgctgccgacgaccacggcccttaacatgccgcggcagttcatcagcctcggctccgcgcccgacgagccaccgccgctgccagccagggccagcaatggcagcctcgactgtgcgccgtcgtccagcaatccagtcggagttgatggcatggtcatcggcagcaaggcggccgatctcgtgcccgtgccgccggctttcgattaccaccaccaccacggcggcggcggccatgacagcagggcagccgccggcgcaggtgggagcagcgacccggagcagcagagctgctggctccccggcggcaaggtccccaaattcctcccccctggaatcaagggcgtccccgagcccgcggcgccaacggtgcagcagcagccgcccgaggctgccgccgccgccaccatgcgcaaggcccgcgtctcagtccgtgctcgctccgaagccgccatgatcagcgatgggtgccaatggaggaagtacgggcagaagatggcgaaggggaacccgtgcccgcgggcatactaccggtgcacgatggcggcggggtgcccggtgcggaagcaggtgcagaggtgcgccgaagacaggacggtgctcatcacgacgtacgaagggaaccacaaccacccgctgccccccgccgccatggctatggctaccaccacggccgctgccgccaccatgctgctctccggatccatgcccagcgccgacgccgccggggggatcatggcagggtccaacttcatggcacgcgccgtgctgccctgctcgccctccagcgtcgccaccatctccgcctctgcgccattccccaccgtcacgctcgacctcacggcgcctccaccgctcaaggaggcgctggcggaggcggcggcgaggccagtggtgctgccacagctgttcgggcagaagctctacgatcaggcaaagctctccgccgtacaggccgtggccggcaccaatggcaaggcaacggtggatggcggcggcgcgcagctcgctgacacggtgagtgcagcctcggccgtgatcgcgtccgacccacagttcaccagggtgctcgcggccgccatcacgtcctacatcggcaacagcagcgggagcaccggcacggcgcagcccatggcgagcggaggcggtgatagctgtagtagagacgacgag

SEQ ID NO: 224 - protein, 562 aa, Brachypodium distachyon
  Bradi2g16150.1
MESRPSSGFVAGVKRGSVGEMDFFETEMRKEKRDRKELAGAGDDDGLGIKNGDDLTIDMGLHVGRRTTVRRNSGSEESTVDDGGVSSNDELDHHHYMEAKAELAATKSELARVREENKRLKSMLSSANSKCNSLHMHLTHLQQQQQRSSSSHGGHRVHELLDPDKHHHLDQLPLPTTTALNMPRQFISLGSAPDEPPPLPARASNGSLDCAPSSSNPVGVDGMVIGSKAADLVPVPPAFDYHHHHGGGGHDSRAAAGAGGSSDPEQQSCWLPGGKVPKFLPPGIKGVPEPAAPTVQQQPPEAAAAATMRKARVSVRARSEAAMISDGCQWRKYGQKMAKGNPCPRAYYRCTMAAGCPVRKQVQRCAEDRTVLITTYEGNHNHPLPPAAMAMATTTAAAATMLLSGSMPSADAAGGIMAGSNFMARAVLPCSPSSVATISASAPFPTVTLDLTAPPPLKEALAEAAARPVVLPQLFGQKLYDQAKLSAVQAVAGTNGKATVDGGGAQLADTVSAASAVIASDPQFTRVLAAAITSYIGNSSGSTGTAQPMASGGGDSCSRDDE

SEQ ID NO: 225 - DNA, 1875 bp, Oryza sativa
  LOC_Os05g49210.1
atggagtcctacgtgggtgtcaaggggaagaatgtcgtcgggggcggcgacgtcggcagggagatgccggtggcgccaccgtcgtcgtcgtcggcggcggtagggatggtggagttcccggcggcggcggcggggctggggtacgccgggatgacggcgaaggaggccgggggtggttaccaggagaggagggtggtggtcggcgagatggacttcttcaagacggcggagaagcgtggggagaggaaggagccgccgccggcgacggcgacggcggcggcgagtggacacgccggtgcctcgccggatgacctcagcctcaacaaggacgacctcaccatcaatatgggattgctcgtcggccggaggaggaacagcggcagcgaggaatccatcgtcgacgatggcggcgtctcctccaacgacgaggagcaccgcgaggccaaagctgcgctggcagtaaccaaagctgagattgggcggctgagtgaggagaacaagaggctcaagaacatgctgagcaacgtgaccacgaaatacaactctctccagatgcagttcgtcacactgatgcagcagaggagatcagtcctagccgctccgatccaccagcaagagctgcttgatccggagaagaaggagcaagaggggagccagcagcagcagcagcagctgatcccgaggcagttcatcagcctcggctccgcgtcgctgcagcccgacgtcgaggcgccgcactccgtcgtcgtcgtcggcggcgatgtctgcgcgccgtcgtcgagcaaccccgacgcggcggtgccggcgatgatgccgttgccgcatttcgaccaccacaaccaccaccaccccatccatggtggaagggagagggggagcagcccggcggaggccgaccaccaccgccaccatcagcaagagcagccgccgccgccgccgcagcagcagcagcagttgccgccgagctggcttcccgccgacaaggtgcccaggttcctccccggcaaggggcccgagcccgtcccggaggccgccaccatgcgcaaggcccgcgtctccgttcgagctcgctccgatgcacccatgatcagcgatgggtgccaatggaggaagtacgggcagaagatggcgaagggaaacccttgcccgcgcgcgtactaccggtgcaccatggccgccggctgcccggtgcggaagcaggtccagaggtgcgcggaggacaggacggtgctgataacgacgtacgaggggaaccacaaccacccgctgccgccggcggcgatggcgatggcgtcgaccacggcggcggcggcgtccatgctgctgtcgggctccatgccgagcgcggacggcagcctcatggccgggtccaacttcctggcgcgcgccgtgctgccgtgctcgtccaccgtcgccaccatctcggcgtcggcgccgttcccgacggtcacgctcgacctcacgcagacggcgccgccgccgccgccggcgtcgtcgacgcagccgcagccgccgcgcccggagcccgcgcagctccaggcggcgctcgccgaggccgcgcggccggtggcgctgccccagctgttcgggcagaagctctacgaccagtccaagctctccgccgtgcaggccgtggccggcaccaagggctccgacggcggcgcgctcgccgacacggtgaacgccgcgacggccgcgatcgcgtcggacccaaacttcaccgccgtgctcgccgccgcgctgacgtcgtacataggcagtagaagcggcagcggcggcgccggcgccggcgggagcagcggcacggtgcagccgctgatgagcggcggcggcgatagctgtagtagagacgacaagataggagagcaaaacagc

SEQ ID NO: 226 - protein, 625 aa, Oryza sativa
  LOC_Os05g49210.1
MESYVGVKGKNVVGGGDVGREMPVAPPSSSSAAVGMVEFPAAAAGLGYAGMTAKEAGGGYQERRVVVGEMDFFKTAEKRGERKEPPPATATAAASGHAGASPDDLSLNKDDLTINMGLLVGRRRNSGSEESIVDDGGVSSNDEEHREAKAALAVTKAEIGRLSEENKRLKNMLSNVTTKYNSLQMQFVTLMQQRRSVLAAPIHQQELLDPEKKEQEGSQQQQQQLIPRQFISLGSASLQPDVEAPHSVVVVGGDVCAPSSSNPDAAVPAMMPLPHFDHHNHHHPIHGGRERGSSPAEADHHRHHQQEQPPPPPQQQQQLPPSWLPADKVPRFLPGKGPEPVPEAATMRKARVSVRARSDAPMISDGCQWRKYGQKMAKGNPCPRAYYRCTMAAGCPVRKQVQRCAEDRTVLITTYEGNHNHPLPPAAMAMASTTAAAASMLLSGSMPSADGSLMAGSNFLARAVLPCSSTVATISASAPFPTVTLDLTQTAPPPPPASSTQPQPPRPEPAQLQAALAEAARPVALPQLFGQKLYDQSKLSAVQAVAGTKGSDGGALADTVNAATAAIASDPNFTAVLAAALTSYIGSRSGSGGAGAGGSSGTVQPLMSGGGDSCSRDDKIGEQNS

SEQ ID NO: 227 - DNA, 1677 bp, Zea mays
  GRMZM2G366795_T01
atggagtcctcctgcctgggaaagcgcaggctgaacggcgccgagagggcgccgcccgcgttcctcccgctggggtacgagtacggcgacgcggacgcggtggaccacatgccccatcgcttggagacgggcgagatggacttcttcaagagagagaagagggagaggaaagctgacgccgccgccccggacgacctcggcatcaaggaagaagacatcaccatcaacatgggtctgcaccacgtcggcagatggaagaacaggagcgaagagtccgtcgacgagggcgtctcctccaacgacggggatacgagggagatgaaaactgagctggcactgacaaaatccgagcttggacgcctgaacgaagagaacaagcagctcaagaacattctcaccaggctgaccagcagcaactccaaccccctccagatgcagatgcaggccctcacaacgatgcaacagctaaggaacaatatcatccatcgaggtcttcgcggagctccaagccatgagctgaacgtcgatccggagaagaagaaggaccaggaggggagccgcggcggcggccacctgctcccgcagcagttcatcgggctcagcacccccgcgttgtcgttcgacgacccgctgcgcttcgtggcctcagacgtgcaaggcggcgagagctcagcgtccaccagcaacgtggagccgccgccgacgacgacgaccatggaaatgatgccgctgcccgcgttcgagcacggccaccaccagcacctcgcccatgagaggggtagcagtagcagcccggacgagccaccgtcacaccacctggcggtgaatcagggttggctctcgaacaaggtggccaagttccttcccgtcaagggccccgagcccgccaccatgcggaaggcccgcgtctccgtccgagcccgctccgagatcagtgatgggtgtcaatggaggaaatacgggcagaagatggccaagggcaatccgtgcccccgctcgtactaccgctgcaccatggccgccggctgcccggtccgcaagcaggtccagagatgcgcggaggacacgacggtggtggtcacgacgtacgaggggaaccacaaccacccgctgccgccggcggcgatgccgatggcttcgacgacgacgacggcgtcgtccatgctgctgtccgggtcgatgccgagcgcggagggcagcagcctgatggcggggtccaacttcctggcgcgcgccgtgctgccgtgctcctccagcgtcgccaccatctcggcgtcggcgccgttccccaccgtggcgctggacctcacgcagccgctgccgccgcaggcgcaggcgcggagcacgacggagccttcccagctccaggccgcgctcgccgacgccgcgggccgaccgacgccgcagctgttcgggcagaagctgtacgacccttcctcctccaaggcccccgccgcctcgcagggagcggacgcggcgggcgacaccgtcagcgcggcggccgtgatcgcgtccgaccccaacttccctgcagtgctcgcggcggcgatcaagtcgtacataagcgggaacggcagcggcggtgggaacagtggcacgaccgtgctgccgccgccgccggcggcgagcagcgccgacgatagcagcagagatgacaaggccggggagcaggggggc

SEQ ID NO: 228 - protein, 559 aa, Zea mays
  GRMZM2G366795_T01
MESSCLGKRRLNGAERAPPAFLPLGYEYGDADAVDHMPHRLETGEMDFFKREKRERKADAAAPDDLGIKEEDITINMGLHHVGRWKNRSEESVDEGVSSNDGDTREMKTELALTKSELGRLNEENKQLKNILTRLTSSNSNPLQMQMQALTTMQQLRNNIIHRGLRGAPSHELNVDPEKKKDQEGSRGGGHLLPQQFIGLSTPALSFDDPLRFVASDVQGGESSASTSNVEPPPTTTTMEMMPLPAFEHGHHQHLAHERGSSSSPDEPPSHHLAVNQGWLSNKVAKFLPVKGPEPATMRKARVSVRARSEISDGCQWRKYGQKMAKGNPCPRSYYRCTMAAGCPVRKQVQRCAEDTTVVVTTYEGNHNHPLPPAAMPMASTTTTASSMLLSGSMPSAEGSSLMAGSNFLARAVLPCSSSVATISASAPFPTVALDLTQPLPPQAQARSTTEPSQLQAALADAAGRPTPQLFGQKLYDPSSSKAPAASQGADAAGDTVSAAAVIASDPNFPAVLAAAIKSYISGNGSGGGNSGTTVLPPPPAASSADDSSRDDKAGEQGG

SEQ ID NO: 229 - DNA, 1671 bp, Zea mays
  GRMZM2G366795_T02
atggagtcctcctgcctgggaaagcgcaggctgaacggcgccgagagggcgccgcccgcgttcctcccgctggggtacgagtacggcgacgcggacgcggtggaccacatgccccatcgcttggagacgggcgagatggacttcttcaagagagagaagagggagaggaaagctgacgccgccgccccggacgacctcggcatcaaggaagaagacatcaccatcaacatgggtctgcaccacgtcggcagatggaagaacaggagcgaagagtccgtcgacgagggcgtctcctccaacgacggggatacgagggagatgaaaactgagctggcactgacaaaatccgagcttggacgcctgaacgaagagaacaagcagctcaagaacattctcaccaggctgaccagcagcaactccaaccccctccagatgcagatgcaggccctcacaacgatgcaacagaggacgtcgatcacatcatgttcatgtcatcgccagctgaacgtcgatccggagaagaagaaggaccaggaggggagccgcggcggcggccacctgctcccgcagcagttcatcgggctcagcacccccgcgttgtcgttcgacgacccgctgcgcttcgtggcctcagacgtgcaaggcggcgagagctcagcgtccaccagcaacgtggagccgccgccgacgacgacgaccatggaaatgatgccgctgcccgcgttcgagcacggccaccaccagcacctcgcccatgagaggggtagcagtagcagcccggacgagccaccgtcacaccacctggcggtgaatcagggttggctctcgaacaaggtggccaagttccttcccgtcaagggccccgagcccgccaccatgcggaaggcccgcgtctccgtccgagcccgctccgaggtactcatgatcagtgatgggtgtcaatggaggaaatacgggcagaagatggccaagggcaatccgtgcccccgctcgtactaccgctgcaccatggccgccggctgcccggtccgcaagcaggtccagagatgcgcggaggacacgacggtggtggtcacgacgtacgaggggaaccacaaccacccgctgccgccggcggcgatgccgatggcttcgacgacgacgacggcgtcgtccatgctgctgtccgggtcgatgccgagcgcggagggcagcagcctgatggcggggtccaacttcctggcgcgcgccgtgctgccgtgctcctccagcgtcgccaccatctcggcgtcggcgccgttccccaccgtggcgctggacctcacgcagccgctgccgccgcaggcgcaggcgcggagcacgacggagccttcccagctccaggccgcgctcgccgacgccgcgggccgaccgacgccgcagctgttcgggcagaagctgtacgacccttcctcctccaaggcccccgccgcctcgcagggagcggacgcggcgggcgacaccgtcagcgcggcggccgtgatcgcgtccgaccccaacttccctgcagtgctcgcggcggcgatcaagtcgtacataagcgggaacggcagcggcggtgggaacagtggcacgaccgtgctgccgccgccgccggcggcgagcagcgccgacgatagcagcagagatgacaaggccggggagcaggggggc

SEQ ID NO: 230 - protein, 557 aa, Zea mays
  GRMZM2G366795_T02
MESSCLGKRRLNGAERAPPAFLPLGYEYGDADAVDHMPHRLETGEMDFFKREKRERKADAAAPDDLGIKEEDITINMGLHHVGRWKNRSEESVDEGVSSNDGDTREMKTELALTKSELGRLNEENKQLKNILTRLTSSNSNPLQMQMQALTTMQQRTSITSCSCHRQLNVDPEKKKDQEGSRGGGHLLPQQFIGLSTPALSFDDPLRFVASDVQGGESSASTSNVEPPPTTTTMEMMPLPAFEHGHHQHLAHERGSSSSPDEPPSHHLAVNQGWLSNKVAKFLPVKGPEPATMRKARVSVRARSEVLMISDGCQWRKYGQKMAKGNPCPRSYYRCTMAAGCPVRKQVQRCAEDTTVVVTTYEGNHNHPLPPAAMPMASTTTTASSMLLSGSMPSAEGSSLMAGSNFLARAVLPCSSSVATISASAPFPTVALDLTQPLPPQAQARSTTEPSQLQAALADAAGRPTPQLFGQKLYDPSSSKAPAASQGADAAGDTVSAAAVIASDPNFPAVLAAAIKSYISGNGSGGGNSGTTVLPPPPAASSADDSSRDDKAGEQGG

SEQ ID NO: 231 - DNA, 1830 bp, Zea mays
  GRMZM2G448605_T01
atggactcctcctacctgggaaagcgcaagctggacggcggcgagagggagccgcccgcggctgcgttcctcccggccgtcgcgctcgggtacgagtacgagtacggcgacgcggaggcggtggaccaccggccctgtcgcgcggcggcgggcgagatggacttcttcaagaaggaggagaagagggagaggaaggctgccgccgccctggtgccgtcggacgaccttggcatcaaggaagatgaagtcacaatcaacatgggtctgcaccacgtcgacaggaggaagagcagtagcgaggagtccatcgtcatcgacgacggcgtatcctccaacgatgtcgatcacagggaggccaaagctgagctggcactagcaaaatccgagcttggacgcctgaacaacgagaacaagcagctcaacgaagagaacaagcagctcaacgaagagaacaagcagctgaggagtatgctcagcaggctgaccaccagcttcaaccccatccagaagccgtcgatgcagatgcagttactctcactgatgcagcagcaagcgacccgtacccatcgaggccttcgtggagctccaggccatgagccgatgtacgccgatccggagaagaaggacgaccagaaggcgagccgcggtggcgcccacacgctcccgcagcagttcatcagcgtcggcaccgcgcccgacgacctcctgcgctccgtgggctcgcacgcactgcgcggcgacgactgctcggcgtcgaccagcaacgcggagccgcctccaccgcccatggactactgctctgctggctatggcaaagggctcatggccagtggtaaggacatgatgccgctgccggcgttcgagctcggcaaccagcagcacctcgctcacgagaggggcagcagcccggatgagccgccgccgcaccacttggcggcgcagcagggctggctctccaacaaggcacccaagttcctccccggcaagggcctcgagcctgtcgtccccgaggccgccaccatgcgcaaggcccgcgtctccgtccgaacccgctccgaggcagccatgatcagtgacgggtgccaatggaggaagtacgggcagaagatggccaagggcaacccgtacccccgcgcgtactaccgctgcaccatggccgccgcctgcccggtccgcaagcaggtccagagatgcgccgaggacacgacggtggtggtcacgacgtacgaggggaaccacaaccacccgctgccgccggcggcgatgccgatggcgtcgacgacggcggcggcggcggccatgctgctgtccgggccgatgccgagcgcggacggaggcagcctgatggcggggtccaacttcctggcgcgcgcagtgctgccgtgctcctccaacgtcgccaccatctcggcgtcggcgccattccccactgtgacgctggacctcacgcagccgcagccgccgcctgcggcacggacgatgggaacggagccctcactgcagccccaggccgcgctcaccgacgatgcgggccggccggtttcgctggcgacgcagctgttcgggcagaaggtgttcggcccctcctccaatacccccgccgccgcgcagccgcagccgcaggcggacgcggcgggcgacaccgtcagtgcggcggccgtgatcgcgtccgacccgaacttccccgcggtgctcgctgcggctatcaagtcgtacataggcggcagcggcggtgccggcgtgatcagcgggacgatcgtgctgccgcctgcgccgtcgagcagcgccggcgatagcaccagagaggacagggtgggcgagcaggggaga

SEQ ID NO: 232 - protein, 610 aa, Zea mays
  GRMZM2G448605_T01
MDSSYLGKRKLDGGEREPPAAAFLPAVALGYEYEYGDAEAVDHRPCRAAAGEMDFFKKEEKRERKAAAALVPSDDLGIKEDEVTINMGLHHVDRRKSSSEESIVIDDGVSSNDVDHREAKAELALAKSELGRLNNENKQLNEENKQLNEENKQLRSMLSRLTTSFNPIQKPSMQMQLLSLMQQQATRTHRGLRGAPGHEPMYADPEKKDDQKASRGGAHTLPQQFISVGTAPDDLLRSVGSHALRGDDCSASTSNAEPPPPPMDYCSAGYGKGLMASGKDMMPLPAFELGNQQHLAHERGSSPDEPPPHHLAAQQGWLSNKAPKFLPGKGLEPVVPEAATMRKARVSVRTRSEAAMISDGCQWRKYGQKMAKGNPYPRAYYRCTMAAACPVRKQVQRCAEDTTVVVTTYEGNHNHPLPPAAMPMASTTAAAAAMLLSGPMPSADGGSLMAGSNFLARAVLPCSSNVATISASAPFPTVTLDLTQPQPPPAARTMGTEPSLQPQAALTDDAGRPVSLATQLFGQKVFGPSSNTPAAAQPQPQADAAGDTVSAAAVIASDPNFPAVLAAAIKSYIGGSGGAGVISGTIVLPPAPSSSAGDSTREDRVGEQGR

SEQ ID NO: 233 - DNA, 1731 bp, Setaria italica
  Si024078m
atggagtcctacctggggaagcgcaagctgaatggcaatggcgcgccgggcgccgagcgggagccgtccgtggcgccgccggctgggttccaggcggtggtgctggggtaccacgacgccggggaggaggcggccgcggaggcgcggcgggtggtgggcgagatggacttcttcaagacggagaagaggaaggaggaggcggccggccgctcgcgctccgccgccggcgcgccgggcgatctcagcatcaacaaggacgacctcaccatcaacatgggcctgcacgtcggcaggaggaagagcgggagcgaggattccatcgtcgacgacggcgtgtcctccaacgaggtagatcacagggaaaccaaagctgagctggcattggccaaatccgagattgggcgcctgaacgaagagaacaagcagctcaagaacatgcttggccgggtgaccacgagctacaactccctccaagtgcaagtcctcacactgatgcagcaaaggaataaccacagaagcctcggcgctccaagccatgagctgaacgttgatccggagaacaaggaccaggacgggagcctgctcccgcggcagttcatcagcctcggcaccgcggcgttgcccgacgagccgccgctgcgctccgcgggcggcgagtgctcggcgtcgcccagcaacacggacgcggccatgccgacgccgccggactacttccctggcaagggcaacggtgtcgtgctcggtagcaaggacgtcatgccgctgccgacgttcgatcaccaccaccgcgcccaggagcgggagcaggggggcagcagccctgaggacccgccgccgccgcaccacgtgtcgcagggatggctccccagcaaggttcccaagttcctgccggccaagggctccgagccggtccccgaggccgccaccatgcggaaggcccgcgtctccgtccgagcccgctccgaggcagccatgatcagtgacgggtgccaatggaggaagtacgggcagaagatggccaagggcaatccgtgcccccgcgcgtactaccggtgcacgatggccgccggctgcccagtccgcaagcaggtccagagatgcgccgaggacacgacggtggtgatcacgacgtacgaggggagccacaaccacccgttgccgccggccgcgatgccgatggcgacgaccacggcggcggcggcggccatgctgctgtcgggctcgatgccgagcgcggacggcagcctgatggcggggtccaacttcctggcgcgcgccgtgctgccgtgctcctccaacgtcgccaccatctccgcgtcggcgccgttcccaacggtgacgctggacctcacgcagccgggcccgggcgcgcagtcgcagcagcagccgcagcaaccggcgcgcccggaccccgcgcagctccaggccgcgctcgctgaggccgcgcggccggtggcgctgccgcagttgttcgggcagaagctgtacgacccctccaagcactccgccgtgcaggccgcggcggcgccggacgccggcgacaccgtcagcgcggcggccgtgatcgcgtcggaccccaacttccccgcggtgctcgcggccgcgatcaagtcgtacataggcggtagcagcggcggcggcggaggcggcgccggcgggagcagcgggaccgtgccaccaccgccggctagcggcggcggcgacagtagtagagacgacaagataggggag

SEQ ID NO: 234 - protein, 577 aa, Setaria italica
  Si024078m
MESYLGKRKLNGNGAPGAEREPSVAPPAGFQAVVLGYHDAGEEAAAEARRVVGEMDFFKTEKRKEEAAGRSRSAAGAPGDLSINKDDLTINMGLHVGRRKSGSEDSIVDDGVSSNEVDHRETKAELALAKSEIGRLNEENKQLKNMLGRVTTSYNSLQVQVLTLMQQRNNHRSLGAPSHELNVDPENKDQDGSLLPRQFISLGTAALPDEPPLRSAGGECSASPSNTDAAMPTPPDYFPGKGNGVVLGSKDVMPLPTFDHHHRAQEREQGGSSPEDPPPPHHVSQGWLPSKVPKFLPAKGSEPVPEAATMRKARVSVRARSEAAMISDGCQWRKYGQKMAKGNPCPRAYYRCTMAAGCPVRKQVQRCAEDTTVVITTYEGSHNHPLPPAAMPMATTTAAAAAMLLSGSMPSADGSLMAGSNFLARAVLPCSSNVATISASAPFPTVTLDLTQPGPGAQSQQQPQQPARPDPAQLQAALAEAARPVALPQLFGQKLYDPSKHSAVQAAAAPDAGDTVSAAAVIASDPNFPAVLAAAIKSYIGGSSGGGGGGAGGSSGTVPPPPASGGGDSSRDDKIGE

SEQ ID NO: 235 - DNA, 1551 bp, Glycine max
  Glyma07g39250.1
atgtttatggaatggagtctcactcttgattcctctcactcttcctcctccaccactaaccacaacatgttccccactttaggatttccggtcaaccttagcccctcctccgatcacaatcggacggtcctcggtgaagttgacttcttctccggtgctagaaacatctcatcatctcacaccaacaacgatcatggaaccccccttaagtgtgatccccatgtaaatactggtttgcaacttctcaccgctaacgctggaagtgatcagtcaaccgtggatgatggggcttcatcggatgctgaagataagcttgtcaagatcactgagctggcacgattgcaagaggaccttcggcgcatgaatgcagagaaccaaaagctgaaggagatgctcagccatgtcagcagtaactacgcgaacttgcaaatgcatcttgcagcagtactgcaacagcaacataaccaacgcactgagaacacggaacaagaggttgttcaaggaaaagctgaggagagaaagcatggaggaatggtgcctcctagacaattcctggatttagttccgagtggtacgaccgaaatagatgatcaagtatcgaattcttctttgggtgaaaggactcgatcaaccacacctcccagctgcaataaaaatgatgataaggataagaaagagactactgatattccacactctggcaaattattgaaccatacgacggatccatccactagtccggaagccgctatgagaaaagctcgtgtctcagttcgtgcccgatcagaagcacccatgatcagtgatgggtgccaatggcgaaaatatggacaaaagatggctaagggaaacccttgtcctcgagcatactacagatgcaccatggcagttggttgcccagttcgcaaacaagttcaacgttgtgcggaggacagaacaattttgacaacaacgtacgaggggacccataaccatccactgccaccagctgcaatggctatggcatcgaccactgcagctgctgctagcatgttgttgtctgggtcaatgaccagtgctgacggaataatgaaccccaatttgctaactagagctattcttccatgttctagcatggcaacactttcagcttcagcaccattccccacagtgacattggacctcacacacaaccaaaacgcgtttcagaattaccaaagacctcaaaccccattgttcccatcacagccccaggactttatcgctggatccacgccaccacaactgccgcaactgattgcacaagcgctctataatcaatccaaattctcaggccttcaactttctcaggatgtggggcctaataattcccaagctccaagaccgtttttgcagccaagccaacaggtctcgctcactgacaccatcagtgccatcaccgccgatccaaacttcacggcagcgctcgtctccgccatctcctccatcatcggtggtgctaatccaaacaataacagcgccaacaacagtagtagcaatcccaatgtcatcaatagtgctacaattaatcaa

SEQ ID NO: 236 - protein, 517 aa, Glycine max
  Glyma07g39250.1
MFMEWSLTLDSSHSSSSTTNHNMFPTLGFPVNLSPSSDHNRTVLGEVDFFSGARNISSSHTNNDHGTPLKCDPHVNTGLQLLTANAGSDQSTVDDGASSDAEDKLVKITELARLQEDLRRMNAENQKLKEMLSHVSSNYANLQMHLAAVLQQQHNQRTENTEQEVVQGKAEERKHGGMVPPRQFLDLVPSGTTEIDDQVSNSSLGERTRSTTPPSCNKNDDKDKKETTDIPHSGKLLNHTTDPSTSPEAAMRKARVSVRARSEAPMISDGCQWRKYGQKMAKGNPCPRAYYRCTMAVGCPVRKQVQRCAEDRTILTTTYEGTHNHPLPPAAMAMASTTAAAASMLLSGSMTSADGIMNPNLLTRAILPCSSMATLSASAPFPTVTLDLTHNQNAFQNYQRPQTPLFPSQPQDFIAGSTPPQLPQLIAQALYNQSKFSGLQLSQDVGPNNSQAPRPFLQPSQQVSLTDTISAITADPNFTAALVSAISSIIGGANPNNNSANNSSSNPNVINSATINQ

SEQ ID NO: 237 - DNA, 1467 bp, Glycine max
  Glyma17g01490.1
atgttccctgccttaggatttccggtcaaccttagcccctccgatcccaaccatcggacggtccttgctgaagttgacttcctctccgctagaaacaattcatcacctcacactaacgatcatggaacccctcctaagtcttatccccatgtaaataccggtttacaacttctcaccgcaaacgctgggagtgaccagtcgacggtggatgatggggcctcgtcggatgctgaagataagcgtgccaagatgactgagctggcacgactgaaagaggaccttcgaaacatgaatgcagagaaccaaaagctgaaggagatgctcagccatgtcagcagtaactacgcgaacttgcaaatgcatcttgcagcagtactgcaacagcaacagaaccaacgcactgagagcacggaacaagaggttgttcaaggaaaattagctgaggagagaaagcatggagttggcggaggaacggtgcctagacaattcctgagtttagttccaagtgaaatagatgatcaagtatctaattcttcttccggtgaaaggactcgatcaaccacacctcccagcaataaaaatgataaggataacaaagagactgatgacaagttgaacccttccaaccctacgacggatccatccactagtccagaagccgctatgagaaaagctcgtgtctcagtccgtgcccgatcagaagcacccatgatcagtgatgggtgccaatggcgaaaatatggacaaaagatggctaagggaaacccttgtcctcgagcatactacagatgcactatggcagttggctgcccagttcgcaaacaagttcaacgttgtgcggaggacagaacaattttgacaacaacgtacgaagggacccataaccatccactgccaccagctgctatggccatggcatcgaccactgtagctgctactagcatgttgttgtctgggtcaatgtccagtgctgatggaaaaatgaaccccaatttgctaactggagctattcttccatgctctaacatggcaacactttcagcttcagcaccattccccacagtgacattggacctcacacacaacccaaatgcgttgcagcagtaccaattaagacctcaaactcaaaccccattcctcccgtcaccgcctcagaactttatgtctggacccacaacaccacaactgccgaaactgattgcacaagtgctctataatcaatccaaattctcaggccttcaactttctcaggatgtggggcctaataattcccaagctccaacaccgtccttgttgcagccaagccaacaggtctcactcactgacaccgtcagtgccatcaccgcggatccaaacttccccgcagcgctcacggccgccatctcctccattatcggtggtgctaatccaaacaacaacaacaacagtagcaatcccaatgtcataaatagtgctacaattaatcaa

SEQ ID NO: 238 - protein, 489 aa, Glycine max
  Glyma17g01490.1
MFPALGFPVNLSPSDPNHRTVLAEVDFLSARNNSSPHTNDHGTPPKSYPHVNTGLQLLTANAGSDQSTVDDGASSDAEDKRAKMTELARLKEDLRNMNAENQKLKEMLSHVSSNYANLQMHLAAVLQQQQNQRTESTEQEVVQGKLAEERKHGVGGGTVPRQFLSLVPSEIDDQVSNSSSGERTRSTTPPSNKNDKDNKETDDKLNPSNPTTDPSTSPEAAMRKARVSVRARSEAPMISDGCQWRKYGQKMAKGNPCPRAYYRCTMAVGCPVRKQVQRCAEDRTILTTTYEGTHNHPLPPAAMAMASTTVAATSMLLSGSMSSADGKMNPNLLTGAILPCSNMATLSASAPFPTVTLDLTHNPNALQQYQLRPQTQTPFLPSPPQNFMSGPTTPQLPKLIAQVLYNQSKFSGLQLSQDVGPNNSQAPTPSLLQPSQQVSLTDTVSAITADPNFPAALTAAISSIIGGANPNNNNNSSNPNVINSATINQ

SEQ ID NO: 239 - DNA, 1623 bp, Glycine max
  Glyma09g00820.1
atggacaaaggatgggtttcctctcaatctcttcttcctcccacacccgacaatactatgtttcctctcctcggattccccgtcaaactcagccgccccaccatggaactccaccatgataaccgcaaacttgtcgctgaagtcgacttcttctctcatactccgccacccaacatcgtcaagaaggaacttgatcaaacacctcttcacattaatactggtttacaactccttactgctaacaccaggagtgaccaatctaccgtggatgacgggctttcatcggatgcagaagataagcgagccaaaaccaccgagcttgcacagttgcaagtggagcttcaacgcatgaacgctgagaacaagaagctgaaagagatgctcagccatgtcaccggtaactacaccgccttgcagatgcatcttgtgacactaatgcaacagaaccagcagcgaacagaaagcacggaaaatggggttgctcagggaaaggttgaggataaaaaccatggtgttggtggaggaaaggtaccaaggcaattccttgatataggtcccagtggcacagcagaagtagatgatcaagtatctgattcttcttctgatgaaagaacacgatcgagcacgcctcaggacaataacactgaagctggaacaagagatggagcgagaaataacaatggtaataaaagcgagttgggtagggaagagagtccagactcagaatcacaaggttggggtcccaataagcttcagaaagtgaacccttccaatcctatggatcaatccactgcagaagccacaatgagaaaagctcgtgtctcagttcgtgcccgatcagaagctcccatgattagtgatgggtgccaatggagaaaatatggacaaaaaatggctaaggggaatccatgccctcgagcatactacagatgcactatggcagttggttgcccagttcgcaaacaagttcaacgttgtgctgatgatagaacaattttggtgacaacatatgaaggcacacataaccatccactgccacctgctgctatggccatggcatcaaccactgcagctgctgctaccatgttgctgtctggatcaatgtccagtgcagatggagtaatgaaccccaatttgctagccagagcaattcttccttgctctacaagcatggcaacactttcagcttcagcaccattccccactgtgactttggacctcacacacaacccaaacccattgcaatttcaaaggcctggtgccccattccaagtacccttcctccaagcacagcctcagaattttgggtccggagccaccccaattgcacaagcactttataatcaatcaaaattctctggtcttcagttgtctcaggatgtaggatcttctcaattagcaccacaagctcccagaccacccttgcagccaagccaacatccctcactggctgacacggtcagcgccgccgcctctgccatcacttccgatccaaacttcaccgccgtgctcgctgccgccatctcctccatcattgggggagctcacaattcaaacaacaacaacaataacaacagcaacaacaacacgagcaggactactattagcagcttttcaggaaac

SEQ ID NO: 240 - protein, 541 aa, Glycine max
  Glyma09g00820.1
MDKGWVSSQSLLPPTPDNTMFPLLGFPVKLSRPTMELHHDNRKLVAEVDFFSHTPPPNIVKKELDQTPLHINTGLQLLTANTRSDQSTVDDGLSSDAEDKRAKTTELAQLQVELQRMNAENKKLKEMLSHVTGNYTALQMHLVTLMQQNQQRTESTENGVAQGKVEDKNHGVGGGKVPRQFLDIGPSGTAEVDDQVSDSSSDERTRSSTPQDNNTEAGTRDGARNNNGNKSELGREESPDSESQGWGPNKLQKVNPSNPMDQSTAEATMRKARVSVRARSEAPMISDGCQWRKYGQKMAKGNPCPRAYYRCTMAVGCPVRKQVQRCADDRTILVTTYEGTHNHPLPPAAMAMASTTAAAATMLLSGSMSSADGVMNPNLLARAILPCSTSMATLSASAPFPTVTLDLTHNPNPLQFQRPGAPFQVPFLQAQPQNFGSGATPIAQALYNQSKFSGLQLSQDVGSSQLAPQAPRPPLQPSQHPSLADTVSAAASAITSDPNFTAVLAAAISSIIGGAHNSNNNNNNNSNNNTSRTTISSFSGN

SEQ ID NO: 241 - DNA, 1671 bp, Glycine max
  Glyma15g11680.1
atggacaaaggatggggactcacccttgatacctcttcctctcaatctcttccattattcccttccaacgataataagatgtttcctctcctcggattccccgtcaacctcagccgcgcctccaaggaagacgatgaaaaccgcaaagttgtcggtgaagttgacttcttctctgatagaaacaaacctacacctccaccctctcacgaccacaacgttaaacccaacatcgtcaagaaggaaatcgatgaaacacctcttcacattaatactggtttacaactccttactgctaacaccgggagtgaccaatctaccgtggatgacggggtttcatctgatgcagaaaataagcgagccaaaaccactgagcttgcacagttgcaggtggagcttcaacgcatgaactctgagaacaagaagctgaaagagatgctcagccatgtgaccggtaactacaccgccttgcagatgcatcttgtcacattaatgcaacagaaccagcagcgaacaggaagcacggaaaatgaggttgttcagggaaaggtagaggataaaaacgttggtgttggtggagggaaggtaccaagacagttccttgatataggtcccagtggcacagcagaagtagatgatcaagtttcggattcttcttctgatgaaagaacacgatcgagcacacctcagaaccataacattgaagctggagctagagatggtgcgagaaataacaatggtaaaagccagttgggtagggaagagagtccagactcagaatcacaaggttggagtcccaataagcttcagaaaatgaacccttccaaccctatggatcaatccactgcagaagccacaatgagaaaagctcgtgtatcagttcgtgcccgatcagaagctcccatgatcagtgatggatgccaatggagaaaatatggacaaaaaatggccaaggggaatccatgccctcgagcatactacagatgcactatggcagttggttgcccagttcgcaaacaagctcaacgttgtactgatgatagaaccattttggttacaacatatgaaggcacgcataaccatccactgccacctgctgctatggccatggcatcaaccactacagctgctgctagcatgttgctttctggatcaatgtccagtgcagatggaataatgaacccaaatttgctagctagagcaattcttccttgctctacaagcatggcaacactctcagcttcagcaccattccccactgtgactttggacctcacacacaaccctaacccattgcaatttcaaaggcctggtgccccattccaagtacccttccttcaagcacagcctcagaactttgggtcaggagccgccccaattgcacaagcacaagcactttataatcaatcaaaattctctggtcttcagttgtctcaggatgtaggatcttctcaattagcaccacaagctcctagaccacccttacaaccaagccaacagccctcacttgctgacacagtcagcgccgccgcctccgccatcaccgccgatccaaacttcaccgccgtgctcgccgccgccatctcctccatcataggcagtgctcataattcaaacaacaacaacagcaacaacaacacaagccggactaccattagcagcttttcaggaaac

SEQ ID NO: 242 - protein, 557 aa, Glycine max
  Glyma15g11680.1
MDKGWGLTLDTSSSQSLPLFPSNDNKMFPLLGFPVNLSRASKEDDENRKVVGEVDFFSDRNKPTPPPSHDHNVKPNIVKKEIDETPLHINTGLQLLTANTGSDQSTVDDGVSSDAENKRAKTTELAQLQVELQRMNSENKKLKEMLSHVTGNYTALQMHLVTLMQQNQQRTGSTENEVVQGKVEDKNVGVGGGKVPRQFLDIGPSGTAEVDDQVSDSSSDERTRSSTPQNHNIEAGARDGARNNNGKSQLGREESPDSESQGWSPNKLQKMNPSNPMDQSTAEATMRKARVSVRARSEAPMISDGCQWRKYGQKMAKGNPCPRAYYRCTMAVGCPVRKQAQRCTDDRTILVTTYEGTHNHPLPPAAMAMASTTTAAASMLLSGSMSSADGIMNPNLLARAILPCSTSMATLSASAPFPTVTLDLTHNPNPLQFQRPGAPFQVPFLQAQPQNFGSGAAPIAQAQALYNQSKFSGLQLSQDVGSSQLAPQAPRPPLQPSQQPSLADTVSAAASAITADPNFTAVLAAAISSIIGSAHNSNNNNSNNNTSRTTISSFSGN

SEQ ID NO: 243 - DNA, 1032 bp, Glycine max
  Glyma15g11680.2
atggacaaaggatggggactcacccttgatacctcttcctctcaatctcttccattattcccttccaacgataataagatgtttcctctcctcggattccccgtcaacctcagccgcgcctccaaggaagacgatgaaaaccgcaaagttgtcggtgaagttgacttcttctctgatagaaacaaacctacacctccaccctctcacgaccacaacgttaaacccaacatcgtcaagaaggaaatcgatgaaacacctcttcacattaatactggtttacaactccttactgctaacaccgggagtgaccaatctaccgtggatgacggggtttcatctgatgcagaaaataagcgagccaaaaccactgagcttgcacagttgcaggtggagcttcaacgcatgaactctgagaacaagaagctgaaagagatgctcagccatgtgaccggtaactacaccgccttgcagatgcatcttgtcacattaatgcaacagaaccagcagcgaacaggaagcacggaaaatgaggttgttcagggaaaggtagaggataaaaacgttggtgttggtggagggaaggtaccaagacagttccttgatataggtcccagtggcacagcagaagtagatgatcaagtttcggattcttcttctgatgaaagaacacgatcgagcacacctcagaaccataacattgaagctggagctagagatggtgcgagaaataacaatggtaaaagccagttgggtagggaagagagtccagactcagaatcacaaggttggagtcccaataagcttcagaaaatgaacccttccaaccctatggatcaatccactgcagaagccacaatgagaaaagctcgtgtatcagttcgtgcccgatcagaagctcccatgatcagtgatggatgccaatggagaaaatatggacaaaaaatggccaaggggaatccatgccctcgagcatactacagatgcactatggcagttggttgcccagttcgcaaacaagtgagtttttctgat

SEQ ID NO: 244 - protein, 344 aa, Glycine max
  Glyma15g11680.2
MDKGWGLTLDTSSSQSLPLFPSNDNKMFPLLGFPVNLSRASKEDDENRKVVGEVDFFSDRNKPTPPPSHDHNVKPNIVKKEIDETPLHINTGLQLLTANTGSDQSTVDDGVSSDAENKRAKTTELAQLQVELQRMNSENKKLKEMLSHVTGNYTALQMHLVTLMQQNQQRTGSTENEVVQGKVEDKNVGVGGGKVPRQFLDIGPSGTAEVDDQVSDSSSDERTRSSTPQNHNIEAGARDGARNNNGKSQLGREESPDSESQGWSPNKLQKMNPSNPMDQSTAEATMRKARVSVRARSEAPMISDGCQWRKYGQKMAKGNPCPRAYYRCTMAVGCPVRKQVSFSD

SEQ ID NO: 245 - DNA, 1821 bp, Citrus clementina
  clementine0.9_005365m
atggacaaaggatggggtctcacacttgattctgatcatcctattgttagtaatctgaatttcttcacaagcaacaagccaaagccatcattagcaaggtttagaacaaaccgtgacatggctgcttctggtgctgctgactcagcttctgtcagaatgtttcagcttccggcctccgacaatagtaatgctccctcctcgtctgatgataatcgggtggctgttgatgaagttgacttcttttccgatgacaagaacagagtttctatctctgatcatcgtgaagatgatcgtaacaagacaacaaattctgttcacatcaagaaagagaattctcacgaccaacttcgtcacagaactggcttggatgttaatactggcttgcatctacttactgctgctaacactggaagcgatcaatcaacggttgatgatggggtttcatctgatcatgctgacaaaaaacgaacaaaaattgagttgactcaattgcaagtggagctgcaacaaatgaatacagaaaatcaaaggttaagagacatgcttagccaagtaactaacaattacaatgcactacagatgcatattgttgcattaatgcaacagcagcaagaaaatcgccgagcccctgaaagcaaccaagcgcatgaggttgttgaaggaaaagatgaaggcaaaaagcacgatgaccaagtaatggtgcctagacaattcatcggtctggggccttccgctgagactgatcacgaggtttctaattgttcatctgatgaggaaagaactttatcaggaaccccaccgaacaatgttgaagctgcatcaaaggagcacgttaatagcaacggtaaaaatgagatagtttctttcgatgatcaagctgctgctgctgcagagaactctaatggcaaaagaattggaagagaagagagcccggaatctgaaacacagggatggggccctaataacaaagttcaaaagttgagttctgctaaaggaattgatcagtccaatgaggccaccatgagaaaagcccgtgtctcagttcgtgctcgatcagaagctcccatgatcactgatggatgtcaatggagaaaatatggacaaaaaatggctaaaggaaatccttgtcctcgagcttattatcgttgcacaatggcagttggttgcccagttcgtaagcaagttcaacgttgtgcggaagataggacgattttgataacaacttatgaaggcaatcacaatcatcccttacctcctgctgcaatggcaatggcatcaacaacaacagctgctgctagcatgttactttcaggatcaatgtcgagtgcagatgggataatgaaccccaatttgctagccagagctattcttccttgctcatcaagcatggctacgatttcagcttctgccccatttcctacagttacattagaccttactcattcaccaaaccctttacaactccaaaggcaagcagctcaattccaagtccaatttccaggccagccgcaaaatcttgcctctgtcacaaacactcaattgcctcaagtttttggtcaggccctttacaatcaatcaaaattctcaggtctacaattatctcaaaatattgggtctaattctcaatcgggtagccatcaaactctacctccaccattgcaacaaccgcagcagttggctgacactgtaagtgccgccacggccgccatcacagctgatccaaacttcactgcagctcttgccgccgccatcacttccattattggcggtgcacaaaatccttttagcaacaactccaataataacaacaggcaacaccaa

SEQ ID NO: 246 - protein, 607 aa, Citrus clementina
  clementine0.9_005365m
MDKGWGLTLDSDHPIVSNLNFFTSNKPKPSLARFRTNRDMAASGAADSASVRMFQLPASDNSNAPSSSDDNRVAVDEVDFFSDDKNRVSISDHREDDRNKTTNSVHIKKENSHDQLRHRTGLDVNTGLHLLTAANTGSDQSTVDDGVSSDHADKKRTKIELTQLQVELQQMNTENQRLRDMLSQVTNNYNALQMHIVALMQQQQENRRAPESNQAHEVVEGKDEGKKHDDQVMVPRQFIGLGPSAETDHEVSNCSSDEERTLSGTPPNNVEAASKEHVNSNGKNEIVSFDDQAAAAAENSNGKRIGREESPESETQGWGPNNKVQKLSSAKGIDQSNEATMRKARVSVRARSEAPMITDGCQWRKYGQKMAKGNPCPRAYYRCTMAVGCPVRKQVQRCAEDRTILITTYEGNHNHPLPPAAMAMASTTTAAASMLLSGSMSSADGIMNPNLLARAILPCSSSMATISASAPFPTVTLDLTHSPNPLQLQRQAAQFQVQFPGQPQNLASVTNTQLPQVFGQALYNQSKFSGLQLSQNIGSNSQSGSHQTLPPPLQQPQQLADTVSAATAAITADPNFTAALAAAITSIIGGAQNPFSNNSNNNNRQHQ

SEQ ID NO: 247 - DNA, 1815 bp, Eucalyptus grandis
  Eucgr.E04011.1
atgttccccggcatcgacttctcggccagcctcggccgccgggacgaccaccgccacgcctccatcctaaattcgtcctcgcctgccgcggacgagggccgggtcgtcgtcggcgaggtcgacttcttctccgattgcaagagcaggtcgtcccttcctgccgccgccgcgggcggcgaggagggtagagccgccaccgtgagcgtcaagagggagagccccgtcgcgtccggccccgcgaggtcggagctgaacgtgaatactggtttgcgcctcctgactgccaacaccggcagcgaccagtcgacggtggacgacggattctcctccgatatcgaggagaaaagagccaagaacgagcagctggcgcacctaaacgcggagctgcagagaatgaattcggagaaccagaggttgaaggagatgctcagccaggtcacgagcaactacaacgcattgcagttgcacctctcttcactcctccagcagcagcagcagcaccacatccagcaccagcaccagagcaatggcgccgagcccgcgcaagatcacgagaatgcgatgaagaagaaccagacggtggtgccgaggcagtttcttgatctcggcccgatgtcggcggctgccgcggagaccgacgagatctcgaactcttcatcggaggagaggacgagggatggctcaaggtcgccgttggccaaaatggaagtcgcatcgtctgctcataacaacaaggcggaacaagatagctccggcgctagagatggtgacaagagaggtgttaggaacgagagtcccgacgactcggaaactcaaggctgggggccgaacaaggcggccaaactggaggcggcgaggacgagcatcgagcaatccgcggaggccacgatgaggaaggcccgcgtctccgtccgagctcgatccgaggctcccatgattaccgacggatgccaatggaggaaatacggacagaagatggccaaggggaacccgtgcccccgagcttattatcgttgcaccatggcggtcggctgccccgttcgcaagcaagttcagcgctgtgccgaagaccgagggattctgataacgacctatgagggcaaccacaaccacccactcccgccggcagccatggccatggcctcgaccaccgcggctgcggtcagcatgctgctctcagggtcgatgtcgagcgcggacggcatcatgaacccgaacctgctggcgagggcgatcctgccttgctcatcgagcgtggccacgatctcggcctcagccccgttccctacggtcacgctggacctcacccactccccgaacccgttgcaaatccaaagaccccagccccaattccaagtccccttccctggccagccccagaactttggctcattgccttcacagtctcttcctccagcttttgggcaagcactctacaatcaatccaagttctctggcctccaattgtctcaagatttggccaatccttcccaattaggtcagcaagttgcctcgctaccacaacacttgcaacaagcacagcagcagcagcagcaacagcaacaacaacaacaacaatcggcttctttggctgacacgctcagcgcagccacagccgccatcaccgccgaccccaacttcaccgcggcccttgctgctgccatctcgtccataatcggcggtgcacatcccaataacagcaccaccaccaccacaaccggcactgctgccgccgccacaaccaccggcaacaacaacaacaacaccactaacgtcagcacaagcaacagcaagatgagcagcttcccaggaaat

SEQ ID NO: 248 - protein, 605 aa, Eucalyptus grandis
  Eucgr.E04011.1
MFPGIDFSASLGRRDDHRHASILNSSSPAADEGRVVVGEVDFFSDCKSRSSLPAAAAGGEEGRAATVSVKRESPVASGPARSELNVNTGLRLLTANTGSDQSTVDDGFSSDIEEKRAKNEQLAHLNAELQRMNSENQRLKEMLSQVTSNYNALQLHLSSLLQQQQQHHIQHQHQSNGAEPAQDHENAMKKNQTVVPRQFLDLGPMSAAAAETDEISNSSSEERTRDGSRSPLAKMEVASSAHNNKAEQDSSGARDGDKRGVRNESPDDSETQGWGPNKAAKLEAARTSIEQSAEATMRKARVSVRARSEAPMITDGCQWRKYGQKMAKGNPCPRAYYRCTMAVGCPVRKQVQRCAEDRGILITTYEGNHNHPLPPAAMAMASTTAAAVSMLLSGSMSSADGIMNPNLLARAILPCSSSVATISASAPFPTVTLDLTHSPNPLQIQRPQPQFQVPFPGQPQNFGSLPSQSLPPAFGQALYNQSKFSGLQLSQDLANPSQLGQQVASLPQHLQQAQQQQQQQQQQQQQSASLADTLSAATAAITADPNFTAALAAAISSIIGGAHPNNSTTTTTTGTAAAATTTGNNNNNTTNVSTSNSKMSSFPGN

SEQ ID NO: 249 - DNA, 1734 bp, Populus trichocarpa
  POPTR_0004s00890.1
atggacaaaggatggggtcttactcttgcttctgatcccgtttctgtcttctctagcaacaacagcaacaacagcccggttggctcttttttgaaggtcaaaagggacttcagttctgatcataacatggcagattctaggaatattaataatagtatgtttcagtttccggtcagtctttctgccggcaaggaagaggtatcatctgctgctgctcatgaagtagacttctttaaggagatgatcaatagggttgatggccatgattctaaatccacaagtgttattgttaagaaggagaattctcttgctgaagttgctccaaggtccagtgctgctcttgatgtaaatactggattgcaccttctaactgcttacgctagaagtgatcaatcaactgtggatgatggagtttcatctgacgctgatgataagagatcaaagaatgttgagctagcacaattgcaagtggaacttcaaaaaatgaacgcagaaaatcaaaggttgaaagacatgcttagtcaagtaaccaacaattacagtgccttacaaatgcattttgtagcattgatacaacaacaacaacggaaccatggagttgaaagcgataacaaacaggaggaaaagaaacatgagatggtgcctagacaattcatggatctaggaccttcagctgagactgatgagatatccaattcatcgtccgaagagaggactcgttctgtaacacctcaaaatcatttcgaagcagcttcgacgaaaaacaatgatggaaagagaattggcggagacgagagtcctgaatcagaattacaaggctggaatcctaacaaggttcaaaagttgaatcctgctagttctgccaacaaggctattgaacaatctgccgaggcaaccatgagaaaagcccgtgtttcggttcgtgcacgatcggaggctcccatgatttctgatggctgccaatggcgaaagtacggtcagaagatggcgaaaggaaatccatgtccgagagcttattatcggtgcaccatggcagttgggtgtccagttcgcaaacaagttcaacgttgcgcggaggataagacaatcttgatcacaacttatgaaggcaatcacaaccaccctctacctccagctgcaatgacaatggcgtcaacaacaacagcagctgcaactatgttactttcaggatcaatgtcaagtgcagatggcatgatgaacccaaatttgctagcaagagcaatcctcccaggttgctcatcaagtatggcaacgatttcagcttcagctccgttccctactgtaacattggacctcactcaaaatacaaaccctctacaattccaaagacctcctacacaattccaagtccctttcccaggccaaccccagaatttcgccttagtcacagctccacaattgcctcaggtttttggtcaagccctatacaaccaatcaaaattctccggtctccaattgtctcaagatatagggtcatcacaattaggccaccaagctcaaccccaaatatttcacccaggacaacaaccttccctgtctcatgacacattgagtgctgccactgccgccatcaccgctgatcctaatttcactgcagcacttgcagctgccatcagctccatcattggtggtgctaacagcagtagcaacaccacaaccaacaacaacaacaacaacagcaatagcaatgccaccaacacaagcaacagaaat

SEQ ID NO: 250 - protein, 578 aa, Populus trichocarpa
  POPTR_0004s00890.1
MDKGWGLTLASDPVSVFSSNNSNNSPVGSFLKVKRDFSSDHNMADSRNINNSMFQFPVSLSAGKEEVSSAAAHEVDFFKEMINRVDGHDSKSTSVIVKKENSLAEVAPRSSAALDVNTGLHLLTAYARSDQSTVDDGVSSDADDKRSKNVELAQLQVELQKMNAENQRLKDMLSQVTNNYSALQMHFVALIQQQQRNHGVESDNKQEEKKHEMVPRQFMDLGPSAETDEISNSSSEERTRSVTPQNHFEAASTKNNDGKRIGGDESPESELQGWNPNKVQKLNPASSANKAIEQSAEATMRKARVSVRARSEAPMISDGCQWRKYGQKMAKGNPCPRAYYRCTMAVGCPVRKQVQRCAEDKTILITTYEGNHNHPLPPAAMTMASTTTAAATMLLSGSMSSADGMMNPNLLARAILPGCSSSMATISASAPFPTVTLDLTQNTNPLQFQRPPTQFQVPFPGQPQNFALVTAPQLPQVFGQALYNQSKFSGLQLSQDIGSSQLGHQAQPQIFHPGQQPSLSHDTLSAATAAITADPNFTAALAAAISSIIGGANSSSNTTTNNNNNNSNSNATNTSNRN

SEQ ID NO: 251 - DNA, 1770 bp, Populus trichocarpa
  POPTR_0021s00280.1
atggacaaaggatggggtctaaccctcgcttctgatcctgtttctgtcttctctagcaacaacaacaacagcccagttggctcttttttgaagatcaaaagagacttcattagtgatcataacatggatcattctaggaacaataatatgtttcagtttccaggtagtctttctgctggccaagatgagcaaccaccttctgctgctcacgaagtagatttctttaaagaaaggatagataaggttggtgacgatgattctaagaccacaagtgttattgtcaagaaggagaattccattgctgaacttgctccaaggtctaccaggactgctcttgatgtaaatactgggttgcaccttcttactgctaactctagaagtgatcaatcaactgtggatgatggagtttcatctgatgttgatgataagagatcaaagaacaacgagaagttggcacaattacaaatggagctgcaaaaaatgaatacagaaaatcaaaggttaaaagacatgcttggtcaagtaaccaccagttacagtgctttacagatgcattttgcagcactaatgcagcaacatcaacaacaaaatcatggaaaagaaagcaataaagagcaacagggaaaatcttctgaggaaaagaaacatgaggacgtagtagtgcccagacaattcatggatctaggcccttcagctgagactgatgaactatccaattcatcgtccgatgagaggactcgttctggaacacctcaaaaccatattgaagttgcatccccgaaaaacaatggtaaacttccatatgatcaagaaaattctagcttccgagatggaaaaagaattggcagggaagagagtcctgaatctgaatcacaagcatggaaggttcagaaaacggatcctgccagtcctgctaataaggctatagagcaatcgaccgaggcgacgatgagaaaagcccgtgtgtcggttcgtgcacgatcggaagctcccatgattactgatggctgccaatggcggaaatacggccagaagatggccaaaggaaacccgtgtccgagggcttattatcggtgcaccatggcagtgggctgtccagttcgaaaacaagttcaacgttgcgcggaggatagaacaatcttgatcacaacttatgaagggaatcacaatcaccctctacctccagctgcaatggcaatggcatcaacaacagcagcagctgcaagcatgttactatcaggatcaatgtcaagtgcagatggcataatgaacccaaatttgctagcaagagcaatactcccagctggctcatcaaatatggcaactatttcagcttcagctccattccctactgtaacattagacctcactcataatccaaaccctctacagttccaaagacctcctccacaattccaagtcccttttccaggccagccccagaatttttcctcagtcacaacaccacaattgcctcaggtttttggtcaagccttgtacaaccaatcgaaattctctggcctacaattgtctcaggaaattgggactccacaattaggccaccaagctcaaccccacttgttgcactcaggacaacaaccttccctatctcaggacacattgagtgctgccactgccgccatcacggccgatcctaacttcactgcagcacttgcagctgccatcagctccatcattggtggtgctaacagcaacaccaccaacaacaacaataacagcaatgccacgaacaacacaagccacagaaat

SEQ ID NO: 252 - protein, 590 aa, Populus trichocarpa
  POPTR_0021s00280.1
MDKGWGLTLASDPVSVFSSNNNNSPVGSFLKIKRDFISDHNMDHSRNNNMFQFPGSLSAGQDEQPPSAAHEVDFFKERIDKVGDDDSKTTSVIVKKENSIAELAPRSTRTALDVNTGLHLLTANSRSDQSTVDDGVSSDVDDKRSKNNEKLAQLQMELQKMNTENQRLKDMLGQVTTSYSALQMHFAALMQQHQQQNHGKESNKEQQGKSSEEKKHEDVVVPRQFMDLGPSAETDELSNSSSDERTRSGTPQNHIEVASPKNNGKLPYDQENSSFRDGKRIGREESPESESQAWKVQKTDPASPANKAIEQSTEATMRKARVSVRARSEAPMITDGCQWRKYGQKMAKGNPCPRAYYRCTMAVGCPVRKQVQRCAEDRTILITTYEGNHNHPLPPAAMAMASTTAAAASMLLSGSMSSADGIMNPNLLARAILPAGSSNMATISASAPFPTVTLDLTHNPNPLQFQRPPPQFQVPFPGQPQNFSSVTTPQLPQVFGQALYNQSKFSGLQLSQEIGTPQLGHQAQPHLLHSGQQPSLSQDTLSAATAAITADPNFTAALAAAISSIIGGANSNTTNNNNNSNATNNTSHRN

SEQ ID NO: 253 - DNA, 1530 bp, Vitis vinifera
  GSVIVT01012682001
atggacaaaggatggggtctcacccttgattctattgccatcaattcgtttctcaacaagcgcagccgtgggattctggagtctggccccatgttggacatgccggtgggtgatgagaggcgggaggtggatttcttcgccgagaagactaggagcgtcagtgtgaagaaggagaattctcatgtggatgaagctgcgatcactgatttggatgtcaatactgggttgaatcttctgactgctaacgcgggaagtgatcagtcgacggtggaggatgagaatccggatagggagaataagagagccaagattgaggtggcgcaattgcaagtggagcttgaacgtatgaatgccgagaaccaaaagctgcgagggatgctgaaccaggtgaccaacaactacagcactcttcagatgcatctcgtcacacttatgcagcagcagagccagcagaaccgtggagccgaaagcctccaagaacatgggtctgtcggaggaaaatctgatgagaagaaacatgaggttgcgggagcggtggtgcccaggcagttcatcgatctaggcccaactgccacagctgacacggatgagccatctcaatcttcatcagaagaaagaacccgggatctctctggatcaccccagaatcatcaggaaaacggaaaaggagctggcagggaagaaagcccagaatctgaaacacaaggttgggtccagaacaaggcttccaaattgagtcctcccaagactattgatcagtccgcagaggccacaatgaggaaagcccgcgtctcggttcgtgcccgatcagaggctcccatgatcactgatggatgccaatggcgcaagtatgggcagaaaatggcgaaggggaacccatgcccgcgagcctactaccgatgtaccatggcagttggctgcccagttcgcaaacaagttcagaggtgtgccgaggacaggtcaatattgataactacctatgaaggaacccacaaccacccactccctccggctgcaatggccatggcatcaacgacatcagcagctgcaaacatgctactttcaggatccatgtcgagcgcagatggactaatgaacccgaatttcctggccaggacgatactcccttgctcatctaacatggcgactatttcagcttcagcgccattccccacagtgacattggacctcacccacactccttccccattacagtaccaaaggccaacttcccatcaggccctctacaaccaatccaaattctcagggctgcagctctctcaggacatggaatcagcccaccaagctccaccaacattgcatcagccacagccagcctcattggctgacacagtgagcgctgccacagctgccatcaccgccgacccaaacttcaccgcagctctcgcagctgccataacctcgatcatcggcggtggcgccgcccacccaaacaccaccattaacagcacctccaatgcaaccaactccagcaacaccaacaaaatcagcagcttcccgacggggaat

SEQ ID NO: 254 - protein, 510 aa, Vitis vinifera
  GSVIVT01012682001
MDKGWGLTLDSIAINSFLNKRSRGILESGPMLDMPVGDERREVDFFAEKTRSVSVKKENSHVDEAAITDLDVNTGLNLLTANAGSDQSTVEDENPDRENKRAKIEVAQLQVELERMNAENQKLRGMLNQVTNNYSTLQMHLVTLMQQQSQQNRGAESLQEHGSVGGKSDEKKHEVAGAVVPRQFIDLGPTATADTDEPSQSSSEERTRDLSGSPQNHQENGKGAGREESPESETQGWVQNKASKLSPPKTIDQSAEATMRKARVSVRARSEAPMITDGCQWRKYGQKMAKGNPCPRAYYRCTMAVGCPVRKQVQRCAEDRSILITTYEGTHNHPLPPAAMAMASTTSAAANMLLSGSMSSADGLMNPNFLARTILPCSSNMATISASAPFPTVTLDLTHTPSPLQYQRPTSHQALYNQSKFSGLQLSQDMESAHQAPPTLHQPQPASLADTVSAATAAITADPNFTAALAAAITSIIGGGAAHPNTTINSTSNATNSSNTNKISSFPTGN

SEQ ID NO: 255 - DNA, 1494 bp, Solanum lycopersicum
  Solyc02g032950.2.1
atggataaaggatggggacttacacttgagaataagcctttttttgggtttaatcatatgatgaaccgtagagaagagcaattagtagctgatcatgacaaaaaagaagttgatttcttctctcatcataataggaaggctatacatcatgattttataaagaaggaagatttgaatagtactactattactacgccatcgaaattcattgtaaatactggtttgcaacttgtgactgcaagtgatcaatcaacggtagatgatggggagttaatactagaagaagaaagagctaaaaatgagttagcagaactacaagttgaattgagaaggatgaatgccgaaaatcaacgtttgagagggatgcttacccaagtcaccaataattatactgcacttcagatgcatcttgctacactaatgcaacaacaacgacaaaacatttcaataactcaaaatacacatgaccacaattttcagattgtggaagcaaagttaaatcaagaaaaaatcgttccaagaagattcctggaattaggtcgaagtggtaacgatctatctcataattccaattcttcatcagaagaaagaacagtttctaaatcacctcgaaacgatacacaagttacaattatgcataataaaggcagagaagaaagcccagaatctgatagttgggtacctaacaaggtccccaaattgaattcctcaatgccaattgatccaacaacagacgcaaccatgagaaaagctcgtgtctctgttcgtgcccgatcagaagctcccatgattagtgatggatgtcaatggagaaaatatggacagaaaatggcgaaaggcaatccatgtcctcgagcttattatcgctgcactatggctgttggttgcccagtacgaaaacaggttcaaaggtgtgctgaggacaggacaattttgaatacaacttatgagggtacacacaaccaccctctaccaccagcggctatggctatggcatcgactacatcagctgcagcaaatatgttgctatcaggttcgatgtcaagtgcagatggtgtgttaatgaatccgaatttcctagctaggactatgcttccatgttcgtcaagtatggcgactatttcagcatcagctccgtttcccactgtaacattggacctaactcaaaatcaaaactcgttgacttataatcaaagaagtactcaaatttctcaatttcaagttcctttccaatcgagccctcaacatccgaactttattacatcaatgccaccaccaccaatgcctcaggttttacataaccaatcaaagttttcaggcctacaaatttctcaagacattcatcatcctcaacaattacaacatgttcaaaaccaccaatcattttccgacacgctcaccgccgccactgctgccataacggccgatcccaatttcactgccgcgctggccgcggcaatctcgtccataattactggtcctggaaaagaacag

SEQ ID NO: 256 - protein, 498 aa, Solanum lycopersicum
  Solyc02g032950.2.1
MDKGWGLTLENKPFFGFNHMMNRREEQLVADHDKKEVDFFSHHNRKAIHHDFIKKEDLNSTTITTPSKFIVNTGLQLVTASDQSTVDDGELILEEERAKNELAELQVELRRMNAENQRLRGMLTQVTNNYTALQMHLATLMQQQRQNISITQNTHDHNFQIVEAKLNQEKIVPRRFLELGRSGNDLSHNSNSSSEERTVSKSPRNDTQVTIMHNKGREESPESDSWVPNKVPKLNSSMPIDPTTDATMRKARVSVRARSEAPMISDGCQWRKYGQKMAKGNPCPRAYYRCTMAVGCPVRKQVQRCAEDRTILNTTYEGTHNHPLPPAAMAMASTTSAAANMLLSGSMSSADGVLMNPNFLARTMLPCSSSMATISASAPFPTVTLDLTQNQNSLTYNQRSTQISQFQVPFQSSPQHPNFITSMPPPPMPQVLHNQSKFSGLQISQDIHHPQQLQHVQNHQSFSDTLTAATAAITADPNFTAALAAAISSIITGPGKEQ

SEQ ID NO: 257 - DNA, 1650 bp, Solanum lycopersicum
  Solyc02g080890.2.1
atggacaaaggatggggtcttacccttgaaacttcttcttctaattctgatagagctggtttcttcaagaacaagcctgtttttggttttaatttaagtcctaaatttaacgctgctgaaatgttttcctcctccgatgagaaacgtagcatcgttaatgaagtcgactttttcgccgataaaaagcctattgtaaagaaggaaaattctcagaccgataattctatcagaactgatgatcagtgtgttgtaaatactggtttgcaacttgtgattgcaaacgcgggaagtgatcagtcaacggtagatgatggggtttcatcggaagtacttgaggagaaacgagctaaaattcagcagttggcacaattgcaagttgagcttgaacggatgaattccgaaaatcaacgtttaaaagggatgcttactcaagttagcaacagttattctgcacttcagatgcatcttgttacactcatgcaacaacaacttaattcaagaactgaaaatacacatccccatgaggttgttggcgcaaattctgatgaagaaaagaaaaaagcgaataatgggaccatagttccaagacaattcatggagctaggccctagtggttccaaagttgacccaatggacgaaccatctcattctcgctcttcatcggaagaaagaacactctctggatcacctcggaacaacatggaattagtgtcaagggataaggcaattaaccgcgaagaaagcccagaatctgagagttgggctccaaacaaggcccctaaattgatgacttcatcatcaaagcctgttgaacagtcaacagaagcaaccatgaggaaagctcgtgtctccgttcgtgcccgatcagaagctcccatgattagtgatggttgccagtggagaaaatatggtcagaaaatggcaaaaggcaatccatgtccacgtgcttattatcgttgcactatggctgttggttgtccagtccgaaaacaggtgcaaaggtgtgcggaggacaggtcgatcttaataacaacatacgaaggtacacacaaccacccattaccaccagcagccatggctatggcatctacaacatctgcagcagcaaacatgttgctctctggttccatgccaagtgctgatgggctaatgaatacaaatttcctagcaagagcaatgcttccatgttcatcaaacatggcaactatttcagcttcagccccatttcctactgtcacattagacctcacagcccaaaatccaaacgcagcattgcctaattatcatcaaagaatcaaccaagcaaatcctcaattccaattccctttaccagctgggctaaatcacccgaatttcgccgcttcaatgtcagcaccacaaatgcctcacgttttggggcagcctttgtataaccaatcgaaattttcgggtttacaaatttctcaggaaaacattcatcatcaccacccatcaatttctcatgacacactctccgccgccacggctgctatcaccgccgatcctaacttcaccgccgcccttgcggctgccatctcctccatcatcggtggttctcatccgaacaacggcaacagtcccatgtccggtccctcaagcaataataataacactagtagtttcccagggaac

SEQ ID NO: 258 - protein, 550 aa, Solanum lycopersicum
  Solyc02g080890.2.1
MDKGWGLTLETSSSNSDRAGFFKNKPVFGFNLSPKFNAAEMFSSSDEKRSIVNEVDFFADKKPIVKKENSQTDNSIRTDDQCVVNTGLQLVIANAGSDQSTVDDGVSSEVLEEKRAKIQQLAQLQVELERMNSENQRLKGMLTQVSNSYSALQMHLVTLMQQQLNSRTENTHPHEVVGANSDEEKKKANNGTIVPRQFMELGPSGSKVDPMDEPSHSRSSSEERTLSGSPRNNMELVSRDKAINREESPESESWAPNKAPKLMTSSSKPVEQSTEATMRKARVSVRARSEAPMISDGCQWRKYGQKMAKGNPCPRAYYRCTMAVGCPVRKQVQRCAEDRSILITTYEGTHNHPLPPAAMAMASTTSAAANMLLSGSMPSADGLMNTNFLARAMLPCSSNMATISASAPFPTVTLDLTAQNPNAALPNYHQRINQANPQFQFPLPAGLNHPNFAASMSAPQMPHVLGQPLYNQSKFSGLQISQENIHHHHPSISHDTLSAATAAITADPNFTAALAAAISSIIGGSHPNNGNSPMSGPSSNNNNTSSFPGN

SEQ ID NO: 259 - DNA, 1797 bp, Citrus clementina
  clementine0.9_005514m
atggccaagggaagtggactctccattgatcataatatttcagatcccattgcaggcaagaacaagaacttctttctttgtcatcagcccgctgtcctcaattctttctccgacgatcatcaccacttccacaaattccattatttaatggatgccaagaggtctcctgctaccactccatcgactattcagttccccgtctgccttaatcatgatgaggattctccccagcagtcgtctgatgatcaccatcatcataataaacggaaggtcattgatgagatggattttttcaccgacaagactacccacagccgcgatcatcaccattataaagactccaaattggagcttaacgtcaacactgggttgaatcttctcactacaaataccagcagtgatcattccacggtcgatgatggaatttcgacaaatatggaagataaaaaagctaaaaatgagtacgccgtcgttcacgcagagcttgagcgagtgaacgcggagaatcaacgtttaaaggacatggtaaacgaggttaccaacaattacaacgcgttacagttgcaattgatggcatttatgcaacaccataatgctagggcagctgatgaaaacagtgatgggcggcaagttgaagaaaagaaaggacagcttgcggcaccgaggcggtttatagatcttggtctgggcgttaatacagccgatactgctgatgagcctgcgctttcttcttcagaaggaaggagccgcgacctcggaggttcaccggtgaatggaaattctaataataatgaggagagtaacgttctgtttggtcaagacaagaaggaattcgttaagagagacgatagccccgatcgaaactatgggcctaataaggttcctaagtttagttcatcgtctaaaaatgtcgatcaaaccgaggccacgatgaggaaggctcgtgtttctgttagagccagatcggaagctcccatgatcaacgatggatgccaatggagaaaatatggacagaaaatggcgaagggaaatccttgtcctcgagcttactatcgttgcacaatggctgctggttgcccagttagaaaacaagtacaaagatgtgctgaagatagaacgattttgatcacaacatatgagggcaaccacaaccacccattgccgccggctgcaatggcaatggcatcaacaacatcatcggcggcgcgattgctgctatcgggttcaatgtcaagcgctgacggactgatgaatgcaaattttctagcaagaactctcctcccatgctcctctagcatggccactatatcagcttcagccccattcccaactgtcacattagacctaacacagacccccaacccctcaaatgtccaaaggtcaccaaaccaatttcaagttccattcccaaacccatcccacaattttgccgatggggcagcggcagcagcagccggttcactgctgcctcagatatttgggcaagcattgtataatcaatcaaagttttctgggttacaaatgtcccaagatatggacccttctcaattgggtaaccaatcacaattgccatcaccagcaatgcaacaagggcagcagcataattcattagccgacagtgtgagcgctgccactgctgccattgctgctgatcccaactttactgccgctttagcagcagcaatcacgtctatcattaatggtggcaccccccaatcaaacaacgttaccaacaatgagaataccgacgacctagcaactactacaaatggcaatgtcaagttttctcaatcatca

SEQ ID NO: 260 - protein, 599 aa, Citrus clementina
  clementine0.9_005514m
MAKGSGLSIDHNISDPIAGKNKNFFLCHQPAVLNSFSDDHHHFHKFHYLMDAKRSPATTPSTIQFPVCLNHDEDSPQQSSDDHHHHNKRKVIDEMDFFTDKTTHSRDHHHYKDSKLELNVNTGLNLLTTNTSSDHSTVDDGISTNMEDKKAKNEYAVVHAELERVNAENQRLKDMVNEVTNNYNALQLQLMAFMQHHNARAADENSDGRQVEEKKGQLAAPRRFIDLGLGVNTADTADEPALSSSEGRSRDLGGSPVNGNSNNNEESNVLFGQDKKEFVKRDDSPDRNYGPNKVPKFSSSSKNVDQTEATMRKARVSVRARSEAPMINDGCQWRKYGQKMAKGNPCPRAYYRCTMAAGCPVRKQVQRCAEDRTILITTYEGNHNHPLPPAAMAMASTTSSAARLLLSGSMSSADGLMNANFLARTLLPCSSSMATISASAPFPTVTLDLTQTPNPSNVQRSPNQFQVPFPNPSHNFADGAAAAAAGSLLPQIFGQALYNQSKFSGLQMSQDMDPSQLGNQSQLPSPAMQQGQQHNSLADSVSAATAAIAADPNFTAALAAAITSIINGGTPQSNNVTNNENTDDLATTTNGNVKFSQSS

SEQ ID NO: 261 - DNA, 1893 bp, Solanum lycopersicum
  Solyc07g051840.2.1
atggccaaaggaagtggactctcctttgatccagatcccatcaaacctattcctattgtcctcaattcttttcttgaaccccataacaaccaattttatcctaagaacaaatttttttacaatttaacatccatggaatcatcatacaacaacaggtcaccacctcctactattcaattcccagtaaaccttaactgctctactactactactcatcatcatgatcatgatcatgatcatgatcatcaagaccaacaacaacaccatataagaccagttattgatgaaatggacttctttgctgagaaaaaaaatgctactaatcctgacgacccaacaacagctaatgatactgatagaaaagaatcaaacactactacgactcctcctgaattggattttaatattaatactgctttgcatcttctaacagcaaacacttatactgatcagtccataatggatgatagcttatcccctaattctgatgataaaagaatcaagaatgagttagtagttcttcaggctgaattggaaagaatgaatggcgaaaatcgacgattaagggatatgttaaatcaggtgaaaaacaattacaataccctgcaggtgcatatgatgacaatgatgcatcaacagcaacaaaatcaagaaagtggtcaacgtgatggaaaaaatgaagaagtaaaacatcaacaacataataatcaaaatggtcatggaggaggacaagtagtgcctaggcaatttatggatcttggcttagctgctggtgctggtggtactgcttctgaagcggaagaggcttccctgtcttcgtcagaggggccaagtggcagggaaaaatcgcgatcaccagtgaataacattgaatctagttccacatgtgggattgtaagagaagatagtcctgaaaaagtgtcacctggttggggtcctaataaaattccaagacttggtaatacctctactaataataaacctgctgatcaagctactgaggctactatgagaaaggctcgggtctcggtcagggctcgatcagaagctcccatgatcacagatggctgtcaatggcgaaagtatgggcagaaaatggctaagggaaacccgtgccctcgagcttattaccggtgcaccatggcagctggttgtccagttcggaagcaagttcaaagatgtgcagaggacagaacaatcttgatcacaacttatgaaggtactcacaaccatccgttgcctccggcagccatagcgatggcctcgacaacttcctcagcagcgaaaatgttgctctcgggctctatgccaagtgcagatgggctaatgaattccaatttcttcgcgagaactctccttccttgctcttccagcatggccacaatttcagcctcggccccgttccctactgttacattggacctaactcaatccccgaacccgttgcaattcccaagaccccctaaccaattccaaatcccattttcaaatccacctcacaacaacatcctagcaaatccagctgcacttttgcctcagatatttggacaggctttgtataaccaatccaaattctctggcctccaatcatctcaagatttagaaggacaacaacacccttcaacgatgccatcctcgattaatccatccaaccacaatcctgtagctgacacggtgaacgccttaaccagtgatcctaatttcaccgcagcattagcagcagccatcacttcacttattggcaatccggggcaaccaaacaatggtaccaacaacaccatcgccaccaccacaacgccagccaacaacaataacaacagtgtcacaagcaatggcaataacaacaacaatggcagcaacaataaagtgacgaattcgagttttccagcaaac

SEQ ID NO: 262 - protein, 631 aa, Solanum lycopersicum
  Solyc07g051840.2.1
MAKGSGLSFDPDPIKPIPIVLNSFLEPHNNQFYPKNKFFYNLTSMESSYNNRSPPPTIQFPVNLNCSTTTTHHHDHDHDHDHQDQQQHHIRPVIDEMDFFAEKKNATNPDDPTTANDTDRKESNTTTTPPELDFNINTALHLLTANTYTDQSIMDDSLSPNSDDKRIKNELVVLQAELERMNGENRRLRDMLNQVKNNYNTLQVHMMTMMHQQQQNQESGQRDGKNEEVKHQQHNNQNGHGGGQVVPRQFMDLGLAAGAGGTASEAEEASLSSSEGPSGREKSRSPVNNIESSSTCGIVREDSPEKVSPGWGPNKIPRLGNTSTNNKPADQATEATMRKARVSVRARSEAPMITDGCQWRKYGQKMAKGNPCPRAYYRCTMAAGCPVRKQVQRCAEDRTILITTYEGTHNHPLPPAAIAMASTTSSAAKMLLSGSMPSADGLMNSNFFARTLLPCSSSMATISASAPFPTVTLDLTQSPNPLQFPRPPNQFQIPFSNPPHNNILANPAALLPQIFGQALYNQSKFSGLQSSQDLEGQQHPSTMPSSINPSNHNPVADTVNALTSDPNFTAALAAAITSLIGNPGQPNNGTNNTIATTTTPANNNNNSVTSNGNNNNNGSNNKVTNSSFPAN

SEQ ID NO: 263 - DNA, 1881 bp, Eucalyptus grandis
  Eucgr.K00786.1
atggccaagggaggtggactctccattgatgatccagatccagtcggcttcttcctccaccaccaccctcccacggtcatcaactccctctccgaacaccaccaccaccaccaccacaacaagcgcaagctgcttccttcatcctcctccatggaccatcatcctcaccatcaccagcatgttcacgccgccacagtcaacgtgtccgcagcccctcccgccaccatccagttccctctcaacctcatgtctcgccgggactcttctccgccgccgccgccgccgccgccggcagcggacgagaggcgggcggtcatcgacgagatggacttcttctccatcaagaacaacagcgaagccgctgccaagaacgtcatctcgtcgtctgatgacggtggcgctcgaaaggacatgaccgacggacccaccaatcttgatttcaatgtaaacactggtctgaatcttctgacgacgaatactagcagcgatcaatccatggtggatgatgggatatcaccaaactcagaagataaaagagctaagaatgagctagccgttcttcaagccgaggttgagcggatgagcaatgaaaatcaacggttgaaggacatgctaagccaagtgaccaccaattacagtgctctacagatgcatctgcttgcagtgatgcaggatcagaaacccgagaactcctccgatgaaaacaggaaatcggacgagaagaaagaaaacagcatgctgatggtgcctaggcagttcatggatcttgggctcgccacagcgaataactcagactcgccttcttcatcagaaggagggactcgtgatcggacggggtcgccggtgaataacaacagagagcctgctgaagtcggcatggggttggatccagataagaaggaatccgcgagtgggaggcacaagagagaagagagtccagatcaagaatctcttcccatcaaggtccccagatcaatcagcccgtcaaagagcgttgatcagacagaggccacgatgaggaaggcgcgcgtctcggtcagggctcattccgaggctcccatgatcactgatggatgtcaatggcggaagtacgggcagaagatggcgaaagggaatccatgcccacgagcctactatcgatgcaccatggctgccggttgcccggtccggaaacaagtacaaagatgtgcagaggatcggtccgtgctcatcaccacatatgagggcaatcacaaccacccattacctcccgccgccatggcaatggccgcgacaacctcctcagcggctcggatgttgctgtccgggtcaatgccaagcggcgaagggctgatgaacaccaattttctcaccagaacactccttccatgctcttccagcatggcaactatatcagcttcagccccattccctactgttacactggacttaactcaaaaccccaacacattacagtctcaggcttcaccgggccaattccaggtcccattcccgaacccaggctcgagcttgcccaaccattcggctgctttgctacctcagatctttggccaggctctgtacaatcagtccaagttctctggccttcaaatgtctcaggatgcaaaggcatgccgattggaaggccaaccccaattgccacagccaccaggtcaaggccagccgaatagcatcttcaccaccgacacgctaagtgcggccactgccgccatcgcaaccaatccaaatttcaccgctgccctagctgcagcgatctcctccataatgggcggctcgaatccaagcgggagcagcggcatgtcgagcctcgtgccatctggcgcaaataaccgaagcaatagcagcagcaataactgtagcaatgacaacaaaatcagcagt

SEQ ID NO: 264 - protein, 627 aa, Eucalyptus grandis
  Eucgr.K00786.1
MAKGGGLSIDDPDPVGFFLHHHPPTVINSLSEHHHHHHHNKRKLLPSSSSMDHHPHHHQHVHAATVNVSAAPPATIQFPLNLMSRRDSSPPPPPPPPAADERRAVIDEMDFFSIKNNSEAAAKNVISSSDDGGARKDMTDGPTNLDFNVNTGLNLLTTNTSSDQSMVDDGISPNSEDKRAKNELAVLQAEVERMSNENQRLKDMLSQVTTNYSALQMHLLAVMQDQKPENSSDENRKSDEKKENSMLMVPRQFMDLGLATANNSDSPSSSEGGTRDRTGSPVNNNREPAEVGMGLDPDKKESASGRHKREESPDQESLPIKVPRSISPSKSVDQTEATMRKARVSVRAHSEAPMITDGCQWRKYGQKMAKGNPCPRAYYRCTMAAGCPVRKQVQRCAEDRSVLITTYEGNHNHPLPPAAMAMAATTSSAARMLLSGSMPSGEGLMNTNFLTRTLLPCSSSMATISASAPFPTVTLDLTQNPNTLQSQASPGQFQVPFPNPGSSLPNHSAALLPQIFGQALYNQSKFSGLQMSQDAKACRLEGQPQLPQPPGQGQPNSIFTTDTLSAATAAIATNPNFTAALAAAISSIMGGSNPSGSSGMSSLVPSGANNRSNSSSNNCSNDNKISS

SEQ ID NO: 265 - DNA, 1740 bp, Glycine max
  Glyma06g46420.1
atggttagaggtggtggactccaatccatggattcagatccaattgggagcttcttcctccacaagccaattgttctcaactctttcccagctgaagacacaaacaacaagtggaaaaaacttagtctccaccacaacatggatgccacagctagcaataccaaagataacaccatcccctttcaagtcagccttagatgttctccaaacaatcatgatgatgcctcttcaccaccatctctccacaacaacagaaccgagatggacttattctccgacaagaatagtaccaaagatgatgacaacaacaacaacaaggttgatgcttctgcctctctccccgacaatgatcatcattccaccactccacccacgttggaattcaaactaaacactggtggtctaaatcttcttactaccaacactaacagtgaccaatctatggtggatgatgagatatcacccaattcagaagacaaaagagctaagaatgagatggctgttcttcaagctgatcttgaaagaatgaagagggagaatcaaaagttgagggactcgcttgatgaggttaccaccaattacagcgcgcttcagatgcattttatgaatctgatgcaagagcgaaagggagaggaaggtgaagaagaacaagaagaagtgtatggtggagagaagaagcagcaattaggtgagagtggtggtgatgggatattagttccaaggcagtttatggatcttgggttggctgctaataatggtactagcactggtattgaaccctcttcttcatcaggaggaagaagccaagatcgatcaagatcacccaacgtagaagtggcttccaaggaattagggacaaatgatgaagaagagaagaaagagtatggtagagggatagagagagaggatgatagtccctcagggcatgctcataaagttccaaggttcagtcctccaaaggataataatagtgttgaggctgaggctactatgaggaaggcaagagtttctgttagagctcgatcagagacacccatgattgctgatgggtgtcaatggagaaagtatgggcagaaaatggccaaaggaaacccatgtcctagagcttattataggtgtagcatggcatcggcttgcccagttagaaaacaggtacaaaggtgtgctgaagatagaacagtccttatcacaacctatgaaggaaatcacaaccaccctttgcctccaacagccatggcaatggcacaaaccacatcctcagcagcaagaatgctgctttctggatcaatgtcaagtgctgacagcataatgaatgcaaacttcctcacagggacactccttccttgctcttcaagcatggccactatctcagcatctgctccattcccaactgttacattagacctaactcattctccaaaccctctacagttcccaaggcagcagcatccaaaccagttgcagattggtgtccctcagaataattttgcaaactccccggcagcatctttactgcctcagatatttggacaagcactgtataacaaccaatcaaagttttctggcctacaaatgttgttccaccacaccttgctgacacagttggtgctgccattgctactgacccgaatttcactgcagcattggcagcagctatcacttccattattggtggtgctccgctacaacacagcaacagtagtaataataataatagtaacagtaacaataaaggcaaca

SEQ ID NO: 266 - protein, 580 aa, Glycine max
  Glyma06g46420.1
MVRGGGLQSMDSDPIGSFFLHKPIVLNSFPAEDTNNKWKKLSLHHNMDATASNTKDNTIPFQVSLRCSPNNHDDASSPPSLHNNRTEMDLFSDKNSTKDDDNNNNKVDASASLPDNDHHSTTPPTLEFKLNTGGLNLLTTNTNSDQSMVDDEISPNSEDKRAKNEMAVLQADLERMKRENQKLRDSLDEVTTNYSALQMHFMNLMQERKGEEGEEEQEEVYGGEKKQQLGESGGDGILVPRQFMDLGLAANNGTSTGIEPSSSSGGRSQDRSRSPNVEVASKELGTNDEEEKKEYGRGIEREDDSPSGHAHKVPRFSPPKDNNSVEAEATMRKARVSVRARSETPMIADGCQWRKYGQKMAKGNPCPRAYYRCSMASACPVRKQVQRCAEDRTVLITTYEGNHNHPLPPTAMAMAQTTSSAARMLLSGSMSSADSIMNANFLTGTLLPCSSSMATISASAPFPTVTLDLTHSPNPLQFPRQQHPNQLQIGVPQNNFANSPAASLLPQIFGQALYNNQSKFSGLQMLFHHTLLTQLVLPLLLTRISLQHWQQLSLPLLVVLRYNTATVVIIIIVTVTIKAT

SEQ ID NO: 267 - DNA, 1683 bp, Glycine max
  Glyma12g10350.1
atggattcagatccaattgggagcttcttcctccataagccaattgttctcaactctttctcagctgaagacacaaacaaccacaaccccgagtggaaaaaactcagtcttcacaacaacaacatggatgccacagttaccacaaaagactacaccatccccttccgaatcaaccttagctgttcttctgcagacaatcatgatgatgtctcttcaccaacatctctccgtagcagaaccgagatggacttcttctccaacaagaacagtaccaaagatgatgacaacaacatcgttgctgcggctggttctgcctctctccccgacaatgatcatcattccatctctccacccacgttggatttaaaagtaaacacttgtctgaatcttcttactaccaatgctagtagcgatcaatctatggtggaagatgagatatcacccaattcagaagacaaagaaactaagaaagagatggctgatcttcaaggtgatcttgagagaatcaaaagggagaatcaaaagttgagggacacgcttgatgaggttaacaccaactacaacgcgcttcagatgcactttatgaatatgatgcaggagcggaagggcgaggaaggtgaagatcagcaagaagtgtctgatggcaaggttaaagagaagaagcagggtcagagtggtggtggggtattggtgtcaaggcagtttatggatcttgggttggctagcgctgatattgaaccctcatcttcatcagggggaataagaaaagagaaggagtatgatagagggattgagagcgaagatagtccttcagggcatgctgataaagttccaaggttcagtagtccttcaaagaataataatgttgatcaggctgaggctgaggctactatgaggaaggcaagagtttctgttagagctcgatccgaagcacccatgattactgatgggtgtcaatggagaaagtacgggcagaagatggccaaaggaaacccatgtcctagagcttattatagatgtaccatggctgctggttgcccagttagaaaacaggtacaaaggtgtgctgaagaccgaacagtccttatcacaacctatgaaggaaatcacaaccatcctttgcctccaacagcaatggcaatggcacaaaccacatcctcagcagcaagaatgttgctttctggatccatgtcaagtgctgacagcataatgaatgcagacttcctcacaaggacactccttccttgctcttcaagcatggccactatctcagcatctgctccattcccaacagttacattagacctaactcattctccaaaccctctacagttcccaaggcagcagcatccaaaccagttgcaaattggtgtccctcagaattttgcaaactccccatcatctttaatgcctcagatattcggacaagcactttacaaccaatcaaagttttctggcctacaaatgtcatcacatgatacagcagacccttcttcacaatttgttggtgctgccattgctactgatcccaatttcacttcagcattggcagctgctatcacttccatcattggtggtgctcagcaacaacacagcaacattaataataatagtaacaataatgtcaacatgacagccaacatcaacaatggcaatggcaacagcaatggcaacggaaagcaa

SEQ ID NO: 268 - protein, 561 aa, Glycine max
  Glyma12g10350.1
MDSDPIGSFFLHKPIVLNSFSAEDTNNHNPEWKKLSLHNNNMDATVTTKDYTIPFRINLSCSSADNHDDVSSPTSLRSRTEMDFFSNKNSTKDDDNNIVAAAGSASLPDNDHHSISPPTLDLKVNTCLNLLTTNASSDQSMVEDEISPNSEDKETKKEMADLQGDLERIKRENQKLRDTLDEVNTNYNALQMHFMNMMQERKGEEGEDQQEVSDGKVKEKKQGQSGGGVLVSRQFMDLGLASADIEPSSSSGGIRKEKEYDRGIESEDSPSGHADKVPRFSSPSKNNNVDQAEAEATMRKARVSVRARSEAPMITDGCQWRKYGQKMAKGNPCPRAYYRCTMAAGCPVRKQVQRCAEDRTVLITTYEGNHNHPLPPTAMAMAQTTSSAARMLLSGSMSSADSIMNADFLTRTLLPCSSSMATISASAPFPTVTLDLTHSPNPLQFPRQQHPNQLQIGVPQNFANSPSSLMPQIFGQALYNQSKFSGLQMSSHDTADPSSQFVGAAIATDPNFTSALAAAITSIIGGAQQQHSNINNNSNNNVNMTANINNGNGNSNGNGKQ

SEQ ID NO: 269 - DNA, 1842 bp, Glycine max
  Glyma13g38630.1
atggcaagagggggtggactctccattgattcagatccaattgggagcttcctcccccacgagccaatagtcttaaactccttccctgaagacaacaaagacaacaacaacagtcgccaacaacacaagtggaaacttggtacaaacatggatgccactgttagcagaaagagttctccatcatccacttctaacactaacaccaccatccccttccaagaccaccttacctctgatgacaagatgcctcacctcgacgagatgaacttcttccccaacaaaagcaacaaggatgatgacgatgacaacaaccttgcctctgcctccacctctgcacctccctcccttgaccaccttcatcacacacatgatcattcctccgctatcttgggattgaaagtaaacactggtttgaatcttcttactaccaatgcaagcagtgatcaatctatggtggtggacgatgacatatcccctaattcaggagacaaacgagctaagagtgagatggttgttcttcaagttgagcttgagagaatgaaggtggagaatcataggctgaagaacatgcttgatcaggttaacaacaattacaatgccttgcagacgcatttggtgagtttgatgaaggaccagatggacaaggaggatgataaacaacaaccgcatcaagtgtttgatggaaaactagaagagaagcaagctgggaatggtggtggagccttggtgccaagacagtttatggatcttggattggccactaatgctgacaccaatgaaacttcgcattcccattcttcgtccgtgataagaagtcaggattcaccaccaacaaataatacagaggtggcatccaagaagaatgggggtgctagtgatgaaggactagtgtttgatcaagacaagaaggaatttggtaggggaattgagagagaggatagtccctcggatcaaggggtagctgctaataacaatgttccaaagtttagtcctccaagaaatgttgatcaagctgaggccaccatgaggaaggctagagtttctgttagagctcgatcagaggcacctatgataactgatgggtgtcaatggcgaaagtatgggcagaagatggccaaaggaaacccatgtcctcgtgcatattatagatgtaccatggcagcaggttgcccagtgagaaaacaggtgcaaaggtgtgctgaagacagaacaatactgatcacaacatatgaagggaatcacaaccaccctttgcctccagcagctatggcaatggcacaaaccacttcctcggcagcaagaatgctgctttcaggatcaatgtcaagtgctgatggcctaatgaatgcaagcttcctcacaaggacactcctcccttgctcttctagcatggcaactatctcagcctcagctccattcccaactgttacattggacttgactcagtctccaaatccattgcagttcccaaagcaaccaagccaattccaaatccccttccctggtgtccctcagaactttgccaattcacaagcctcattgctgcctcagatatttggtcaggcactttataaccaatccaagttttctggccttcaaatgtctcaagattcagacccttcccaattgagtaatcaatctcaaaggccaccaccacaccttgctgacacagttagtgctgccattgcagctgatccaaacttcactgcagctttggcagcagccatcacttccattattgggggtgcacagccaaacaacaatagtactaccagtactaattataatggcaccacatcgaccaacaccagcaatggcaatattacatcaagcaacaacaaa

SEQ ID NO: 270 - protein, 614 aa, Glycine max
  Glyma13g38630.1
MARGGGLSIDSDPIGSFLPHEPIVLNSFPEDNKDNNNSRQQHKWKLGTNMDATVSRKSSPSSTSNTNTTIPFQDHLTSDDKMPHLDEMNFFPNKSNKDDDDDNNLASASTSAPPSLDHLHHTHDHSSAILGLKVNTGLNLLTTNASSDQSMVVDDDISPNSGDKRAKSEMVVLQVELERMKVENHRLKNMLDQVNNNYNALQTHLVSLMKDQMDKEDDKQQPHQVFDGKLEEKQAGNGGGALVPRQFMDLGLATNADTNETSHSHSSSVIRSQDSPPTNNTEVASKKNGGASDEGLVFDQDKKEFGRGIEREDSPSDQGVAANNNVPKFSPPRNVDQAEATMRKARVSVRARSEAPMITDGCQWRKYGQKMAKGNPCPRAYYRCTMAAGCPVRKQVQRCAEDRTILITTYEGNHNHPLPPAAMAMAQTTSSAARMLLSGSMSSADGLMNASFLTRTLLPCSSSMATISASAPFPTVTLDLTQSPNPLQFPKQPSQFQIPFPGVPQNFANSQASLLPQIFGQALYNQSKFSGLQMSQDSDPSQLSNQSQRPPPHLADTVSAAIAADPNFTAALAAAITSIIGGAQPNNNSTTSTNYNGTTSTNTSNGNITSSNNK

SEQ ID NO: 271 - DNA, 1839 bp, Populus trichocarpa
  POPTR_0002s21330.1
atggccaaaggaagtggtggactctccattgattcagatccaatcgctaccagtggctactttctacacaaatcaactgtgctcacttctttccctgaagagaacatcaatcccaagtggaaacatcttgctgcaactagcgcgagacaatccatggatgtcaaagcgaatagatctcctccttctactttccaattccctgtcaaacttataaacaccaatgaacatgaccacgatcatgatcctgattcttctttgccatctgataatagacgacggacagtcatcgatgagatggacttttttgctgacaagaaacatgatgttgatcgcatgaccatcataaacaatggtactggtgatttaaaagactctggaagtcccgctggattggagctaaacgtcaacactggtttgaatcttcttactaccaatactagcagcgaacaatcgactgtggatgatggcgtatcgtcgaacatggaagataaaagagccaagagtgagctagcagttctgcgagctgaggtagaacgaatgaaagtggagaatctacggttgaaaggcatgttaaatcatgttactagtaattacaatgcattgcagatggatttagttacacttatgcaggaccaaaattctcatcacaagaatgaacagcgtgatggcaaaaacaaagatgatggggtagttccaaggcagtgtatggatcttggtctagttgctgctgcgggtggcgatgacacggatgaccattctctatctacatcagaaggaggaaggaggcgtgatcgatcaagatcatctggaaataatgcagagaataacaatgaagatgggacagtctttgaacaagataagaaaggaaccgatcaacgagaggagagcccagatcaaggttggggctctaataaggctgctagatttaactcgacgaaaactgttgatcaaacggaggctacaataaggaaggctcgtgtgtctgttcgagctagatcagaggatgctacgatatcggatggatgccaatggcgaaagtatggacagaagatggcaaaaggaaatccatgtcctcgagcttattatcggtgcaccatggctgctggttgcccagtacagagatgcgcagaagatcggaccatcctcacaactacatacgagggtaaccacagccaccctttgcctccggctgccacggcaatggcatcaaccacatcatcggcggcaagaatgctgttgtcaggctccatgtctagtactgatggactgatgaactcaaatttccttaccagaacgatcctcccatgctcctctagtcttgccactatatctgcttcagctccatttcctactgttacattggacctaacccaaaatcccagccctctacagctcccaaagcaaccaattcaatttcaattcccatttccaaacccacctcaaaatcttgccaccgcttcagctgcagcattgctgcctcagattcttggacaagcactctacaatcaatcaaagtcctttggcctgcaaatgtctcaagaaatgcagcctaatcgattggaccaccaatcacaacctgcattgcagcaggggcagaaaaattcattggctgacagcttgaccacagcaactgctgccattgcagctgatcctaacttcactgcagctctagcagcagcaattacctcgataattggtggggctcaccaaaacaacattaatagtattaataacgttcagacaacgaccagcaacaacaatagcaatggcaacataactaccagcaacaacaatagctatggtcacaataaaattaccaattcaagttttccgagcgat

SEQ ID NO: 272 - protein, 613 aa, Populus trichocarpa
  POPTR_0002s21330.1
MAKGSGGLSIDSDPIATSGYFLHKSTVLTSFPEENINPKWKHLAATSARQSMDVKANRSPPSTFQFPVKLINTNEHDHDHDPDSSLPSDNRRRTVIDEMDFFADKKHDVDRMTIINNGTGDLKDSGSPAGLELNVNTGLNLLTTNTSSEQSTVDDGVSSNMEDKRAKSELAVLRAEVERMKVENLRLKGMLNHVTSNYNALQMDLVTLMQDQNSHHKNEQRDGKNKDDGVVPRQCMDLGLVAAAGGDDTDDHSLSTSEGGRRRDRSRSSGNNAENNNEDGTVFEQDKKGTDQREESPDQGWGSNKAARFNSTKTVDQTEATIRKARVSVRARSEDATISDGCQWRKYGQKMAKGNPCPRAYYRCTMAAGCPVQRCAEDRTILTTTYEGNHSHPLPPAATAMASTTSSAARMLLSGSMSSTDGLMNSNFLTRTILPCSSSLATISASAPFPTVTLDLTQNPSPLQLPKQPIQFQFPFPNPPQNLATASAAALLPQILGQALYNQSKSFGLQMSQEMQPNRLDHQSQPALQQGQKNSLADSLTTATAAIAADPNFTAALAAAITSIIGGAHQNNINSINNVQTTTSNNNSNGNITTSNNNSYGHNKITNSSFPSD

SEQ ID NO: 273 - DNA, 1872 bp, Populus trichocarpa
  POPTR_0014s15320.1
atggccaaaggaaggggtgtgctctccattgattcagatctaataagcactactagtgccttctttctacacaaaccaactgtgctcaattctttccctgatcaagagaacatcgtgaatcccaagtggaaacaacttgctactactggtagacaaaccatggatgccacatctgctaggtctcctcctactactatccagtttcctgtcaaacttataaacaccaatgacgcccgtgatgatgatgatgatgaagatgatgatgatgatgattcttctttcccatctgataatagacgacggacggtcatcgacgagatggacttttttgctcgcaagaaacatgatgatggttatcccatcaccaacaatagcactgatgatttgaaagactctggaagtcctactggattggagctaaacgtcaacacaggtttgaatcttcttactactaatactagcagtgaccagtcgatggtggatgatgggatatcgtcgaacatggaagataaaagagctaagagtgagctagcagttctccaagctgaggtagaacgaatgaaagtggagaatctacggttgaaagacatgttaaatcaggttactagcaattacaatgcattgcagatgcatttagtaacacttacgcaggaccaaaagtctcatcacaagaatgaaaaacttgatggcaaaaataaaaataatgggatggttccaaggcagtttatggatcttggtctagttgctgctgctgctgctggtgacaccgatgacctttctctatctacatcagaaggaggaaggagccgtgatcgatcgagatcacctggaaataatgtagagaataataatgaagatggggcactagtgtttgatcaagataagaaggggtttgctaggggagctgatcatagagaggatagcccaggtcaaggctgggcctctaataaggttgctagacttaactcggcgaaaactattgatcaaacggaggctacaataaggaaggcccgtgtgtctgttcgagctagatctgaggatgccatgatatcggatggatgtcaatggcggaagtatggacagaagctggcaaaaggaaatccatgtcctcgagcttattatcggtgcaccatggccgctggttgcccagttcgaaaacaggtacaaagatgtgcagaagatcgaaccatcctcataactacatacgagggcaatcacaaccaccctttgcctccggccgctatggcaatggcatcaaccacatcatcagccgcaagaatgttgttgtcaggctccatgtcaagtgctgatggactattgaactcaaatttccttaccagaactcttctcccatgctcctctaatcttgctactatatcagcttcagccccattccctacagtgacattggacctaacccaaaatcccaaccctctacagctcccaaagcaaccaactcaatttcaatttccatttccaaacgcacctcaagatcctgccaatgcttcagctactgcattgctgcctcagatttttggacaagcactttacaatcaatcaaagttctccggcctacaaatgtctcaacacatggaacctaatcgattgggccaacaatcacaacctgcaatccagcaaaatccattggctgacagtttggccgcagcaactgctgccattgctgctgatcctaacttcacagcagcgctagcagcagcaattacctcaataattggtggtgctcaccaaaacaacgttaatagtactaataacgctcagacaacaaccagcaacagcaacggcaacataactatcagcaacagcaatagcaatgggcacaataaaactagcaattcaagttttcctggcaat

SEQ ID NO: 274 - protein, 624 aa, Populus trichocarpa
  POPTR_0014s15320.1
MAKGRGVLSIDSDLISTTSAFFLHKPTVLNSFPDQENIVNPKWKQLATTGRQTMDATSARSPPTTIQFPVKLINTNDARDDDDDEDDDDDDSSFPSDNRRRTVIDEMDFFARKKHDDGYPITNNSTDDLKDSGSPTGLELNVNTGLNLLTTNTSSDQSMVDDGISSNMEDKRAKSELAVLQAEVERMKVENLRLKDMLNQVTSNYNALQMHLVTLTQDQKSHHKNEKLDGKNKNNGMVPRQFMDLGLVAAAAAGDTDDLSLSTSEGGRSRDRSRSPGNNVENNNEDGALVFDQDKKGFARGADHREDSPGQGWASNKVARLNSAKTIDQTEATIRKARVSVRARSEDAMISDGCQWRKYGQKLAKGNPCPRAYYRCTMAAGCPVRKQVQRCAEDRTILITTYEGNHNHPLPPAAMAMASTTSSAARMLLSGSMSSADGLLNSNFLTRTLLPCSSNLATISASAPFPTVTLDLTQNPNPLQLPKQPTQFQFPFPNAPQDPANASATALLPQIFGQALYNQSKFSGLQMSQHMEPNRLGQQSQPAIQQNPLADSLAAATAAIAADPNFTAALAAAITSIIGGAHQNNVNSTNNAQTTTSNSNGNITISNSNSNGHNKTSNSSFPGN

SEQ ID NO: 275 - DNA, 1494 bp, Vitis vinifera
  GSVIVT01030453001
atggccaaaggcagtggactctcctttgggtcagatccaatcttcttccttcacaaaccaatagttataaattcatttccggaggatcacagcaagaggtttgcggccatggatgccactaaaaaccagtccactaccactattcaattcccagtcaacctcaactgtgctcacccagattctccggttcccgacgacgaaaagcccagaattgtcgatgagatggacttttttgctgataaaaaccgcgactccaagccacccactacagataacaagaactctccctattatttcaatgtaaacactggcttgcaccttcttactgctaataccagcagcgatcagtccatggtggatgatgggatgtcgcccccgaacgtggatgacaagcgagttaagaatgagctggtggttcttcaagctgagatcgagcggatgcacgcagagaatgagcgattgaggagcatgctgaaccaggttactaacaactacaacgcactccaggtgcatatggtggcactgatgcaagatcagaaggcggagaacaatgaagaacatgatcagaagcatagtggtaataataacggaggagttgtggtgcctagacagtttattgatcttggccttgctgctaaagctgaagtcgaagagccttcgctgtcttcatcagaaggaaggagcggtgaccgatccggatcacccataaacaacggagaagtgggttcgaaggagttggagctgaggaagaatgagaagaaggaatacagcagtggaattggaagagaagaaagcccagatcaaggatcccaatggggagctaacaaggttcccaggttgaatccctccaaaaatgttgatcaaaccgaagcaaccatgaggaaagcccgtgtctcagttcgagcacgatctgaagcacctatgatcactgatggatgccaatggaggaagtatgggcagaagatggcaaagggaaatccatgccctcgagcttattatcgatgcaccatggctgcaggttgtccggtccgcaaacaagtgcaaagatgcgcggaggatcggagtattctcatcaccacatatgaaggtaatcacaaccacccactgccgcctgctgccatggcaatggcgtcgaccacttcgtctgcagcgcgaatgctactgtccgggtcaatgcccaccccattccctactaacctcgccgggccggccgctgcaacaccctcttcactgctgcctcaaatcttcaatcaagccctttacaatcagtcaaatgcagcaactgctgccattacagctgaccccaacttcactgcagcactagcggctgccatcacctccattattggtggtgctcaacctcaaccaaacagtagtactaacaataacgccaacaccacagtccccaccaccagcaacagtggcaacattactactagcaacagcaatagtaatggcagcaacaaactctgcaattcaaaatttccagggaac

SEQ ID NO: 276 - protein, 498 aa, Vitis vinifera
  GSVIVT01030453001
MAKGSGLSFGSDPIFFLHKPIVINSFPEDHSKRFAAMDATKNQSTTTIQFPVNLNCAHPDSPVPDDEKPRIVDEMDFFADKNRDSKPPTTDNKNSPYYFNVNTGLHLLTANTSSDQSMVDDGMSPPNVDDKRVKNELVVLQAEIERMHAENERLRSMLNQVTNNYNALQVHMVALMQDQKAENNEEHDQKHSGNNNGGVVVPRQFIDLGLAAKAEVEEPSLSSSEGRSGDRSGSPINNGEVGSKELELRKNEKKEYSSGIGREESPDQGSQWGANKVPRLNPSKNVDQTEATMRKARVSVRARSEAPMITDGCQWRKYGQKMAKGNPCPRAYYRCTMAAGCPVRKQVQRCAEDRSILITTYEGNHNHPLPPAAMAMASTTSSAARMLLSGSMPTPFPTNLAGPAAATPSSLLPQIFNQALYNQSNAATAAITADPNFTAALAAAITSIIGGAQPQPNSSTNNNANTTVPTTSNSGNITTSNSNSNGSNKLCNSKFPGN

SEQ ID NO: 277 - DNA, 1287 bp, Citrus clementina
  clementine0.9_010887m
atgagtgtcgaaaatcaacgtttaagatccctgcttaatcaagttaacaatgactatcgtgcattgcaattgcatctctgtgcacttacgcagcgcgaaccgactggaaaattagctggaagcacagcaggccgtgagatgataaatgacgaaaacgttggtgttgcacgacaatttatggatctgggtcaagctggaaaagacgatcataaagtttcgttatgtaattcttcggaggatacaacaagatttagggaatttaagattgttgagtcgatggaagcacgaagtgatgatgaaattgttgcattggatgatcatcaaatgggtaagaggaacatcagtgacagaactgaaagagaagtaaccccagatgatggtcaacgagctaaaaaagttgcaaggtttaataataataattcatcaagagatgttgaacaagctgcttcacagtcacagaccacgtccttgatcagaagagctcgtgtctcagttcgtgctcgatcagaagcatccatgatctctgatggatgtcaatggagaaagtatggacaaaaaatggctaaaggaaacccttgccctcgagcttattatcgctgcaccatggcttctggttgtcccgtccgcaaacaagtacaaagatgctcgcaagaccgaacaatacttatgactacttacgaaggcaatcacaaccatccgctgcctccggcggccatgtcaatggcatcaaccacatcagctgctgcgtcgatgctgctttcgggatcaatgccaagtgcagatggcctaatcatgagcccaaatttattagccaaaaataatgtactacccttctcaccaagctcggcatcactttctgcttctgcaccgtttcctactgttacattagacctcactcacagtccaaatcctttacaatttcaaaggccactggggcaattccatttcacttctccaaataacttgccacacaattttgtgcccatgtcacacggtcttggtccggctcttattgataataattatcaatcaaatttcttagggctgctgagctctctgggattggagcatccatatgattcggctcaaaatcggatccaagcagcctcgctgatcagtgacaacatcagtgcagcaacggccgccattacgtcggatccaggcttcactgcagctctagtatcagccatcgcctccattataggcaataatgatcaccaaaaccacaatggtaacaacaacagccctagtactgctagaaacaccagcgagaagatcgaacagtct

SEQ ID NO: 278 - protein, 429 aa, Citrus clementina
  clementine0.9_010887m
MSVENQRLRSLLNQVNNDYRALQLHLCALTQREPTGKLAGSTAGREMINDENVGVARQFMDLGQAGKDDHKVSLCNSSEDTTRFREFKIVESMEARSDDEIVALDDHQMGKRNISDRTEREVTPDDGQRAKKVARFNNNNSSRDVEQAASQSQTTSLIRRARVSVRARSEASMISDGCQWRKYGQKMAKGNPCPRAYYRCTMASGCPVRKQVQRCSQDRTILMTTYEGNHNHPLPPAAMSMASTTSAAASMLLSGSMPSADGLIMSPNLLAKNNVLPFSPSSASLSASAPFPTVTLDLTHSPNPLQFQRPLGQFHFTSPNNLPHNFVPMSHGLGPALIDNNYQSNFLGLLSSLGLEHPYDSAQNRIQAASLISDNISAATAAITSDPGFTAALVSAIASIIGNNDHQNHNGNNNSPSTARNTSEKIEQS

SEQ ID NO: 279 - DNA, 1521 bp, Eucalyptus grandis
  Eucgr.F00740.1
atggatgggagccggcatggcgccgtctctgcagcggtggcagcgacatcggctgccggacgtgaagatagagtgtttaacgagttgaacttcttcgccattgacaaaagctcgagagaagaagcgagctccgcatccgcagtcaagagcgagaacgtggaggagagtgtagaggaggataaggagatgaaactcaatacgggattgaatcttctcacagagaatatcggtagcgacaaatcgcttgttgatgaagaagcaccaggcaatgaacagaggtgcctgaacttaactgagatggcagtcttgaaagctgaattagacaggatgaacatggaaaatcaacgcctgaagagcatgatttatcaggtcaacaacaactgccatgccttgcaaggccacctcctttcattaatgcaaaggcatggggcgaatcctccagccgagaccgccgattctgacaaggtatttgtcaacgtgaatggaagaacgttagaggatcgcgagaaattccccggaaaggatgagaattcacaatcattttctggagataaaacacgggatggcttggggtcgcctcataacaatatagtggagtcgatggagtacttcaagacgccaagggaaagctctgcgaacgaagtcacgccgttccgagatcctaacaaaagtgaatccattgatcatagacagaggagggatgatgctccatggtctccgactaaagtgcagaaaatcggttcctccgccgatcaagcagctgaaaccatggccatgattaagaaagcccgggtgtcggttcgagcacgctcggaggcagccatgattgcagacggctgtcagtggaggaagtatgggcaaaagatggcaaaaggaaacccatgccctcgagcttattatcgctgttctatggcgatcggctgtccagttcgcaagcaggtacaaagatgtgcagaagacaaaacaatcctagtaacaacatacgaaggacagcacaaccacccgctcccccaagctgcagtggccatggcatcaaccacttcgtcggctgcatcgatgattctctcgggttcaatggcaagttcagatgggatgatggccaactcgcattacatcaccggaacagcatcgtttcccggttcactgccgagcctggccacgctctccgcgactgcaccgtttcctaccgtcacattggacctcacacacaccgctcccactaatgataccattaccaaccccatgaagcttcaaaggccgttgttcttgggttccgccatgcaaagccaagtaggttacgccttaaaccagtctgaacttcttcaagtgttgagcaatcagatgaaccaagccccgtctgatatggccaacacgggtggcacgacggcagccatcacagcagacccgaacttcacggcagctctcgtggcggctattgcctcagttgtgggcggcattcatccgaaccatggcggtgctagtgacgatgtcatcacaagaagtcgcatcaatgagaataca

SEQ ID NO: 280 - protein, 507 aa, Eucalyptus grandis
  Eucgr.F00740.1
MDGSRHGAVSAAVAATSAAGREDRVFNELNFFAIDKSSREEASSASAVKSENVEESVEEDKEMKLNTGLNLLTENIGSDKSLVDEEAPGNEQRCLNLTEMAVLKAELDRMNMENQRLKSMIYQVNNNCHALQGHLLSLMQRHGANPPAETADSDKVFVNVNGRTLEDREKFPGKDENSQSFSGDKTRDGLGSPHNNIVESMEYFKTPRESSANEVTPFRDPNKSESIDHRQRRDDAPWSPTKVQKIGSSADQAAETMAMIKKARVSVRARSEAAMIADGCQWRKYGQKMAKGNPCPRAYYRCSMAIGCPVRKQVQRCAEDKTILVTTYEGQHNHPLPQAAVAMASTTSSAASMILSGSMASSDGMMANSHYITGTASFPGSLPSLATLSATAPFPTVTLDLTHTAPTNDTITNPMKLQRPLFLGSAMQSQVGYALNQSELLQVLSNQMNQAPSDMANTGGTTAAITADPNFTAALVAAIASVVGGIHPNHGGASDDVITRSRINENT

SEQ ID NO: 281 - DNA, 1044 bp, Glycine max
  Glyma02g46280.1
tttatagctttgttaactgaattggaccaaatgaatgctgagaatcaacgcttaagagagttggttgatcaggtgaacaataactgcaacaccctacgcatgcaacttgtcaagctaacacagaagcatcatagccatgggatctggcatttgatcacatatatattcaatgctgaaaacatgtataataacggagtgataggggaaaaagaagatatggttccaaggtcatttttagacattggtgttgctgagaaggatgagcctaattcccagcaatcttctgagggaaaactgagagaaagcaaaagcatggttgaggaaagtacaaaagctagaatggaagggaggcagataagtactgaacaagaattctctaacaaagttcctagattggatccagcttcagaaaccatgtcaatgatcaagaaagctcgtgtgtcagttcgagcaaaatcatattcttcaatgattgcagatggatgccaatggagaaagtatgggcagaagatggcgaaagggaatccttggccaagagcctattatcgttgcacaatgagtactggttgtccagtgcggaaacaggtacaaaggtgtgctgaagacagaagtgtgctgatcacaacatatgaagggcagcataaccatccactccctcccacaacatctgtagctgcctcaatgccaagcatattagaaagtgcttcacttccatgctctcggaacatggcaactctctctgcctcagccccatttcccaccatcacattggacctcactcaaaatgcaaccaattcctcacagctacaaagggaattaccactgggccaacttggcctcctatccccacttttggctcataagttcatgtcagtccctaaaatatttggacagggaatggacacaaattcatcgtttgctaacatattaaatgcagccactgcagaccccaatttcactgcagctcttgtggcagctataacatctgtcatgggaacttcacattcaaacaccaatgccaccaatagtacaagtggagatgag

SEQ ID NO: 282 - protein, 348 aa, Glycine max
  Glyma02g46280.1
FIALLTELDQMNAENQRLRELVDQVNNNCNTLRMQLVKLTQKHHSHGIWHLITYIFNAENMYNNGVIGEKEDMVPRSFLDIGVAEKDEPNSQQSSEGKLRESKSMVEESTKARMEGRQISTEQEFSNKVPRLDPASETMSMIKKARVSVRAKSYSSMIADGCQWRKYGQKMAKGNPWPRAYYRCTMSTGCPVRKQVQRCAEDRSVLITTYEGQHNHPLPPTTSVAASMPSILESASLPCSRNMATLSASAPFPTITLDLTQNATNSSQLQRELPLGQLGLLSPLLAHKFMSVPKIFGQGMDTNSSFANILNAATADPNFTAALVAAITSVMGTSHSNTNATNSTSGDE

SEQ ID NO: 283 - DNA, 786 bp, Glycine max
  Glyma08g43260.1
catgagagtccagctgatcacaaagctctttggggggatgttgatcaagcatcagaaaccatgtcaatgatcaagaaagctcgtgtatcagttcgtgcaagaacagattcatctatgatatcagatggatgtcaatggagaaagtatggacagaagatggcaaaagggaatccatgtccgcgatcttattatcgttgctcaatggggactgcttgtccagttcggaagcaagtacaaaggagtgctgaggatcaaagtgtattgatcacaacatatgaaggacagcataatcatgtactccctcccactgccaaggcaatggcatccaccacatcagcagttacatcaatgcttctttcaggatcaatgctaagctcagatggccttattcacccaaacatattggaaagtactgcagcactttcatgctcacagaacacagcagcaaccctctcagcttcagctccatttccaacaataactttggatctcactcaaagtgctaccaataattcctcacagctactacaaggagcaccacaagataaccaacatagcctcctttccccagttttggctcagaagtttatgtcatcagctacaaacatttttgaccagggaacagaaactgcttcatttgtggacacggtaaatgcagcaacagctgctatcactgcggacccgaaattcagtgcagctcttatggctgccataacatctattattggaggttcacattcaaacattaatggtactagtggagatatccaacatggcaataacaat

SEQ ID NO: 284 - protein, 262 aa, Glycine max
  Glyma08g43260.1
HESPADHKALWGDVDQASETMSMIKKARVSVRARTDSSMISDGCQWRKYGQKMAKGNPCPRSYYRCSMGTACPVRKQVQRSAEDQSVLITTYEGQHNHVLPPTAKAMASTTSAVTSMLLSGSMLSSDGLIHPNILESTAALSCSQNTAATLSASAPFPTITLDLTQSATNNSSQLLQGAPQDNQHSLLSPVLAQKFMSSATNIFDQGTETASFVDTVNAATAAITADPKFSAALMAAITSIIGGSHSNINGTSGDIQHGNNN

SEQ ID NO: 285 - DNA, 1488 bp, Vitis vinifera
  GSVIVT01037686001
atggacttctttgctcagaaagaaacagcgagggtggatgtcaagagggagacaaccgcacatgatgggctggtgcaaggtttccacataaatactgggttgaatcttcacttagcgagcggtggtagcgaaaaatcttcggtggatggtggaacatcacctagcaacaaggaaaagctcaacatgagtgataagatggtaggtctacgggctgagttagagaatatgaacaaggaaaataaacagttgagagccatgctgagtcaagtcaacaataactactccgccctacagatgcatgttgtaacgctgatgcaaaggcaacacaatcggagagctgaaatctccctagcaaacgaggtgaatactgaaggaaaagtgggagagaggaacagaaatgaaaccatcgttccaaggcaattcatggatttgggtcgggcgtctatggccgaaaaggatgagtcatcaccatcttggtcgggttccagatctcctcaaaccaatgaagatgcatccagggagtcaaggaggcggaagactggcagtactagtaatgaaaacaaggatggaggaagagaagagagttcagaccaatcattacaaggcgggcttcctaacaaagtccctaaatttaattgttcacagaatgtcgaacaggcctcagaagccatgtccatgatgaggaaagctcgggtctcagttcgagcaagatcggaggcatccatgatctccgatggatgccaatggagaaagtatggacaaaagatggcgaaaggaaacccatgccctcgagcttattatcgatgcaccatggcaactgcttgtccagttcgcaaacaagtccagagatctgcagaagatcggaccgtcctcataacaacttatgaaggccatcacaaccatcccctacctccggctgccatggcgatggcctcgaccacatcagctgctgcaacaatgctactttcgggatcaatgccgagctcagatgggataatgagctcgagctttcattcaaggactatgttcccatgctccccaagcttggcaacgatttcagcttcagcgccctttcccactattacattagatcttacacacagcccgaacctcttacagcaccagaggccgaatgcccaattccatgtccctttccaaaaccttccccagaattttgctcctgggtcgcacgctttcaatccagtgcttcacagccaatccaaattctccgcccttcaaagctccccagaaatgcagcctcctcaagtaggaaccgagcaagtgctgaagccatcgtcatcatcctcagacacagtaactgcagcaacggctgccatcaccgcagacccgaacttcactgcagctctagtggcagccatcacttccattattggcaatgttcatccaaacaatagtagtaacagtagtaccaacacaagaagcaccaatgtcgacaataatattgggaactcaaatttggtagggaat

SEQ ID NO: 286 - protein, 496 aa, Vitis vinifera
  GSVIVT01037686001
MDFFAQKETARVDVKRETTAHDGLVQGFHINTGLNLHLASGGSEKSSVDGGTSPSNKEKLNMSDKMVGLRAELENMNKENKQLRAMLSQVNNNYSALQMHVVTLMQRQHNRRAEISLANEVNTEGKVGERNRNETIVPRQFMDLGRASMAEKDESSPSWSGSRSPQTNEDASRESRRRKTGSTSNENKDGGREESSDQSLQGGLPNKVPKFNCSQNVEQASEAMSMMRKARVSVRARSEASMISDGCQWRKYGQKMAKGNPCPRAYYRCTMATACPVRKQVQRSAEDRTVLITTYEGHHNHPLPPAAMAMASTTSAAATMLLSGSMPSSDGIMSSSFHSRTMFPCSPSLATISASAPFPTITLDLTHSPNLLQHQRPNAQFHVPFQNLPQNFAPGSHAFNPVLHSQSKFSALQSSPEMQPPQVGTEQVLKPSSSSSDTVTAATAAITADPNFTAALVAAITSIIGNVHPNNSSNSSTNTRSTNVDNNIGNSNLVGN

SEQ ID NO: 287 - DNA, 1440 bp, Arabidopsis thaliana
  AT1G18860.1
atggatgaggctaaagaggaaaatcgaagactaaagtcatcattgagtaaaatcaagaaagattttgacatccttcaaacacaatacaaccaattaatggccaaacataacgaaccaaccaagttccaatcaaaagggcatcatcaagacaaaggcgaagatgaagacagagaaaaagttaacgaacgtgaagaacttgtctcgttgagcctaggcagacggttaaattcagaggttccaagtggttcgaataaagaagaaaaaaataaagatgttgaagaagcggaaggtgacagaaattatgatgataatgaaaaaagcagtattcaagggttgagtatggggattgaatacaaggctttgagtaatcctaatgagaagttagagattgatcataatcaagaaaccatgtcgttggagattagtaacaataataagatcagatcacaaaatagttttgggtttaagaatgatggagatgatcatgaagatgaagatgagattttgcctcaaaaccttgttaagaaaactagggtttcggtgagatcaagatgtgagacaccaacgatgaacgacggatgtcaatggaggaaatatggccagaaaatagctaaaggcaatccatgtccccgagcttactatcgttgcaccattgcagcttcttgtccagtaagaaaacaggtgcaaagatgttcagaagatatgtctatacttatctcaacgtacgaaggaacacataaccatccacttcccatgtcagcaactgccatggcctctgccacttccgctgccgcctccatgcttctctccggcgcctcctcctcctcatccgccgcagctgatcttcatggccttaacttctctctttccggcaacaacatcactccaaaacctaaaactcatttcctccaatccccttcttcttctggccatccgaccgtcactctcgacctcacaacctcctcctcgtcgcagcaaccgttcttatcaatgctcaatagattcagctctcctccaagtaatgtctcacgatctaatagttatccttcaaccaatctcaacttttcaaacaacaccaacacattgatgaattggggtggtggtggtaatcccagtgatcaataccgtgcagcttacggcaacattaacacccatcagcaatcaccttaccacaaaatcattcaaacccgaaccgccgggtcatctttcgatccgtttggaagatcatcttcatcacattctccacaaataaatcttgatcatatcggaatcaagaacatcatcagtcaccaagtgccatctttaccggctgaaacaatcaaggcaatcacgacagatccaagtttccaatcggctttggcgacagctctatcttccatcatgggcggcgatttaaagattgatcacaatgtgactagaaatgaagctgagaagagccct

SEQ ID NO: 288 - protein, 480 aa, Arabidopsis thaliana
  AT1G18860.1
MDEAKEENRRLKSSLSKIKKDFDILQTQYNQLMAKHNEPTKFQSKGHHQDKGEDEDREKVNEREELVSLSLGRRLNSEVPSGSNKEEKNKDVEEAEGDRNYDDNEKSSIQGLSMGIEYKALSNPNEKLEIDHNQETMSLEISNNNKIRSQNSFGFKNDGDDHEDEDEILPQNLVKKTRVSVRSRCETPTMNDGCQWRKYGQKIAKGNPCPRAYYRCTIAASCPVRKQVQRCSEDMSILISTYEGTHNHPLPMSATAMASATSAAASMLLSGASSSSSAAADLHGLNFSLSGNNITPKPKTHFLQSPSSSGHPTVTLDLTTSSSSQQPFLSMLNRFSSPPSNVSRSNSYPSTNLNFSNNTNTLMNWGGGGNPSDQYRAAYGNINTHQQSPYHKIIQTRTAGSSFDPFGRSSSSHSPQINLDHIGIKNIISHQVPSLPAETIKAITTDPSFQSALATALSSIMGGDLKIDHNVTRNEAEKSP

SEQ ID NO: 289 - DNA, 1644 bp, Arabidopsis thaliana
  AT5G15130.1
atggaggttcttttgaaattaccctcttcagagtctcctcttaaggataaatttggatctgttcaaatccatgaagctaataagggtgatggtgatcatcaagaacttgaatctgccaaggcagagatgagcgaggtgaaggaagagaacgagaagcttaaaggaatgctcgaacgaattgaaagtgattacaaatctctcaagctcagattcttcgacataattcaacaagaaccttcaaacaccgcaactaaaaatcaaaacatggttgatcatcccaagccaacgacgacggatttgagttcttttgaccaagaacgcgagcttgtatcgctttcactagggagaagaagttcttccccaagtgatagcgtccccaaaaaggaagagaaaacggacgcaatcagcgcagaagtcaacgctgacgaagagttgactaaggccggcttgaccttagggatcaataatggcaacggaggtgaaccgaaagagggtttatctatggagaatcgtgcaaattctggctcggaagaagcttgggcgccaggtaaagttacggggaagagaagctctccagcaccagcctccggtggcgatgctgacggtgaggccggtcaacaaaaccatgttaagagagctagagtttgtgttagagcaagatgtgacacaccaacgatgaatgatggttgtcaatggagaaaatatggacaaaagattgcgaaaggaaatccatgtccacgagcatattatcgctgcacggttgcacctggatgtcccgttagaaaacaggtccaaagatgtgcagatgacatgtctatactaatcacaacctatgaaggaacacacagccactctcttccactctcagccaccaccatggcttccaccacatcagccgctgcctccatgctcctctctggctcctcctcctcaccagccgctgaaatgatcggaaataacctctacgacaattcaagattcaacaacaacaacaaatccttctattcacccacccttcactccccattacatcccaccgtcactctagacctcactgctccacaacactcttcctcgtcttcttcttcattgctttctttaaatttcaacaaattctcgaactctttccaaagattcccatctacaagcctaaatttctcttctacttcatcaacatcatcaaacccgtctactctcaacctacccgcgatttggggtaatgggtattcttcttatactccatatccttacaacaacgtccaatttgggacgtccaacctaggaaaaacagtccaaaatagccagtccttaaccgaaaccctaacaaaagcgcttacttccgacccaagtttccactcggtgatcgctgctgccatctcaactatggtcggatcaaatggagaacaacagattgtcggtccacggcattcgattagcaataacattcaacaaaccaacacgacgaataataacaaaggatgtggaggctattttagcagcttattgatgtctaacattatggcgagtaatcaaacgggtgcttctttggatcaaccatcgtcgcaacttcctcccttctctatgttcaagaattcttcttcttcgtcttctacgactaatttcgtgaacaaggaagagaaaagc

SEQ ID NO: 290 - protein, 548 aa, Arabidopsis thaliana [sequence omitted]

SEQ ID NO: 291 - DNA, 1875 bp, Brachypodium distachyon
  Bradi1g51030.1
atgatcaagggagagacctggcggcagcttggcaaccatgaagaccggttgaaaggcgagacttcatcagagagtttgattatttctttcgataagcatatgaaagatgaccatcgagtctcagatgacagttttttcaagacattacaaaaccaatcaagcacaacaaaagaggttcaacatgacaggcttgcatccacaagggcagagatgggtgaagtgaggcaagagaacgagaggctcaagacgatgctatctcgcatcatagaggaccatcgatctcttcaaaagcacttcaacgacgttctgcagcaaggacgagagaagaagctcgccggtcgatcgcccgctgacgtcgaggagaccgaactcgtctcgctgagcctcggcacgagcacgagcacgagcagcaggtggtacaccacggaagagaagagcagtaccattgcagaaggccaaggcagacaactaggccttctgaagattagacaaggagctgcaggcatctcccttggcctgtcagcaggctcccaattatctggtgcaactgatcagaaggtgccccggccggatgtgctgctgagcttgagccctgaaggcagctctgaggagacagccaaggatgccgacgacacaacggcgtcgatggaacagtggcctgcgccgagccaaacggccaagagctcgaggagtggggccggcaccggcggcacggaaaccgaggatgaggtagccccacaggcgccaatggtcaagaaggccagggtctcagtgagggcaaggtgtgacgcaccaacgatgaatgatgggtgccagtggaggaagtatggtcagaagatatccaaggggaacccgtgcccgcgcgcctactaccggtgcaccgtcgcagcaggatgcccagttaggaagcagatgtcagaaatccttcgtttagcccatgaatcgccaaccgcaattcacgaggtgcagagatgcgcggaggacatgtcgatcctgatcagcacgtacgaggggaggcacaatcacccgctgtccgcctccgcctccgccatggcctccaccacctccgccgccgcctccatgctcctctccggaagctcctcttcctcccccggcctattattcccctcccccagcctcagcttcggcggcctcccggcgacgtccatcaccgccgccccatccgcctcgtctcaccccaccatcaccctcgacctcacctcgccgccaacaccggccaccgcctctcactctcactcgcccttctccttcagcagcagcagattctcctccagcttattattcaacggcagcggtggcagttctaggtaccctccgtcgacgagcttctccttctccggctccggttccaccaacgctactactaccgcggcatggccggccacgggcgggtacttgagctacgggcaatcaccgccgtcgttgtcaggatcctcgtcctacaacaacgccggcaatggcaatggcatcgttgtccaaggaaggcaattgcagttgcagcagcaaggcggctcaacgtcagcggcactgtaccagcagcagcggctggcagtggtgccgccgcaggtggacacgatcgcgaaggtgatcacgtcggacccagggttccacacggcgctcgcagctgccatcacgtcgtacgtcggcactactaagccggcggtgacgccaccgacgggaggaggagggctcgagtggggggagcacctcgggctggggccggcatcagcatcggcggtggagagcgggaaggcgcccttcttgcagccgtcgcgggcattgtcaggctcgacgagtggcactgcttccatgtctccggtgaagaacagggagcacacattagctgaaggttta

SEQ ID NO: 292 - protein, 625 aa, Brachypodium distachyon
  Bradi1g51030.1
MIKGETWRQLGNHEDRLKGETSSESLIISFDKHMKDDHRVSDDSFFKTLQNQSSTTKEVQHDRLASTRAEMGEVRQENERLKTMLSRIIEDHRSLQKHFNDVLQQGREKKLAGRSPADVEETELVSLSLGTSTSTSSRWYTTEEKSSTIAEGQGRQLGLLKIRQGAAGISLGLSAGSQLSGATDQKVPRPDVLLSLSPEGSSEETAKDADDTTASMEQWPAPSQTAKSSRSGAGTGGTETEDEVAPQAPMVKKARVSVRARCDAPTMNDGCQWRKYGQKISKGNPCPRAYYRCTVAAGCPVRKQMSEILRLAHESPTAIHEVQRCAEDMSILISTYEGRHNHPLSASASAMASTTSAAASMLLSGSSSSSPGLLFPSPSLSFGGLPATSITAAPSASSHPTITLDLTSPPTPATASHSHSPFSFSSSRFSSSLLFNGSGGSSRYPPSTSFSFSGSGSTNATTTAAWPATGGYLSYGQSPPSLSGSSSYNNAGNGNGIVVQGRQLQLQQQGGSTSAALYQQQRLAVVPPQVDTIAKVITSDPGFHTALAAAITSYVGTTKPAVTPPTGGGGLEWGEHLGLGPASASAVESGKAPFLQPSRALSGSTSGTASMSPVKNREHTLAEGL

SEQ ID NO: 293 - DNA, 1581 bp, Oryza sativa
  LOC_Os06g05380.1
atgggtgaagtacgagaagagaacgagaggctcaagacgttgctgtcgcgcatctcacacgactatagatctcttcagacgcacttctatgacgttcttcagcaaggccgagctaagaagctcccagactctccggccaccgacatcgaggagcctgaactcgtctctctgagacttggaacgagcacgagcaaatgcaagaaggaagacaagagtaccaccagtagcgaagtcaaagggagtactgaagattttctgaagatcaaaggaggtctctctcttggattatcagactgcagagttgatgctaataacagtgagaaggtacagccggatgtgatgacgttgagccctgaaggcagctttgaggatgctagggatgacaccgcagagaccacagagcaatggccaccaagcaaaatgctgaagaatttgaggagcgtcggcgcggaagccgaggatgacatagctcctcagccacaggtcaagaaggctagggtttcagtgagagcgagatgtgatgcgccaacgatgaatgatggatgccagtggagaaagtatgggcagaagattgcgaaggggaacccgtgcccgcgcgcctactaccggtgcaccgtggcagcaggatgcccagtcaggaagcaggtgcagcgatgcgcggatgacatgtccatcctcatcaccacctacgagggcacgcacaaccacccgctctccgtctccgccaccgccatggcctccaccacctccgccgccgcctccatgctcatctccggctcctcctccacctctctcgccgcctaccccgccgccgccgcgtcgccggccctcgcattcgacgcctcctccaagccgcccctcatcggcggccgcccgttcttcctcccgaccgccgccgccgccgccatcacctccaccccttcctaccccaccatcaccctcgacctcacctcgccggccgccgccgccacctcctcccacgccgccttctccctcagtaacaggttctcgcacaccaggtacccttccaccggcttcaccttctccggctccggcccgagtagcgcgccatggccggggtacttgagctacggggcgtcgctatccgctcacccgtacaacgccggcggcggcaagagctcgtcgtcgttcgaggctgcgctgagcagcatcaacggaagcaggcagcagggcggcggcggcggtggcggctcggcgccgccgctctaccagatgcagcagaaggcggcggcggcggcgccgccgccgccgagcgtgatcaccgacacgatcgcgaaggcgatcacggcggacccgagcttccacacggcgctggcggccgccatcacgtcgtacgtcggcaagaagggctcgccgccggcgtcgggaggagaggacagcaaggtcgggctcaagtggggggagcacctcgggctcgggctgacccactcgtcgctgtcgacggcggcggcggcggcggcgagctcgagcagccagatgttcttgcagccatcgctggggttatcaggatcgacgacgagtgcgtcgacgtctcctgtggcgaacagagagcaagcacat

SEQ ID NO: 294 - protein, 527 aa, Oryza sativa
  LOC_Os06g05380.1
MGEVREENERLKTLLSRISHDYRSLQTHFYDVLQQGRAKKLPDSPATDIEEPELVSLRLGTSTSKCKKEDKSTTSSEVKGSTEDFLKIKGGLSLGLSDCRVDANNSEKVQPDVMTLSPEGSFEDARDDTAETTEQWPPSKMLKNLRSVGAEAEDDIAPQPQVKKARVSVRARCDAPTMNDGCQWRKYGQKIAKGNPCPRAYYRCTVAAGCPVRKQVQRCADDMSILITTYEGTHNHPLSVSATAMASTTSAAASMLISGSSSTSLAAYPAAAASPALAFDASSKPPLIGGRPFFLPTAAAAAITSTPSYPTITLDLTSPAAAATSSHAAFSLSNRFSHTRYPSTGFTFSGSGPSSAPWPGYLSYGASLSAHPYNAGGGKSSSSFEAALSSINGSRQQGGGGGGGSAPPLYQMQQKAAAAAPPPPSVITDTIAKAITADPSFHTALAAAITSYVGKKGSPPASGGEDSKVGLKWGEHLGLGLTHSSLSTAAAAAASSSSQMFLQPSLGLSGSTTSASTSPVANREQAH

SEQ ID NO: 295 - DNA, 1599 bp, Setaria italica
  Si006217m
atgggtgaggtaagagaagagaacaataggctaaaaacaatgttgtcacgcattgtagaggactaccgatctcttcaattgcacttccatgacgttcttcaacaaagacaaggcaagaagcttgcagaccctacaactgccatgcccaccaacatcaaggagcctgaattcgtctcactaagcctcggcacgagcacaagcatgcgcaagaaagaagggaagaatactagtgtttacgaaggcgaagggagagaagacttcatggatactaaagaaggagggctctctcttggattgtcggactgcaaagttggtgcaactaacaatgcaaagatacagcctgatgagctgaccttgagccctcaaggtagctctgaggacgccaaggacgacgccttggaggcagcagatcagcagtggccaccaagcaaaacgctaaagaacttgaggagcgttggcgcggaagccgaggatgacataggtccaatgcagcaggccaagaaggcaagggtgtctgtaagggcaaggtgtgatgcaccaacgatgaatgatggatgccaatggaggaagtacgggcagaagatagccaaggggaacccatgcccccgtgcctactaccggtgcacagtggcagcaggatgccccgtcagaaaacaggtgcagaggtgcgcggacgacatgtcgatcctgatcaccacgtacgagggcacgcacaaccacccgctctccgcctccgccaccgccatggcctccaccacctccgccgcggcgtccatgcttacatcgggctcctccacctccctccgcttccccgccgcctcgtccgccgccggcctcagcttcggcttcccgtcggcgccgcacgacgcttccaagcacttcttcctcccgaacggcggcgcagcgtccatcacctccaccccgtcctacccgaccatcaccctcgacctcacctcgccggcggcggccacctcacaggccttctcgctgagcaacaggttctcctcgagcttcgggcacggcgcgacgaggtaccatcccacgagcttctccttctccaactccggcccgagcgcgctgtccggcgccgcatggccggcggccggcggtgccgggtacctgagctacgggtcgccagctgcgtcgctgttcaacggaaggcaaaacggcggggagctcccggcggtgctccaccagcagcagcagaaggcttccgcgagcgggagctcgcctccggcgggcgtgctcaccgacacgatagcgaaggcgatcacgtcggacccgggcttccacacggcgctggcggcggccatcacgtcgtacgtcggcacgcagggtggcaagtcgccggctggaggagacggcgggagccagacgcaggggcttttaaagtgggggcagcacctcggcctggggccgtcgccgtcgagcgcgggcgcggcgtgctcgtcggcagcgatgctggcgcggtcatcgccgacgacggcagcggcggcggagcagaagggttcgaacgggcatcggtcgttcttgcagccgtcgctagggctgtcaggctctcacagtgcctcgacctcccctgtggagaacagggagcac

SEQ ID NO: 296 - protein, 533 aa, Setaria italica
  Si006217m
MGEVREENNRLKTMLSRIVEDYRSLQLHFHDVLQQRQGKKLADPTTAMPTNIKEPEFVSLSLGTSTSMRKKEGKNTSVYEGEGREDFMDTKEGGLSLGLSDCKVGATNNAKIQPDELTLSPQGSSEDAKDDALEAADQQWPPSKTLKNLRSVGAEAEDDIGPMQQAKKARVSVRARCDAPTMNDGCQWRKYGQKIAKGNPCPRAYYRCTVAAGCPVRKQVQRCADDMSILITTYEGTHNHPLSASATAMASTTSAAASMLTSGSSTSLRFPAASSAAGLSFGFPSAPHDASKHFFLPNGGAASITSTPSYPTITLDLTSPAAATSQAFSLSNRFSSSFGHGATRYHPTSFSFSNSGPSALSGAAWPAAGGAGYLSYGSPAASLFNGRQNGGELPAVLHQQQQKASASGSSPPAGVLTDTIAKAITSDPGFHTALAAAITSYVGTQGGKSPAGGDGGSQTQGLLKWGQHLGLGPSPSSAGAACSSAAMLARSSPTTAAAAEQKGSNGHRSFLQPSLGLSGSHSASTSPVENREH

SEQ ID NO: 297 - DNA, 1596 bp, Brachypodium distachyon
  Bradi2g05500.1
atggacgtcgccgtcgagaggccgctgccgtcgccggtgaaagaggagaagaaggcggagagcatggagagagggagcgcgcctccgatagtcttcgagagtttcccaacatctactacgcaaagagacccgatcaccaacaagcaggaggaggaaggggataatactaagctggaggcgaccaaggcggagatgggttccgtgcgcgaggagaacgagcggctcaagacgctgctctcccagatcgtccgcgattaccagtcgctccacacgcacttcctcgccgccgtcaagcccaaatcctctcaaccccaaccccaagccgccgccataggcaacctcctccagctccccgccgcgccggttcccactgccgccgccgccgaggacctcgtctccctcagcctcggcaggagccgacccgacgccggcgcggggcggatcaaggccgccgcccgccacgagaggtcggcgtcctcgtcgtccggaaccgacaccgaccgcgacgaccggctctccctcgggctcagcagccgccggtccaacgacgacgatgacaagaaggccaccttgctcaacctcagctccggcagcagcagcgcggacgccgacgccgatgccgttcaagccgcggccgccgcgtgcccaccggcggcgacggccaaggcgcggaagagcccgggcgccggggatggaggaggaggagccgacgacgatgtgctccagcagcaggccaagaaggctagggtttccgtccgcgtcaaatgcgacacccccacgatgaacgacgggtgccaatggcggaagtacgggcagaagatctccaaggggaacccgtgcccgcgggcctactaccggtgcacggtggcgccgtcgtgcccggtgcggaagcaggtgcagcgctgcgccgacgacatgtccatcctcatcaccacctacgagggcgcgcacacccacccgctcccgcccgccgccgccgccatggcctccaccacatccgccgccgcctcgatgctgctcgccggcccatccacatccgcctccgcggcccacctcctcggcccgttcgcggcccatcaagccggcctccttggcccggcggccacctccatctccaccgtcgcctcctgccccaccgtcacgctcgacctcaccgcgccgccgcacagctcgctcatgcaccagcagcagcaccacccgtcctcgtctccttacgcggcggcgtacgagtcgtccaaggcgatgctgcccgcgtggagcagcggcgccgggtacctgcaggcggcgtacggcggcgggtcctactacgggaagaactcgaactcgatctcgtccatgtccatgctgccggcggcggcgatgcagcagttcgggctgggcatggagaggccggcggcggagcagatgtaccagcttccgacgtacctgctgaggacgacgagcggcgcgcagcagcagcaggcggcggcggcgccggccgtgacggacacgatcgcgaaggcgatcacggcggacccgagcttccagtccgtgctggcggcggcgatcacgtcctacatggggcgcggggccggcgcggcggcgcagcagcacaag

SEQ ID NO: 298 - protein, 532 aa, Brachypodium distachyon
  Bradi2g05500.1
MDVAVERPLPSPVKEEKKAESMERGSAPPIVFESFPTSTTQRDPITNKQEEEGDNTKLEATKAEMGSVREENERLKTLLSQIVRDYQSLHTHFLAAVKPKSSQPQPQAAAIGNLLQLPAAPVPTAAAAEDLVSLSLGRSRPDAGAGRIKAAARHERSASSSSGTDTDRDDRLSLGLSSRRSNDDDDKKATLLNLSSGSSSADADADAVQAAAAACPPAATAKARKSPGAGDGGGGADDDVLQQQAKKARVSVRVKCDTPTMNDGCQWRKYGQKISKGNPCPRAYYRCTVAPSCPVRKQVQRCADDMSILITTYEGAHTHPLPPAAAAMASTTSAAASMLLAGPSTSASAAHLLGPFAAHQAGLLGPAATSISTVASCPTVTLDLTAPPHSSLMHQQQHHPSSSPYAAAYESSKAMLPAWSSGAGYLQAAYGGGSYYGKNSNSISSMSMLPAAAMQQFGLGMERPAAEQMYQLPTYLLRTTSGAQQQQAAAAPAVTDTIAKAITADPSFQSVLAAAITSYMGRGAGAAAQQHK

SEQ ID NO: 299 - DNA, 1521 bp, Oryza sativa
  LOC_Os01g09080.1
atggacgtcgtcgtcgagagcccgccggtgagggacgagaagaaagtcgacgtcgccgcgattggaggcgcgcctccaatagtctttgagagttttgcaccatcgacgcagagagattcaaccatcatcaagaaggaggagaagatggaggcagcgaaggcggagatgggcgaggtgagggaggagaacgagcggctcaagacgatgctcacacgcatcgtcagcgactacaagtcgctgcacacgcacttcctcgacgtcgtcaaggtcaaggagcaaacggcggcggagctctccggagacgacgacgacgacgagcccgacgacctcgtctccctgagcctctgcacgaggcccaacgccgccgcgacgcgccggaagggccacgagaggacgccgtcgtccggcggcggcggcgacgacgggcggctgtccctcgggctgagctgcgctcgcggcggcgttgcctccgacgacgacgacgacaagcaggcgagccgccgcgcgttgccgccgatgcccgtgctgaacctcagctccgacagcagcggggacgccgccggcgccggcgccggcgagcctacccagccgaacaaagcgtccaggagctcgagcggcggcggcgatggcgccgacgacgaggtgctgcagcagcagcaggccaagaaggctagggtttccgtcagagtcaagtgcgacacccccacgatgaacgatgggtgtcagtggcggaaatacgggcagaaaatctcaaaggggaacccttgcccgcgcgcctattaccgttgcaccgttgcacccaactgccctgtacgcaagcaggtgcagagatgcgcggacgacatgtcgatcctgatcacgacgtacgagggcacgcacagccacccgctgccgccggcggcggcggcgatggcgtccacaacgtcggccgcggcggcgatgctgacgtctggctcgaccaactccacgatgcacggcagcggcggcgttcaccaccacctgccgttcgcctcggccgtcggcggcggcggcggcgtcgggctgctcggcccgaccaccatctccaccgccacgtcctgccccaccgtcacgctcgacctcaccgcgccgcactcgctcctgcacccgtcgtcggcgtcgccctacgccgccgccgccgcggggtacgagtccagcagggcgctgccggcggcgtggagcagcgggtacctggcgtacggcggcgcggcggcggcgcagccatactacgccaagggcgttgcgccgtcgccgttcggccatcatttcggcatgatgggcatggcggcggcggcggcgaggccggcgccggagcagctgttcggcggccagacgacgtcgccgtacctgcagagagccatcggcggcggcggcgtcgcgccggcggccgtgacggacacgatcgcgaaggcgatcacgtcggacccgagcttccagtcggttttggcggcggcgatcacgtcctacatggggcgcggcggcggcgcggcggcgccgaacaag

SEQ ID NO: 300 - protein, 507 aa, Oryza sativa
  LOC_Os01g09080.1
MDVVVESPPVRDEKKVDVAAIGGAPPIVFESFAPSTQRDSTIIKKEEKMEAAKAEMGEVREENERLKTMLTRIVSDYKSLHTHFLDVVKVKEQTAAELSGDDDDDEPDDLVSLSLCTRPNAAATRRKGHERTPSSGGGGDDGRLSLGLSCARGGVASDDDDDKQASRRALPPMPVLNLSSDSSGDAAGAGAGEPTQPNKASRSSSGGGDGADDEVLQQQQAKKARVSVRVKCDTPTMNDGCQWRKYGQKISKGNPCPRAYYRCTVAPNCPVRKQVQRCADDMSILITTYEGTHSHPLPPAAAAMASTTSAAAAMLTSGSTNSTMHGSGGVHHHLPFASAVGGGGGVGLLGPTTISTATSCPTVTLDLTAPHSLLHPSSASPYAAAAAGYESSRALPAAWSSGYLAYGGAAAAQPYYAKGVAPSPFGHHFGMMGMAAAAARPAPEQLFGGQTTSPYLQRAIGGGGVAPAAVTDTIAKAITSDPSFQSVLAAAITSYMGRGGGAAAPNK

SEQ ID NO: 301 - DNA, 1620 bp, Zea mays
  GRMZM2G083350_T01
atggaggtcgccgtcgtcgaagggccgccgccgcaggtgatgaaggaggagaaccggcccgacgccaagccagagatcgccgcgtcgatggtaggaaccgctcttccgatagtcttcgaaagctttccatcatcgacgcaaagagatgcggccggcaagaagcgggaggaacaagaacaacgcaggctggaggcggccagagcggagatgggcgaggtgcgggaggagaacgagcgcctcaagtcgacgctgtcccgcatcgtcagccagtaccagtccctgcagatgcacttcctcgacgtcgtcaaggtgcacgagcaagcatctgcagccaaagcggagaagctccccgtggcgccggctcccgcgcctccgcctcccgccaccaccggcaccgacgaccccgacgacctcgtctctctgagcctcggcacgagggcgaatagcggtggcggcgcaccacgccgcaagggccacgagaggtcggcgtcctcgtctggcaccgctgatgagatgaccaccgccggcgccgacgacgaaggccaccggctctccctcgggctcggcttcgggcgcggtagcgggctgccggcgtcgacggtggccacggacgacgacaaggccagccacgcgtccgtccggaacttgagctccgacagcagcggcagcgccgactacaacgacaacgccaagcctgctgacctggccgccgcgggcaccgctcgtaagagcccgagcgccggtgccggcgacggatcagctgacgacgaggtgcagcagcaggccaagaaggctagggtttccgtcagagtcaaatgcgatacacccacgatgcccgatggctgtcaatggcggaagtacgggcagaagatctccaaggggaacccgtgcccgcgcgcctactaccgctgcacggtggcgccgcagtgcccggtgaggaagcaggtgcagcggtgcgcggaggacacgtcgatcctgatcaccacgtacgagggcgcgcacaaccacccgctcccgccggcagcgacggccatggcgtccacgacctccgcggcggcggccatgctcacctcgggctccaccagctccgccgcctcggcctcgctcgtccacggccaccaccacccgctggcggccgccgccgccgggctgttcggccccaccaccatggtctccaccgccgcgtcctgccccaccatcactctcgacctcacctcccccgcgaccgcgccgcacaccctcatgcactcctcgccctacgggttcgagtccaaggcggtcccggcggcgtggagcagcgggtacctggcgtacggcggcgccagcgccggcgcccacccgtcctcctactacgccaagagctcgccggcgctcgggcaccaccagctgttcggcggaaacctgagcgcgccatcgaggccggagcagatgtacgcccaatcgtacctgcagagagccagcagcctgggccttggaggcggcggcggccatggcgccgtggcgcccgccgtcacggacacgctcgcgaaggccatcacgtccgatccgagcttccagtccgcgctggccgcggcgatcacgtccgtcatgggccgcggcggagccgctgctgcccacaag

SEQ ID NO: 302 - protein, 540 aa, Zea mays
  GRMZM2G083350_T01
MEVAVVEGPPPQVMKEENRPDAKPEIAASMVGTALPIVFESFPSSTQRDAAGKKREEQEQRRLEAARAEMGEVREENERLKSTLSRIVSQYQSLQMHFLDVVKVHEQASAAKAEKLPVAPAPAPPPPATTGTDDPDDLVSLSLGTRANSGGGAPRRKGHERSASSSGTADEMTTAGADDEGHRLSLGLGFGRGSGLPASTVATDDDKASHASVRNLSSDSSGSADYNDNAKPADLAAAGTARKSPSAGAGDGSADDEVQQQAKKARVSVRVKCDTPTMPDGCQWRKYGQKISKGNPCPRAYYRCTVAPQCPVRKQVQRCAEDTSILITTYEGAHNHPLPPAATAMASTTSAAAAMLTSGSTSSAASASLVHGHHHPLAAAAAGLFGPTTMVSTAASCPTITLDLTSPATAPHTLMHSSPYGFESKAVPAAWSSGYLAYGGASAGAHPSSYYAKSSPALGHHQLFGGNLSAPSRPEQMYAQSYLQRASSLGLGGGGGHGAVAPAVTDTLAKAITSDPSFQSALAAAITSVMGRGGAAAAHK

SEQ ID NO: 303 - DNA, 1641 bp, Zea mays
  GRMZM2G176489_T01
atggaggtcgcggtcgtggaaagtcctcgtcctcctccgccgccgccgcaggccaaggaggagaagaggtccgacgccaccaagccagagatcgccgcatcgatggtaggaagcgctctcccaatagtcttcgaaagctttccgtcgacgcaaagagaagcggcggcggcgggcgtcaaacaggaggagcgcaggctggaggcggccagggcggagatgggcgaggtgagggaggagaacgagcgcctcaagtcgatgctgtcccgcatcgtcggccagtaccagtccctgcagacgcacttcctcgacgtcgtcaaggtgcgcgagctggcatcatcgtcagccaaggcggcggcagagaacaagatccccgcggcgccggctctgctgcccggcaccgacgacggcgacgaaccctacgacgacctcgtctccctgagcctcggcacgagggcgaatagcagcggcggcggccctcgccgcaaggggcacgacgacaggtcggcgtcctcgtctggcaccgctgacgagatgcccaataccgccgacgacgaacgccgccaccagatctccctcggtctcggcttcgcgcgcgggcttccgccatcgggcacggcggcggccgcggacgacgacaaggccagccacgacgcgtccacggcgccggtcctgaacctgagctccgacagcagcggcagcgccggggacaccgacaccacgaagcctgccctggccgccgcgggcgccgcccgtaagagcccgagtgccggtgccggagacgggtcagctgacgacgaggtgcagcagcaggccaagaaggctagggtttccgtcagggtcaagtgtgacactcccacgatgcccgatggctgccaatggcggaagtacgggcagaagatctccaaggggaacccgtgcccgcgcgcctactaccgctgcacggtggcgccgcactgcccggtgaggaagcaggtgcagcggtgcgcggaggacacgtcggtcctgatcaccacgtacgattgcgcgcacaaccacccgctcccgccggcggcgacggccatggcgtccacgacctccgcggcggtggccatgctcacctatggatccaccacctccgccgcctcggcctcgctcgtccacggccaccaataccactcgctggcggccgccgccgggcttctcggccccaccaccatggtctccaccgccgcgtcctgccccaccatcacgctcgacctcacctcccccgccgcgccgcactccctcgtgcactcctccttgccctacgccgccgccgccgccgcagcagcagcggggttcgagtccaaggcggtccccgcggcgtggagcagcgggtacctggcgtacggcggcgcccacccgtcctacgacaccaagatctcgtcggcgttggggcacctgttcggtggaagcctgggcgtgccatcgagaccggaacagctgtacgcccagtcgtacctgcagagagctaatagcctgggcgacggccatggtgcggtggcgcccgccgtcacggacacgctcgcgaaggcgatcacgtcggatccgagcttccagtcggtgctggcagcggcgatcacgtccgtcatggggcgcggcggagccgctgctacccagaag

SEQ ID NO: 304 - protein, 547 aa, Zea mays
  GRMZM2G176489_T01
MEVAVVESPRPPPPPPQAKEEKRSDATKPEIAASMVGSALPIVFESFPSTQREAAAAGVKQEERRLEAARAEMGEVREENERLKSMLSRIVGQYQSLQTHFLDVVKVRELASSSAKAAAENKIPAAPALLPGTDDGDEPYDDLVSLSLGTRANSSGGGPRRKGHDDRSASSSGTADEMPNTADDERRHQISLGLGFARGLPPSGTAAAADDDKASHDASTAPVLNLSSDSSGSAGDTDTTKPALAAAGAARKSPSAGAGDGSADDEVQQQAKKARVSVRVKCDTPTMPDGCQWRKYGQKISKGNPCPRAYYRCTVAPHCPVRKQVQRCAEDTSVLITTYDCAHNHPLPPAATAMASTTSAAVAMLTYGSTTSAASASLVHGHQYHSLAAAAGLLGPTTMVSTAASCPTITLDLTSPAAPHSLVHSSLPYAAAAAAAAAGFESKAVPAAWSSGYLAYGGAHPSYDTKISSALGHLFGGSLGVPSRPEQLYAQSYLQRANSLGDGHGAVAPAVTDTLAKAITSDPSFQSVLAAAITSVMGRGGAAATQK

SEQ ID NO: 305 - DNA, 1524 bp, Setaria italica
  Si001109m
atggaggtcgctgtcgaaaggccggcgccggtgaaggaggagaagagagccgacgccaagccggagatggcagcagcgacaggaagcgcgaggtctctcccgatagtcttcgaaagcttcgcaacaacgcaaagcgacgcaggcatcaagcaggaagaacgcacgctagaggcggccaaggcggagatgggcgaggtgagggaggagaacgagcgcctcaagacgatgctgtcccgcatcgtcaaccagtaccagtcgctgcacatgcacttcctcgacgtcgtcaaggtgcacgagcaagaagctgccaaggctaagctcccggcggcgccggcgccggcgcccggagccgatggcgtcgacgaagaccccgacgatctcgtctccctgagcctcggcacgaggtccaacggcgcccgccgcaagggccacgagaggtcctcgtcctcgtccggcaccgccgagaccaccgccggcgaaggccagctctccctcgggctcggcatcgcgcggggcagcggggtgcccgccgacgacgacaaggcgagcggcgcgtcggcggcgcctggcgtcctgaacctgagctccgacagcagcagcgctaacgacgccgccaagcctgcccgggacgacgccgccgcgtccccgccttgcgccacgcgcaagagcccgagcgccgccggggagggcgtggacgacgaggtgcagcagcaggccaagaaggctagggtttccgtcagggtcaaatgcgacactcccacgatgcccgatggttgccaatggcggaagtatgggcagaagatctccaaggggaacccttgcccgcgcgcctactaccgctgcacggtggcgccccactgcccggtgaggaagcaggtgcagcggtgcgcggaggacacgacgatcctgatcaccacgtacgagggccagcacaaccaccagctcccgccggcggccacggccatggcgtccacgacctccgccgcggcggccatgctcacctcgggctccaccacctcctcctccccggcctcgctcgccgcccacggccaccacctcccgctcgcggccgccgggctgctcggcccgaccaccatggtctccaccgccgcttcctgccccaccatcacgctcgacctcaccaccccggcggcgccgcactccctcatgcactccacgccctacgctgccggttacgagtccaaggcggtcccggcggcgtgcagcagcggttacctcgcgtacggcgccgcgccaccgtcgtactacgccaagggctcgctggcgctggggcacctgttcggcggcggcttgggcgtgtcgtcgaggccggagcagctgtacgctgcccagtcgtacctgcagaggacgagcagcctcggcggtggcggccatggcgcggtggcgccggccgtcacggacacgctcgcgaaggcgatcacgtcggacccgagcttccagtctgcgctggcggcggcgatcacgtcggtcatgggccgcggcggagccgctgccgcccagaag

SEQ ID NO: 306 - protein, 508 aa, Setaria italica
  Si001109m
MEVAVERPAPVKEEKRADAKPEMAAATGSARSLPIVFESFATTQSDAGIKQEERTLEAAKAEMGEVREENERLKTMLSRIVNQYQSLHMHFLDVVKVHEQEAAKAKLPAAPAPAPGADGVDEDPDDLVSLSLGTRSNGARRKGHERSSSSSGTAETTAGEGQLSLGLGIARGSGVPADDDKASGASAAPGVLNLSSDSSSANDAAKPARDDAAASPPCATRKSPSAAGEGVDDEVQQQAKKARVSVRVKCDTPTMPDGCQWRKYGQKISKGNPCPRAYYRCTVAPHCPVRKQVQRCAEDTTILITTYEGQHNHQLPPAATAMASTTSAAAAMLTSGSTTSSSPASLAAHGHHLPLAAAGLLGPTTMVSTAASCPTITLDLTTPAAPHSLMHSTPYAAGYESKAVPAACSSGYLAYGAAPPSYYAKGSLALGHLFGGGLGVSSRPEQLYAAQSYLQRTSSLGGGGHGAVAPAVTDTLAKAITSDPSFQSALAAAITSVMGRGGAAAAQK

SEQ ID NO: 307 - DNA, 1191 bp, Eucalyptus grandis
  Eucgr.I01927.1
atgttgaagcttgttgagaaggatccaccatatccccttcaaatgcgcatgttcgacatacttcaacaagaagctcgagaaatatcctcttcgaactcttccaatgaagaggccgacgaaaaacctcagcttgtgtctctttgcctcggaaggagccaacatatgaatgacaagaaggaaacgggcgagtccagcgatcctacacaagacatcaagaccagcctcactctcgggttggatttcaagggtgaattctcgtcaaagcttgcaccagatcctcatcgcaagagccggttggaattgggcaacccggatgaagaagaagggaaagaaacttgtctgtcgagtaggattcggaagacgacttgtgatggtgaagaaaacgaggtttcacagcaagagcaagtgaagagagctagggtttgcgtcagggccagatgcgacacacccacgatgaacgatggatgtcaatggagaaaatacggacaaaagatttccaaagggaacccttgtccccgagcatattaccgttgtacggttgtcccggcatgccccgtcagaaaacaggtccaaagatgtcccgaagacatgtccatattgaccaccacctacgagggcactcacaaccacccgcttcccgtttcagccagggccatggcttccaccacctcggccgcggcttccatgctcctcctctctggttccactttccacacaggcccgagcttcagcacgtacgacagttattcaagaagcaggcccatcttcctccacccaaaccctgcctctgctctgaacccaacaatcactctagacctcactgacgatgcgccaccatccgcttcgaccatgagccacttcaagtccaagtccaacattgggccgacatctttattgggctacgattacacgagcggccgtcccatgttgttgcctggttatgtcagggcccaagctggcccatttggccaggagaagcgaccccagcaagagcagataaatcacggcaccagcggggacaaggaccaacagatttattctcaacagtccctgacggagaccctgaccaagatgctcacgtcggacccgagtttccagtcgattgtggcggcggccatttcgtccatggttggaggcgataaggcacccaccggccaaggcgggacgggaagatttggcccggccggacta

SEQ ID NO: 308 - protein, 397 aa, Eucalyptus grandis
  Eucgr.I01927.1
MLKLVEKDPPYPLQMRMFDILQQEAREISSSNSSNEEADEKPQLVSLCLGRSQHMNDKKETGESSDPTQDIKTSLTLGLDFKGEFSSKLAPDPHRKSRLELGNPDEEEGKETCLSSRIRKTTCDGEENEVSQQEQVKRARVCVRARCDTPTMNDGCQWRKYGQKISKGNPCPRAYYRCTVVPACPVRKQVQRCPEDMSILTTTYEGTHNHPLPVSARAMASTTSAAASMLLLSGSTFHTGPSFSTYDSYSRSRPIFLHPNPASALNPTITLDLTDDAPPSASTMSHFKSKSNIGPTSLLGYDYTSGRPMLLPGYVRAQAGPFGQEKRPQQEQINHGTSGDKDQQIYSQQSLTETLTKMLTSDPSFQSIVAAAISSMVGGDKAPTGQGGTGRFGPAGL

SEQ ID NO: 309 - DNA, 1548 bp, Citrus clementina
  clementine0.9_007664m
atgggtgaagtgagagaagaaaacgaaagattaaagaagatgctagagcaaatcgaaaaggattacaagtctctccaattgcgcttctttgatatcttgcaaaaagctgaccccgccaagaaatctacaaattcaactcaatacttttcccacgatgatcaaatcatggagtctgaacttgtgtcactttgtcttggaagaagcagcagtccgggtgaggttaaaaaggaagaaagaacaagcaataatgcaagcaaaagtagcaggaaaaatggtgatgatgaagagttgaaggccagtctaaatcttgcgctggacccaaaaattcaaccgtctctggagcttggtgtgtcgaatctaagccccgagaatagttcagaagagacaaaggaagaggaagcaggagaggcatggccaccaagtaaggttttgaagacaatgagaggtaatggagatgatgaagtttcaccacaaagcaatgtgaagagagctagggtttctgtgagagcaagatgtgatgcccctacgttgaacgatgggtgtcaatggaggaaatatgggcaaaaaattgcaaaaggaaacccatgtcctcgagcttattatcgttgtacggttgcaccaggatgtcctgtaagaaaacaggtacaaaggtgtgccgaagacatgtctatattaatcacaacctatgaaggaacacacagccacccacttccagtttcagccactgccatggcttccactacctcagctgctgcttccatgctattatctggctcttcgacatctcagccaggcctcagctccacagccccaactactactgctgccacagaacccaatggattaaacttcaatatttatgatacttcaagaacaaagccattctactcctcaaatagtacctcagctttgttcccaacaattaccctggatcttaccaatccatccagttccttttctcacttcaacaggttctcttcaagttttgcttcaaacccaagattcccttcaacaaatctcaacttttcttgttcctcagaatccactttgttacccacactttggggcaatgggttccaagcttatggtccttacaatcaaactccaaatgggtccttgttaaatcttggaaaaaattcccaagaacagttttatcaatctttcatggataaaaatcagaaccaacaagctgcaactgcttctgcttctcaacaagctttgacagaaaccctaaccaaagctatgacatcggaccctaactttcggtcagttatagctgccgcgatttcaacaatggttggaggcaatgcaacaaataatggggatcaagaaaattttggtcagaatctgatgcagaataatactcctcctaacaattcaatactaagccaaaatgggaaagcttgcgcatcaggctacttcaatggactctcaactttgaattctcagacgggaagcagtagtttgcttcaatcttcattgccatttcctatcttcaagagcagccctaccccgacaaatgataataataacaagggtcaaagcagt

SEQ ID NO: 310 - protein, 516 aa, Citrus clementina
  clementine0.9_007664m
MGEVREENERLKKMLEQIEKDYKSLQLRFFDILQKADPAKKSTNSTQYFSHDDQIMESELVSLCLGRSSSPGEVKKEERTSNNASKSSRKNGDDEELKASLNLALDPKIQPSLELGVSNLSPENSSEETKEEEAGEAWPPSKVLKTMRGNGDDEVSPQSNVKRARVSVRARCDAPTLNDGCQWRKYGQKIAKGNPCPRAYYRCTVAPGCPVRKQVQRCAEDMSILITTYEGTHSHPLPVSATAMASTTSAAASMLLSGSSTSQPGLSSTAPTTTAATEPNGLNFNIYDTSRTKPFYSSNSTSALFPTITLDLTNPSSSFSHFNRFSSSFASNPRFPSTNLNFSCSSESTLLPTLWGNGFQAYGPYNQTPNGSLLNLGKNSQEQFYQSFMDKNQNQQAATASASQQALTETLTKAMTSDPNFRSVIAAAISTMVGGNATNNGDQENFGQNLMQNNTPPNNSILSQNGKACASGYFNGLSTLNSQTGSSSLLQSSLPFPIFKSSPTPTNDNNNKGQSS

SEQ ID NO: 311 - DNA, 1644 bp, Glycine max
  Glyma09g37470.1
gaaatagtaataattgaggccatgtcaaaaatttctggtcctagtggtccagatgagatagaagagaagagagtaacaaaggaagaaaaaatcaaatctgctaaaactgagatgggtgaggtgaaggaagaaaatgagagattgaagatgatgctggaaagagtagaaaaggactaccactcccttcaactccgtttctttgacatccatcacgaagatgtttcaaagaagggtttagctgattcttctacttgccatgatcatgaaactgaagagcttgtgtcactttgccttggaaggagtccaatggtgcctaagaaggaagcaagaattggaaactccaacaaactaaaagaagatgttggacccaaccttacacttggattagactccaaacaccttttgtcaatggaggttgtgtctgattttagtcccatgaacagctccgaacaaccaaaggaagcggaagaagaggtaacattgtcaacaaatcaatcagcaaaagtgataaatgtaaatgatgacatgtcagatcaaatgccagccaagagagccagggtatctgtgagagctagatgtgatactcccacgatgaatgatggatgccagtggaggaaatatggacagaagatagcaaagaggaatccttgtccaagggcatactatcgttgcacagttgcaccaacttgcccagtcaggaggcaggtgcaaaggtgtgctgaggacttgtccatcttaatcaccacatatgaaggaactcataaccaccctcttccagtttcagccacagccatggcttcaaccacttcagctgctgcttccatgctgttgtcaggttcttcaacatctcaccacccaacaaaccacaattctgcatcttttggaaatgctcctaccacactacaaagtggtctgagtttcagtcaccagtttgatgaatcaagaaccaaacaagttttctcacccccaaaccatgcttcactacacatgttcccaacaatcactctagacatgacttattcagcttctaattcctcctcattaactcaattccatcatcgcttaccttcaacaatggcatcaatttcaaacttaaaattttctccagctagtctcagctgttcacaagataataacttcataccctccatttggagtaaggggggtgacactacaacaccaccaataattgacaaaatccccactaggccagttatcaagggaaatccatatttccaagaaaatttctaccaacaaagcataacaaaccaaactcctttcaaagaagctttggcagaaacaataaccaaagcaatcagcacagacccgagtcttcgttcagtaatagctgctgcagtttcatcaatagtggggaatggatcaaacagtgggaaccaagaaggagcagagaatgttcttggttcagggttgaacttaaaacttggggatcatcttcaattggcttcatccaatcccttgaaccaaaatgggaaagggtgcttaacaggctacttcaaaagtttgtcctctaagaattccgaggcaggaaacttcatttttctccaaccaccattgccattttctttctccaagagtggcacaaatcagctcaaccattatgttccagaaatgaacacacatcat

SEQ ID NO: 312 - protein, 548 aa, Glycine max
  Glyma09g37470.1
EIVIIEAMSKISGPSGPDEIEEKRVTKEEKIKSAKTEMGEVKEENERLKMMLERVEKDYHSLQLRFFDIHHEDVSKKGLADSSTCHDHETEELVSLCLGRSPMVPKKEARIGNSNKLKEDVGPNLTLGLDSKHLLSMEVVSDFSPMNSSEQPKEAEEEVTLSTNQSAKVINVNDDMSDQMPAKRARVSVRARCDTPTMNDGCQWRKYGQKIAKRNPCPRAYYRCTVAPTCPVRRQVQRCAEDLSILITTYEGTHNHPLPVSATAMASTTSAAASMLLSGSSTSHHPTNHNSASFGNAPTTLQSGLSFSHQFDESRTKQVFSPPNHASLHMFPTITLDMTYSASNSSSLTQFHHRLPSTMASISNLKFSPASLSCSQDNNFIPSIWSKGGDTTTPPIIDKIPTRPVIKGNPYFQENFYQQSITNQTPFKEALAETITKAISTDPSLRSVIAAAVSSIVGNGSNSGNQEGAENVLGSGLNLKLGDHLQLASSNPLNQNGKGCLTGYFKSLSSKNSEAGNFIFLQPPLPFSFSKSGTNQLNHYVPEMNTHH

SEQ ID NO: 313 - DNA, 1413 bp, Glycine max
  Glyma18g49140.1
atgtcaaaaatgtctagccccaatggtccagagatagaagagaagagagttacaaaggaagataaattcaaatctgctaaaactgaaatgggtgaggtgaaggaagaaaatgagagattgaagatgatgctggaaagagtagaaaaggactatcactcccttcaactccgtttctttgacatccttcacaaagatgtttcaaagaagggtttagctgtttcatctacttcccttgatcatgaaactgcagagcctgagcttgtgtcactttgccttggaaggagtccaatggagcctaagaaagaattagcaagaattggatactccaacaaaccaaaagaagaagacgttggacccaaccttactcttggattagactccaaacaccttttctcagaagaaccaaaggaagtagaagctgagggaacaaatcaatcagcaaaagtgataaatatgaatgatggatgccagtggaggaaatatggacagaagatagcaaagggaaatccatgtccaagggcatactatcgttgcacagttgcaccaacatgtccagtcaggaagcaggtgcaaaggtgtgctgaggacttgtccatcttaatcaccacatatgaaggaacacacaaccaccctcttgcagtttcagccacagccatggcttcaaccacttcagctgctgcttccatgctgttgtcaggttcttcaacatctcaccttacaagccacaattctgcatcttttggaaatgctcctaccacactactcaatgccaaacaaatgttgtcaccaccaaaccatgtctcaccaaatctgttttcaacaatcactttagacatgacttcttcagcttctaattcctcctcatcaactcaattccatcatcgcttaccttcgacgatagcttcaatttcaaacccaaaattttctccagctagtctcagcttttgttcccaagataataacttcataccatccatttggggtaaggggggtgacacttccacaacaccaattgacaaaatccccatgactaggccacaaactccttccaaagaagctttggcagaaacaataacaaaggcaatcagcacagacccgagtcttcgttcagtaatagctgctgcagtttcatcaatagtggggaatggatcaagcagtgggaaccaagaggaatcagacaatgttcttggttcagggttgaacttaaaacttggggagcattttcaattggcttcacccaatcccttgaaccagaataggaaagaatgcttaacaagctacttcaaaagtttgtcctcaaagaattctgaggcaggaagcttcatttttctccaaccaccattgccattttctttctccaagagtagcacaaatcaggtcaaccattatgttcaagaaatgaactcacatcat

SEQ ID NO: 314 - protein, 471 aa, Glycine max
  Glyma18g49140.1
MSKMSSPNGPEIEEKRVTKEDKFKSAKTEMGEVKEENERLKMMLERVEKDYHSLQLRFFDILHKDVSKKGLAVSSTSLDHETAEPELVSLCLGRSPMEPKKELARIGYSNKPKEEDVGPNLTLGLDSKHLFSEEPKEVEAEGTNQSAKVINMNDGCQWRKYGQKIAKGNPCPRAYYRCTVAPTCPVRKQVQRCAEDLSILITTYEGTHNHPLAVSATAMASTTSAAASMLLSGSSTSHLTSHNSASFGNAPTTLLNAKQMLSPPNHVSPNLFSTITLDMTSSASNSSSSTQFHHRLPSTIASISNPKFSPASLSFCSQDNNFIPSIWGKGGDTSTTPIDKIPMTRPQTPSKEALAETITKAISTDPSLRSVIAAAVSSIVGNGSSSGNQEESDNVLGSGLNLKLGEHFQLASPNPLNQNRKECLTSYFKSLSSKNSEAGSFIFLQPPLPFSFSKSSTNQVNHYVQEMNSHH

SEQ ID NO: 315 - DNA, 1466 bp, Glycine max
  Glyma19g02440.1
atggaggccatgttaaaattgtctagtctttgtggtcaagagatagatgataagagagatacttccatttgctcagaagaggacttgtgtattgaaaagggtagtaaggaagataaacttgaatctgctaaagctgagatgagtaaggtgaaggaggagaatgaaagattgaagatgatgatagaaagagtaggaaagaattaccattctcttcaacttcgtttctttgacatccttcatagagaaacttcaaacaaaggtgtggaagattcagctgtttcccttgatgaagtggaggaacctaagcttgtgtcactttgtcttggaacaagtccatgggagcataaaaaggatggaataatctgtaactctagcaaacataaagaaaatgaagatttggaagccagccttacccttggtttagactgcaaaggtgtgtcttcaaaggaacaggtatctgatatgaacacctcagaagaaaaggaagaagattcaacaaataaattagtaaggaccaaagatggaggtgatgaaatttcagagataacacccccagccaagagggctagagtttgtgtcagagcaagatgtgatagtcccgttatgcatgatggatgccagtggaggaaatatggacagaagatagcaaaaggaaatccatgtccaagagcatactatcgttgcacacttgctccagcatgcccggttaggaaacaggtgcaaagatgtgctgatgacatgtccatcttaatcaccacatatgaaggaactcacaaccacccaattccagcttcagccacagccatggcttccaccacttctgctgctgtttccatgttgttgtcaggctcttcaacatctcagcctacagatcacagttttgcctatcatgcaaattctcctacactgttcagtggtgtcaatttcagtcttttagaccaaccaagagcaaaccaagtcttgttaccaaccccttcctcacatttactcccaacaatcactctagaccttacttctactccatcctattcattaaatcaagggaattgtttaccatcaaactttgcttcaaccccaagattccctccattaagtctaaacttttggtccccagagtccaacattccactatccttttggggcaagggaattcctaacaatggcactattcctattgacaaaactcacatcaagccattcaatataggaaaccaatttcaagaacatttctaccaacattacttcaagaaccaaactccattcagggaggctttggcagaaacactaaccaaagcaatcagcacagacacgagttttcggtcagcgatagctgctgcagtttcatctataaggggacaaggatcaagcagtgagaacaagggtgatggagaggttttaggttcaggattgagcttgaaacttggggagcatcctcaacttgcttcttccaattccttgaacaagaa

SEQ ID NO: 316 - protein, 490 aa, Glycine max
  misc_feature (490)..(490): Xaa can be any naturally occurring amino acid
  Glyma19g02440.1
MEAMLKLSSLCGQEIDDKRDTSICSEEDLCIEKGSKEDKLESAKAEMSKVKEENERLKMMIERVGKNYHSLQLRFFDILHRETSNKGVEDSAVSLDEVEEPKLVSLCLGTSPWEHKKDGIICNSSKHKENEDLEASLTLGLDCKGVSSKEQVSDMNTSEEKEEDSTNKLVRTKDGGDEISEITPPAKRARVCVRARCDSPVMHDGCQWRKYGQKIAKGNPCPRAYYRCTLAPACPVRKQVQRCADDMSILITTYEGTHNHPIPASATAMASTTSAAVSMLLSGSSTSQPTDHSFAYHANSPTLFSGVNFSLLDQPRANQVLLPTPSSHLLPTITLDLTSTPSYSLNQGNCLPSNFASTPRFPPLSLNFWSPESNIPLSFWGKGIPNNGTIPIDKTHIKPFNIGNQFQEHFYQHYFKNQTPFREALAETLTKAISTDTSFRSAIAAAVSSIRGQGSSSENKGDGEVLGSGLSLKLGEHPQLASSNSLNKNX

SEQ ID NO: 317 - DNA, 1614 bp, Populus trichocarpa
  POPTR_0017s11570.1
atgtcaagttccggtggtgcagctatagaagaaagggcggtgcaatttggattgactagccgtgaagattcaggcagcagtcaagaggctaagaaggaggaagtaattgaatctgccaaaagcgaaatgggtgatgtgagagaagaaaatcacagattaaagatgatgctggagcgaattgagaaagattaccagtctctccagttgcgctttttcgacattcttcagcacgaaactagttctaagcaatctacagattcagccccatcccatgatgaaactgaagaatctaatgagctggtgtcactttgccttggaagaagtccaagcgagcctaaaaaggaagaaaagtctacaaactctgccaaaagtagggaaaatgaagagttgaaggctaacttgactcttggattggattccaagattctgacatccacagaaactgcgtcaaatccaagccccgcagaaagtgtagaagaaccgaaggaagaagctggagaaacatggccaccaagcaagattattccaaaaagaaatggagatcatgatgaggctgcacaacaaagtcaagcgaaaagagccagggtttgtgtgagaacaagatgtgagacacccacaatgaatgatggatgccagtggaggaaatatggacagaaaatttccaaaggaaatccatgcccacgagcatattatcgttgcactgttgcaccattatgtccagtaagaaaacaggtgcaaagatgtgctgaggacacgtcgatcttgatcactacctatgaaggaacacataaccacccacttccagtttcagccacagccatggcttctaccacctcggcagctgcttcgatgttattatctggctcttcaacctctcagcaaggccttggttcccatatcaatgcgacctctgctcgtactgaactcaacggagtaagcttcagtcttcacgatcatttgagagcaaagcaaatctactttccaaattcttcctcgccaacgttcccaacaattactttagaccttaccacctctccctctacttcaactactcctttcggtaggttctcttcaagcttcagttcaacctcaagatatccctcaacaagtcttaacttttcttccaccgaacccaactctctacccccaatatggggaaacgggctccataattatggcacacgatcctataatcatcaacaattatatcaatcattcatggagaagaaccaccaggccgcagcttctcaacaggttttaacagataccttaacaaaggcaataacgtcggatccaagttttcgaacagtaatcgccacggctatttcatcaatgattggaggtggaggtagtgcaattgcaaacaatagaaaccaaagggccggggatcagaattgttttgggcagaacttgaactttggcgagaccatgactacatcggcattctccatcaattcattgtcccagaacgggaaaggatgtgcatcaagctgtttcaatggattgtcatcttcgacatctcagaagggaagcagtcagcttcaaccggcattgccattttctgtatttaacagtgcctctatgcctaataatgacaatgaggaacacaagagt

SEQ ID NO: 318 - protein, 538 aa, Populus trichocarpa
  POPTR_0017s11570.1
MSSSGGAAIEERAVQFGLTSREDSGSSQEAKKEEVIESAKSEMGDVREENHRLKMMLERIEKDYQSLQLRFFDILQHETSSKQSTDSAPSHDETEESNELVSLCLGRSPSEPKKEEKSTNSAKSRENEELKANLTLGLDSKILTSTETASNPSPAESVEEPKEEAGETWPPSKIIPKRNGDHDEAAQQSQAKRARVCVRTRCETPTMNDGCQWRKYGQKISKGNPCPRAYYRCTVAPLCPVRKQVQRCAEDTSILITTYEGTHNHPLPVSATAMASTTSAAASMLLSGSSTSQQGLGSHINATSARTELNGVSFSLHDHLRAKQIYFPNSSSPTFPTITLDLTTSPSTSTTPFGRFSSSFSSTSRYPSTSLNFSSTEPNSLPPIWGNGLHNYGTRSYNHQQLYQSFMEKNHQAAASQQVLTDTLTKAITSDPSFRTVIATAISSMIGGGGSAIANNRNQRAGDQNCFGQNLNFGETMTTSAFSINSLSQNGKGCASSCFNGLSSSTSQKGSSQLQPALPFSVFNSASMPNNDNEEHKS

SEQ ID NO: 319 - DNA, 1506 bp, Vitis vinifera
  GSVIVT01011356001
atgggggaggtgagagaagaaaatgagagactaaagaccatgttggagaaaattgggaaggattataagtctcttcaactgcaggtttttgacattcttcaacaagaatcctccaagaggcctgtggattcagctcctgccattgatgaagaatccaaagaactcgaactagtttccctttgccttggaagaagtagtccaactgatggtaaaagagatggtaagtccagcatcgctagcaaggccaaggaagacgacgatgagctgaatgctggtctcacccttggtttagactcaaaatttcaagtgtctaaactggatgtgacagagtttgcgtccaactcgagtccaaccgagaatagtatcgaggaggtgaaggaagaggaagctggggagacatggcctcccagtaaagttttgaagacaatgagaaccggagatgaggtttcacagcagtcccatgtgaagagagccagggtttcagttagagctcgatgtgacacgctaacgatgaatgatgggtgccaatggaggaaatatggacagaaaatagctaaggggaatccatgcccacgagcttattatcggtgtacagttgcaccatcttgcccagtgagaaagcaggtgcagagatgtgcagaggacatgtccattttgatcactacctatgaaggaactcacaaccacccacttccgatgtcagccacagccatggcttccaccacctctgctgcagcttccatgctcatctccggctcttctgcctctcagccaggccttggttcctcacctgctgctactgagctccatgggttgaacttcagtctccctgataatatgagaacaaggcagctctatgcagcaaactcttccccatttccaactattactctagacctcaccactacagcttcatcatcctctcatttcagcaggttttcctcaagcttcaattctagcaccccaaggttcccgtcaacaagtcttagcttttcttcctcagaatccaacagtgtacctacagtttggggcaatgggtgccttaattatggcatactaccacataataaagctcaaatagggtctctaaatcttggaagacaaccaccagaacattttcatcaaccctacatggaaaagaacggccaagcacctattcaacagtccttaactgaaacattgaccaaggtgataacatcagacccaagttttcggacagttatagctgcggcgctctcatcaatggttagcagcagtaccggccaaccaaacccaggtgcaggagagagcttgggccagaatttgaagtggggtgagactactcaggccatttctaccaacccattgagccagaatgggaagggatgtgcacctgggtacttaaatgcgtcatcatcttcaaattctcagacaggaaactccatcctcctccagcctccatttccagtttccatccctagaagtggtacttctgggtctgctgctgagaacagggaccagaacaac

SEQ ID NO: 320 - protein, 502 aa, Vitis vinifera
  GSVIVT01011356001
MGEVREENERLKTMLEKIGKDYKSLQLQVFDILQQESSKRPVDSAPAIDEESKELELVSLCLGRSSPTDGKRDGKSSIASKAKEDDDELNAGLTLGLDSKFQVSKLDVTEFASNSSPTENSIEEVKEEEAGETWPPSKVLKTMRTGDEVSQQSHVKRARVSVRARCDTLTMNDGCQWRKYGQKIAKGNPCPRAYYRCTVAPSCPVRKQVQRCAEDMSILITTYEGTHNHPLPMSATAMASTTSAAASMLISGSSASQPGLGSSPAATELHGLNFSLPDNMRTRQLYAANSSPFPTITLDLTTTASSSSHFSRFSSSFNSSTPRFPSTSLSFSSSESNSVPTVWGNGCLNYGILPHNKAQIGSLNLGRQPPEHFHQPYMEKNGQAPIQQSLTETLTKVITSDPSFRTVIAAALSSMVSSSTGQPNPGAGESLGQNLKWGETTQAISTNPLSQNGKGCAPGYLNASSSSNSQTGNSILLQPPFPVSIPRSGTSGSAAENRDQNN

SEQ ID NO: 321 - DNA, 1320 bp, Solanum lycopersicum
  Solyc02g067430.2.1
atggagaaaaaaagggataattccatctcaagtgctaataatcatgaagaagaagatgtcaaaaaaatttcaaaggatgatgaattcaagtcagccatagcagaagtgaataaaatcaaactagagaacgcaagattaaagttgttgcttcaacagatagaaaaggattacacgtctctccagactcgatttttcaatatttgtcaaccagatttcaagaagagcagcggcagcccaacatgtacacatgaaaacattgcagatgaagaagaatctgaactcgtctcgcttagactcgggcgaagtccgagtccaagcgaatacaaaaaagttgacaagaaaagaagttatgacaagacaatagaggactctccttcttgcaatgatcagtccaataatgggcttaaacttgggctggactacagcactggtgtatgtgaatcagaatttataaagcccagtaatgatccaagcccaggcccaactagtgaagttgtcaaaacagtgaaaaaatgtgatgatgaaagtatcaaaaaggatgatgaagtttctcagcctaatgtcaagagagctagagtttcggttcgaaccaagtgcgattacccaacaataaatgatggttgtcaatggagaaaatacggacaaaagatatctagaggtaatccatgtccacgatcatattatcgttgctcagtggctccattatgtcccgtgaggaaacaagtccaacggtgtctcgaagacatgtctatattgatcacaacatatgaaggaacacataatcattcacttcctattgaggccacagctatggcctctacaacttctgctgcagcctctatgcttctttcgggttcatcaacaagttttcaaacatccaaaaatttgccaaatatttcgaaaactacacctctctatttatccaattcatcttcaaatccttttcccaccatcacattagacttcaccacattccctactacttcatcattcactagtttcaatttcccttccaatttccaatccggtttaggatttctctctaacagtttaagcttttcctcgactgagtcgaccacaatgccaattttgggcagtgggggtctaaattatgattctactagtacattaccatatcacaataacctcataaacattggctcatcccacaaacaatttgacactagtagtaataaattgaaggaggattcttctcaacaagcactaactgaaacattgacaaaggcaattacatcagatcctagctttcaatcagtgctagctgctgctatttcatcaatggttggtgccaccaaaact

SEQ ID NO: 322 - protein, 440 aa, Solanum lycopersicum
  Solyc02g067430.2.1
MEKKRDNSISSANNHEEEDVKKISKDDEFKSAIAEVNKIKLENARLKLLLQQIEKDYTSLQTRFFNICQPDFKKSSGSPTCTHENIADEEESELVSLRLGRSPSPSEYKKVDKKRSYDKTIEDSPSCNDQSNNGLKLGLDYSTGVCESEFIKPSNDPSPGPTSEVVKTVKKCDDESIKKDDEVSQPNVKRARVSVRTKCDYPTINDGCQWRKYGQKISRGNPCPRSYYRCSVAPLCPVRKQVQRCLEDMSILITTYEGTHNHSLPIEATAMASTTSAAASMLLSGSSTSFQTSKNLPNISKTTPLYLSNSSSNPFPTITLDFTTFPTTSSFTSFNFPSNFQSGLGFLSNSLSFSSTESTTMPILGSGGLNYDSTSTLPYHNNLINIGSSHKQFDTSSNKLKEDSSQQALTETLTKAITSDPSFQSVLAAAISSMVGATKT

SEQ ID NO: 323 - DNA, 1575 bp, Citrus clementina
  clementine0.9_007342m
atgggtgaggtgagacaagaaaatgaaaaactgaagatgtacctaaatcgcattatgaaggattaccagacccttcaaacgcaatttgttaacattgttcaccaagaagcaaagaaatcaacagaaacatctaatgatcatgaccgtgacaaggaagaagttgagcttgtatctcttagcctcggaagatttccaagtgattcaaaaaaggatgaaaagaacaagacctcttctctggttaaagaggagaaacaatttcaagaaggcttgtctcttgcactagactgcaaatttgaagcgtctaataaatcagacgcaaacgaatctctgactaatcggagccccgcacagagtcttgaagaaccaaaggaggaagctggggagacatggccacccggtaaaggtcttaataagacaatgagaaatggagatgatgaaatgttgcaacaaagtcatgtcaagaaagctagggtttctgtgagggctagatgtgatactccaacgatgaatgatggttgccaatggaggaaatatggacaaaagattgccaaaggaaacccctgcccccgagcctactatcgctgcactgttgcaccttcatgccctgtacgaaaacaggtccaaagatgtgctgaggacatgtccgtcttaatcacaacctatgaaggaacccacaaccacccacttcctgtctcggccacagcaatggcttccaccacttctgcggctgcttcaatgctattgtccggctcaacatcgtcatcatcatcaagctctcgccctggttccaccgccgcaatcacagcacccaataatctccttatgcacggactcaacttttacctatctgataagtcaaagcaaatctatgcacccaactcctcttcatcactgtcagcttcacctttacacccaacaattacccttgatctcacaacaactacagcaccctcttcttcttcgtctccattcagtaggtttacttcaaattatcccccagccccgagatactcttccacaaatctcaacttcagttccacagaatcaagttcattgatgtcatggagtaataatgggctacttagctatggcagttgcactcaaccgtacatcaaaaacaatcaaattggatctttaaacatgggaagcaggcagccagcagataatatctttcaatcctacatgcaaaagaataaccctaaccctaatcttcctcctcaacagtctttacctgcggagacaatagcagccgctaccaaagcaataacagcggacccaagtttccaatctgctttagctgttgctcttaaatcaatcattggaaatggcaatggtagtggtgtaaataataatcaggtcaacggagataatttagggcagaaactcaagtggggtgagcaatttctagaaacagtgaagggtggtggttgcgcaacaagctacttgaacaaatcatcttcagcaagttctcatcaccagccaggaagtttgatttttctgccgcctaattctttgccattttcaacttctaagagtgcttctgcatctcctgctgacgatagagagcacactgat

SEQ ID NO: 324 - protein, 525 aa, Citrus clementina
  clementine0.9_007342m
MGEVRQENEKLKMYLNRIMKDYQTLQTQFVNIVHQEAKKSTETSNDHDRDKEEVELVSLSLGRFPSDSKKDEKNKTSSLVKEEKQFQEGLSLALDCKFEASNKSDANESLTNRSPAQSLEEPKEEAGETWPPGKGLNKTMRNGDDEMLQQSHVKKARVSVRARCDTPTMNDGCQWRKYGQKIAKGNPCPRAYYRCTVAPSCPVRKQVQRCAEDMSVLITTYEGTHNHPLPVSATAMASTTSAAASMLLSGSTSSSSSSSRPGSTAAITAPNNLLMHGLNFYLSDKSKQIYAPNSSSSLSASPLHPTITLDLTTTTAPSSSSSPFSRFTSNYPPAPRYSSTNLNFSSTESSSLMSWSNNGLLSYGSCTQPYIKNNQIGSLNMGSRQPADNIFQSYMQKNNPNPNLPPQQSLPAETIAAATKAITADPSFQSALAVALKSIIGNGNGSGVNNNQVNGDNLGQKLKWGEQFLETVKGGGCATSYLNKSSSASSHHQPGSLIFLPPNSLPFSTSKSASASPADDREHTD

SEQ ID NO: 325 - DNA, 1695 bp, Populus trichocarpa
  POPTR_0015s07530.1
atgcttaaacaggtgattgtagcgactaaaaatgaaagaatcaccacggaagctgatgcaaaagaatcttcctgccaaaaggaacaggatgatcagcttgaatctgcaagagctgagatgggtgaagtaagaaaagaaaatcaaaggctaaaaatacatttggatcgtgtagtgaaggattatcggacccttcaagtgcaattctatgagattattcagcaagaagaaactaagaaatctacagatactgtcgatgatcatcaaggaactgaagaacacgagctcgtgtcgcttacccttggaagaatttcgagtgaacctaaacgggatggaaagaacaataaaacttctagccaggggaaaaatcacgatgagcaagttaaagaaagcctctctcttggatcactctgcacatttgaagcgtctaaatctgctaccaatgagactttgccgaatccaagccccgtgaacagttttggtgagccaaaggaagaagccggggagacttggccacccagtaaagctctcaagacaatgcgaggaggagatgatgaagttccccagcaaaaccctgcaaagaaagctagggtttctgtcagagctagatgcgataccccaacgatgaatgacgggtgccaatggagaaaatatgggcaaaaaattgccaaagggaacccatgtcctcgagcatactatcgctgcactgttgcaccatcatgcccagtacggaaacaggtacaaagatgtgctgaagatatgtccatcttaaccaccacctatgaaggaacgcacaaccacccacttcctatttctgccacggctatggcttctacaacttctgcagctgcttccatgttactgtctggctcatcatcgagctctgcaggaactgcaggtttcaataactccggcaccatcgccgttgacctccatggactaaactactatctatccgataactcaaaatcaaagcaattctacttgcacaactcttcactgtcatcttcatctccataccctacaatcactcttgacctcacttcaaacccatccagtgcttcatctcatttcaatagatttactacttcaagctaccggcctaccattcaaaaatttgcttcaacaagcctcaactttggctcctctgattcgtctaacgcaatgccttggggcaatggtttcctcactgcttccggccagtctcacaacaggattaaccaacttggaactttaaacattggaagaccagctatggatcagagtaacatttatgatcagttctacacgcaaaacattaatgacctggcagctgctacttctcagcagtccctgtcagccgataccatagctgctgcaaccaaggcaattacagcagacccaagtttccaatctgctttagcagctgccctcacttctatcattggcactggaactggcagtagcgctactggtgttgcaaatctaggtgttgttaataatttatttccaaagtcggaacggggaccggttattaatagcttctcatcatcacctcctaacggcaatccatgtgcaagctacttcaacaaaacgacgtcttcaataaattctcagccagctccaagttcgatgacaatgtttgtgccaccttcattgccattttctactcctacgaatgcatccgcgtctgctgttgacaagaatgatcgtgccaac

SEQ ID NO: 326 - protein, 565 aa, Populus trichocarpa
  POPTR_0015s07530.1
MLKQVIVATKNERITTEADAKESSCQKEQDDQLESARAEMGEVRKENQRLKIHLDRVVKDYRTLQVQFYEIIQQEETKKSTDTVDDHQGTEEHELVSLTLGRISSEPKRDGKNNKTSSQGKNHDEQVKESLSLGSLCTFEASKSATNETLPNPSPVNSFGEPKEEAGETWPPSKALKTMRGGDDEVPQQNPAKKARVSVRARCDTPTMNDGCQWRKYGQKIAKGNPCPRAYYRCTVAPSCPVRKQVQRCAEDMSILTTTYEGTHNHPLPISATAMASTTSAAASMLLSGSSSSSAGTAGFNNSGTIAVDLHGLNYYLSDNSKSKQFYLHNSSLSSSSPYPTITLDLTSNPSSASSHFNRFTTSSYRPTIQKFASTSLNFGSSDSSNAMPWGNGFLTASGQSHNRINQLGTLNIGRPAMDQSNIYDQFYTQNINDLAAATSQQSLSADTIAAATKAITADPSFQSALAAALTSIIGTGTGSSATGVANLGVVNNLFPKSERGPVINSFSSSPPNGNPCASYFNKTTSSINSQPAPSSMTMFVPPSLPFSTPTNASASAVDKNDRAN

SEQ ID NO: 327 - DNA, 1638 bp, Eucalyptus grandis
  Eucgr.B00437.1
atgggcgaggtgcgagaagagaatcagaggctaaagacgtacttggaccgcataatgaaagattacaagaccctccaaatgcagttcttcgacatcgtcaagcccgatcaggagcagcagaaaccttcagaggacgaagcaatgactaatggtaacgatgacaagcagcgagctgaagagtctgaagagcttgtttctctcagcctgggaagatccccctcaagccagcactcagagaaagacgatgagaaaaataagtcgccgatttcaccccgtccagggaagttgttattcttagagaatatcagcaaagaacagcacttggatctctcattggactgcaaattatctgatgcatcgactactggtctggttgaaactttgccaaagaataataatgataacagcaagggtagtcctgcgactagcttcgaagatcatcaaaaggaagaagccgctgagacttggtcacccaacaaagtcctaaaaacaatgagatcaggtggggatgatgaggtttcccagcaaaacccagtcaagaaagctagggtttcggtgcgggctcgatgcgacgcagcgacgatgaacgatggatgccaatggcgaaagtatggccagaagattgcgaaaggaaacccatgccctcgagcttactatcggtgcacggttgcaccatcgtgtcccgtaagaaaacaggtgcaaaggtgtgctgaggacatgtccattctgataaccacatatgaaggcacacataaccacccgcttccgatgtcagccactgctatggcttccaccacctcggcggccgctgccatgctgttgtccggctcctcaagctcgcagccaggacagagtcacggcacatccaccactattggggccggccttcacggacttaacttttgtccgcttgatgcttcgagatcgaatcaattttacctgccgagctcggtcatgccatctgctcctgcccacccgacaatcactctcgacctcacttcctcaaacttatcatcggcatcgtcgacttcatcgcatttcaatcgattctcctcccatactttcccttcggcaacgtcaagatattcttccacaagtttaagctttagttcgcctgatcaatctgataataatcttcccatgtcatgggctaataatgggctccttaactacgccacccaactccaaaacaagaaccacacagcttatcaaccctacttgcagatgaagaacaaccctagccttcctcaacaatctctaccagacaacattgctgccgcaaccaaggcgatcacagcagaccccaacttccaatccgccctagtagtcgctctcaagtcgatcatcggcaatggtagcagtggagctgtcccagcgactataggggatcattctcacggagtgggagacagcaacagctttggccacaagttgaggtggagcaccgaacccttttcgacagcctcttctctcctcccccagacgttacaagcaaacgggtgctcgtcgagtttcttgaacagatcaagcttgtcttctcaacttggaagttttgtgatcccacctccttcgttgccattctctttgtcaaaaagacccgcgtccccgaacgataacagggatcgcacaaatttgtta

SEQ ID NO: 328 - protein, 546 aa, Eucalyptus grandis
  Eucgr.B00437.1
MGEVREENQRLKTYLDRIMKDYKTLQMQFFDIVKPDQEQQKPSEDEAMTNGNDDKQRAEESEELVSLSLGRSPSSQHSEKDDEKNKSPISPRPGKLLFLENISKEQHLDLSLDCKLSDASTTGLVETLPKNNNDNSKGSPATSFEDHQKEEAAETWSPNKVLKTMRSGGDDEVSQQNPVKKARVSVRARCDAATMNDGCQWRKYGQKIAKGNPCPRAYYRCTVAPSCPVRKQVQRCAEDMSILITTYEGTHNHPLPMSATAMASTTSAAAAMLLSGSSSSQPGQSHGTSTTIGAGLHGLNFCPLDASRSNQFYLPSSVMPSAPAHPTITLDLTSSNLSSASSTSSHFNRFSSHTFPSATSRYSSTSLSFSSPDQSDNNLPMSWANNGLLNYATQLQNKNHTAYQPYLQMKNNPSLPQQSLPDNIAAATKAITADPNFQSALVVALKSIIGNGSSGAVPATIGDHSHGVGDSNSFGHKLRWSTEPFSTASSLLPQTLQANGCSSSFLNRSSLSSQLGSFVIPPPSLPFSLSKRPASPNDNRDRTNLL

SEQ ID NO: 329 - DNA, 1638 bp, Eucalyptus grandis
  Eucgr.K02453.1
atggaggatgcttttgaaaggtctggtcatggaggtgttgatgttgtcaaggaagagaagagagttgatgatgaaaattctgatcatcatgatggtggtggacagtatagcagagaagtggtgcttgttcaagaggtcaaaaataaaatgccaccaaaagaaagcgaaaattcaaagccgtcttctccgaaccagatgatctcgtccccaagaagaaaggaagatcaacatcagcttgaatctgcgagagctgaaatgagtcaagtaagagaggagaaccagaaactgaagatgtatttgaatcaaataatgagagactatcggacactccaaatgaaattcttcgatgctgtcaagcaagaagatgacaataagaaatcggccaatgccaccaaggggagttgccgagagattgatcaggaatctgatgaacttgtctctctcagcctaggaagagcaacaagtgattcgaagaaattatcattagaggataagaataaatcacttgcccaagtgaaagacaatactaatgatcataagtttgaagaaggcttgggcttcggactggactacaagttggaactgttgacatctggaacgacagaatcgttgccgaacccgagcccagatacgagtattgaggaagcaaaggaggaagctggagagacatggccgccaggcatagtcaaaaagacaatgagaaccagttgtgatgatgaagtctcccagcaaaatcctgtgaaaaaggctagggtttctgtgagagctagatgtgacactccaacgatgaacgatggatgtcaatggagaaaatatgggcaaaagatcgcgaaaggaaatccatgtcctcgagcatattatcgttgcactgttgcgccatcctgcccagtgagaaaacaggttcaaagatgtgccgaggatatgtccatcttggtcaccacctacgagggcacgcacaaccacccgcttcctatgtcagccaccgccatggcctccaccacctccgcggctgcccacatgcttctatccggctcatcgacctctcaaaacattagcagtcacggctcatcgagcctcaccatggcacccatggctgccaatctccaaggcctaagcttttaccaatcggaagcttccaaagcaagatcgccattctatttgcctaccacatcgtttgcatcctcatccacaccaaccatcactcttgatctcacgtcaaacccattatcatcttcctcatcatcctctctgttcaataggtttcctttacaatacccttcaacaaggttctcttccacaagcctaagctttaacaattccttcgagtctagtgcccttcccttgccttgggggtcctcaaatggtggcctgatgaactataacacctctcaactcttcaacaagaaccaagccctagaccttgcaaagcaggctcaagaaagttaccatcagtcctacacgcaaaagaacatgtcgagccttccccaacaagcgctaccggaatccattgctgctgccacaaaggcgatcactgccgatccgagcttccaatctgctttggcggcagctctaaagtcgatcatcggtaatggtggaggtggaaatagtaaccagggaggcgttgatcatttcagaaat

SEQ ID NO: 330 - protein, 546 aa, Eucalyptus grandis
  Eucgr.K02453.1
MEDAFERSGHGGVDVVKEEKRVDDENSDHHDGGGQYSREVVLVQEVKNKMPPKESENSKPSSPNQMISSPRRKEDQHQLESARAEMSQVREENQKLKMYLNQIMRDYRTLQMKFFDAVKQEDDNKKSANATKGSCREIDQESDELVSLSLGRATSDSKKLSLEDKNKSLAQVKDNTNDHKFEEGLGFGLDYKLELLTSGTTESLPNPSPDTSIEEAKEEAGETWPPGIVKKTMRTSCDDEVSQQNPVKKARVSVRARCDTPTMNDGCQWRKYGQKIAKGNPCPRAYYRCTVAPSCPVRKQVQRCAEDMSILVTTYEGTHNHPLPMSATAMASTTSAAAHMLLSGSSTSQNISSHGSSSLTMAPMAANLQGLSFYQSEASKARSPFYLPTTSFASSSTPTITLDLTSNPLSSSSSSSLFNRFPLQYPSTRFSSTSLSFNNSFESSALPLPWGSSNGGLMNYNTSQLFNKNQALDLAKQAQESYHQSYTQKNMSSLPQQALPESIAAATKAITADPSFQSALAAALKSIIGNGGGGNSNQGGVDHFRN

SEQ ID NO: 331 - DNA, 1476 bp, Glycine max
  Glyma04g34220.1
gctgttgatgaacttgaaactgccaaagccgaaatgggtgaagtgatggaagaaaatcaacgactaaagacgtgtttgagccgaatactaaacgattaccgcacactccaaatgcaattccacaacagagttgaacaagagacaaaagactcttctgatcagaaagtgaacaacaacaatgaccatcaaagagaggaatcagacctagtttccctcagtcttggaagacttccaactagaaacaatgagaaagttaataataaaccattgaaagaggaagaaaaagaagataaagaaggctttgttgaagaagtgccaaaggaagaagcagcaggtgagagttggccacaaaggaagggacacaagacagctagagatactactggtgaggatgaagtttctcaacaaaatcctgcaaagaaagcaagggtttgtgttagggcaagatgtggcaccgcaactatgaatgatgggtgtcaatggaggaaatatggacagaaaatttcaaagggaaatccttgccctcgagcttactatcgttgcacggttgcaccatcatgccccgtaagaaagcaggtgcaaagatgtgctcaagacatgtccatattaatgaccacctacgaaggtaaccacaaccaccctcttccactttcagccacagccatggcctccaccatttcagcagctgcttccatgctattatccggctcatcaacctcacactccggatcaaggccttcaacagccatgaccaccgccgcttcctatcagacggttccaaatcaaagcaatacttacttgtcccatcctgcagcactctcatcttcaccttcacaccccaccatcactctagacctcacttccaataataatccatcctcatcttctgttcctcttgttaaattcacttcgaattcaacctttaataacccacaaaggtaccctctttccacaagcctaaacttcagttactcagaatccaataatgcaacttcttggagcaataatgggttcctcagctacaacaacactctaccatataatagcaatagaaatgtgacaaatgtccttagcaacataaaccttggaaaacaacaacaacgaccattggaaaacatctacaattcctacctgcaaagaaacaacaatattaatccaatcccgccaccacaacattctctaccagacaccatagctgcagcaacaaaagaaaacctgagtcagcaaatgaaatggggtgaattgtttccttcatcttcttctgcattaccttcatcttcaacaaaagtcaatggttgtgcatcaagcttcttgaacaaatcagccgctaatacaaaaccaggaacaactttgatgtttcttcagccacttttgcctctttctagccccaaaagcgcttctggaacatacgcatgtgatgttcacactttcatcaatttcaaaaattatagtatgaaaagtagtctaacaatctta

SEQ ID NO: 332 - protein, 492 aa, Glycine max
  Glyma04g34220.1
AVDELETAKAEMGEVMEENQRLKTCLSRILNDYRTLQMQFHNRVEQETKDSSDQKVNNNNDHQREESDLVSLSLGRLPTRNNEKVNNKPLKEEEKEDKEGFVEEVPKEEAAGESWPQRKGHKTARDTTGEDEVSQQNPAKKARVCVRARCGTATMNDGCQWRKYGQKISKGNPCPRAYYRCTVAPSCPVRKQVQRCAQDMSILMTTYEGNHNHPLPLSATAMASTISAAASMLLSGSSTSHSGSRPSTAMTTAASYQTVPNQSNTYLSHPAALSSSPSHPTITLDLTSNNNPSSSSVPLVKFTSNSTFNNPQRYPLSTSLNFSYSESNNATSWSNNGFLSYNNTLPYNSNRNVTNVLSNINLGKQQQRPLENIYNSYLQRNNNINPIPPPQHSLPDTIAAATKENLSQQMKWGELFPSSSSALPSSSTKVNGCASSFLNKSAANTKPGTTLMFLQPLLPLSSPKSASGTYACDVHTFINFKNYSMKSSLTIL

SEQ ID NO: 333 - DNA, 1818 bp, Glycine max
  Glyma06g20300.1
atggagtttggttcagaaagatctggtcatgaagtcaaggatgagaagagaagtgaatctagtgttggagatgaagaagatcgtcgtgaacaagagattgttacgcaggagccacccctgtctactaccgaaagatccacagtggaggctgggccaaatgcttcttccctaaccaaaaaggaagaggctgttgatgaacttgaagttgccaaagccgaaatgggtgaagtgatggaagaaaaccaacgactaaagacgtgtttgaaccgaatactgaacgattaccgcgcactccaaatgcaattccacaacatagttgaacaagagacaaaagattcttctgatcagaaagtgaacaacaacaatgaccaatatcaaatagatgaatcaaacctagtttccctcagtcttggaagacttccaacaagaaacaataataaagtccctaataataaaccattgaaagaggaagcagaaaaagaagataaagaaggcttgtcccttggattagactgcaaatttgaaacatcaaaatctggaataagcacaactgaatatttgccaattcatcaaagccctaataatagtgttgaagaagtgccaaaggaagaagcagctggtgagagttggcaacctggcaagggaataaagacagctagagatgctacaggagaggatgaagtttctcaacaaaatccagcaaagaaagcaagggtttgtatgaacgatggatgtcaatggaggaaatatggacagaagatttcaaagggaaatccttgccctcgagcttactatcgttgcacggttgcaccatcatgcccagtaagaaagcaggtgcaaagatgtgcacaagacatgtccatattattcaccacctacgaaggcaaccacaaccaccctcttccactctcagccacagccatggcctccaccacttcagcagctgcatccatgctattatccggctcatcaacctcacactccggaacaaggccttccacagccatgaccaccgcagatcttcatggaatgaacttcttcctatcagacggttccaaattatcaaagcaatactacctgtcccatcctgcagcactctcatcttcaccttcacaccccaccatcactcttgacctaacttccaataataatccatcctcatcatcttctgctgctcttgttaaattcacttcaaactcaaactacaataacacacaaaggtaccctctttccacaagcttaaacttcagttcctcagaatccaacaatgcaacaacttcttggagcaataatgggttcctcagctacaacaacactctaccatataatagcaataggaatgtgacaaatgtccttagcaacataaaccttggaagacaacaacaacaaccaatggaaaacatctacaactcctacatgcaaaggaacaacaatgttccaatctctccaccacaacattctctgccagataccatagctgcagcgacaaaagtaatcactgcagaccccaattttcaatcagctttggcagcagcacttacaacaattattggttctggaagcactactcaaggaaaccatggtggtgcaggggaaaatctgagtcagaaaatgaaatggggtgaactgtttccttcatcttcttctgcattaccttcatcttcaacaaaagtcaatggttgtgcatcaagcttcttgaacaaatcagccgctaatacacaaccaggaacagctttgatgtttcttcagccacctttgcctctttctagccccaaaagcgcttctgggtctccaggagatcatatagacaagagaaat

SEQ ID NO: 334 - protein, 606 aa, Glycine max
  Glyma06g20300.1
MEFGSERSGHEVKDEKRSESSVGDEEDRREQEIVTQEPPLSTTERSTVEAGPNASSLTKKEEAVDELEVAKAEMGEVMEENQRLKTCLNRILNDYRALQMQFHNIVEQETKDSSDQKVNNNNDQYQIDESNLVSLSLGRLPTRNNNKVPNNKPLKEEAEKEDKEGLSLGLDCKFETSKSGISTTEYLPIHQSPNNSVEEVPKEEAAGESWQPGKGIKTARDATGEDEVSQQNPAKKARVCMNDGCQWRKYGQKISKGNPCPRAYYRCTVAPSCPVRKQVQRCAQDMSILFTTYEGNHNHPLPLSATAMASTTSAAASMLLSGSSTSHSGTRPSTAMTTADLHGMNFFLSDGSKLSKQYYLSHPAALSSSPSHPTITLDLTSNNNPSSSSSAALVKFTSNSNYNNTQRYPLSTSLNFSSSESNNATTSWSNNGFLSYNNTLPYNSNRNVTNVLSNINLGRQQQQPMENIYNSYMQRNNNVPISPPQHSLPDTIAAATKVITADPNFQSALAAALTTIIGSGSTTQGNHGGAGENLSQKMKWGELFPSSSSALPSSSTKVNGCASSFLNKSAANTQPGTALMFLQPPLPLSSPKSASGSPGDHIDKRN

SEQ ID NO: 335 - DNA, 1569 bp, Glycine max
  Glyma05g01280.1
atgggtgtagcgagagaagaaaatcaactgctaaagacgtgtttgaacaaaataatgaatgaatatcggacactagagatgcaatttcaggatatactaaagcaacaagggacaaaaaagaacgctgataaaggaaatgatgataagcatgaagaaatattagaggaagcggatcttgtttccctctgccttggaagagttccaagaagtgatgagaaaatcaaagtttctaataagccattgaaggatgatgaagggttgactcttggactagagtgcaaatttgaaacatcaaagtcaggaagcacaaatgaagctttacctaataatccaagcccagaaaatagttgtgaagtagtaccaaaggaagaaggtggggaaagtaaggaggcactaaagacaatgagatcagacacagaggatgaagttgctcagcaaaatcctacaaagaaacctcgagtttgtgttagagcaagatgtgacactccaacaatgaacgacggatgccaatggaggaaatatggacaaaagatttcaaagggaaatccttgccctcgagcttactatcgttgcacaattgcaccatcatgcccagttagaaaacaggtgcaaagatgtgttgacgacatgtccattttattcaccacttacgagggaacccacaaccacactcttccaccatcagctactgctatggcatccacaacttccgcagctgcatccatgttattgtctggttcatcaacctctaactctgcctcaataccttcaacagcaaccacaaatctccaaggcctcaacttttatctctcagacggttcaaaaccaaggcaactatacctctccaaccctgcactatcatcttcactttcacatccaaccatcactctcgacctcactacttcacacccttcagcctcttcctcatcatcatcaccctttgtcagattcaattcaaactacaacaacaatcaccaacccagatacccctcttcctcatcaagcctaagcttcagtactagtaattcctccgaaattgctaatgctatatcttggagcaacggcttcctcaacaataataggaacatccttagcagtgtgaactttggaagacaacaaatggaaaacatgaaccagtcctacatgcaaaagaacaacaacaacacaagccttcttcctcaagctgatactatatctgcagcaacgaaagtgatcacagcggaccccgcttttcagtcagctttggcagcagcacttacttcgtttattggcggtggtggtgttggaaacacgcgaggaagtcaaggtggtaatgttgttggagaaagtttgagtttgggtcagaaaatgaaatggggtgaggtgtttccagcgtctaataattctaattcttcaatttcgaacaataaagtcaatggttgtgcatccagcttcttgaacaaaacgccggcagcgaatacacagacgaaaaatttgatgtttctgccgccgtcgtcattgccgttttcttctactcccaaaagtgcatctgcatctcctgctgctgataatagcgacaccaccaccaat

SEQ ID NO: 336 - protein, 523 aa, Glycine max
  Glyma05g01280.1
MGVAREENQLLKTCLNKIMNEYRTLEMQFQDILKQQGTKKNADKGNDDKHEEILEEADLVSLCLGRVPRSDEKIKVSNKPLKDDEGLTLGLECKFETSKSGSTNEALPNNPSPENSCEVVPKEEGGESKEALKTMRSDTEDEVAQQNPTKKPRVCVRARCDTPTMNDGCQWRKYGQKISKGNPCPRAYYRCTIAPSCPVRKQVQRCVDDMSILFTTYEGTHNHTLPPSATAMASTTSAAASMLLSGSSTSNSASIPSTATTNLQGLNFYLSDGSKPRQLYLSNPALSSSLSHPTITLDLTTSHPSASSSSSSPFVRFNSNYNNNHQPRYPSSSSSLSFSTSNSSEIANAISWSNGFLNNNRNILSSVNFGRQQMENMNQSYMQKNNNNTSLLPQADTISAATKVITADPAFQSALAAALTSFIGGGGVGNTRGSQGGNVVGESLSLGQKMKWGEVFPASNNSNSSISNNKVNGCASSFLNKTPAANTQTKNLMFLPPSSLPFSSTPKSASASPAADNSDTTTN

SEQ ID NO: 337 - DNA, 1443 bp, Glycine max
  Glyma17g10630.1
gttgatgatcagcttgagactgctaaagctgaaatgggtgtggtgagagaagaaaatcaacggctaaagatgtgtttgaacaaaataatgaatgaatatcggacactagagatgcaatttcaagatatactaaagcaacaagggacaaaaaagaacgttgataaaggaaaggctgatagccatgaagaaatattagaggaatcggatcttgtttccctctgccttggaagagttcctaccattaatgcaagaagtgatgagaaaatcaaagtttctaataagccattgaaggatgatgaagggtttaataacgaagagttgactcttggactagattgtgaagtaccaaaggaagaaggtggggagagtaaggaggcactcaagactatgagagacagtacagaggatgaagttgctcagcaaaatcctacaaagaaacctcgagtttgtgttagagcaagatgtgacactccaacaatgaatgacggatgccaatggaggaaatatggacaaaagatttcaaaggggaatccttgccctcgagcttactatcgttgcacaattgcaccgtcatgcccagttagaaaacaggtgcaaagatgtgctgatgacaagtcgattttaatcaccacctacgaagggacccacaaccactctcttccaccaacagccactgccatggcatccacaacttccgcagctgcctccatgctcttgtctggttcatcaacctctaactctaactccgcctcaataccttcagcaacccccacaaatctccacggcctcaacttctatctctctgaaggttcaaagccaagacaactatacctatccaaccctgcactatcgtcttcaccttcacatccaaccataactctagacctcactacttcacaccctgcagcatcttcctcctcatcatcaccctttttcagattcaattcaaactacaacaacaacaaccaacccagatacccttcttcctcatcaagcctaagcttcagtagtaataattcctcccaaattgccaatgctatatcttggagcaacggcttcttaaaccacaataatagggacatccttagtagtgtgaactttggaagacaacaacaaatggagaacgtcaacaacaacaacaacaacacaagccttgttcctcaagctgatactatctctgcagcaacgaaagtgatcacagcggaccccacttttcagtcagctttggcagcagcactttcttcgtttattggtggcggtggtgttggaaacacgcgaggaagtcaaggttgtaatttcggagaaagtttgagtttgggtcagaaaatgaaatggggtgagacggaaagtttgatgtttctgccgccgtcgtctttgccgttttcttctaccaccaaaagtgcatctgcatctcctgctgataatagcaacaccaccatcaat

SEQ ID NO: 338 - protein, 481 aa, Glycine max
  Glyma17g10630.1
VDDQLETAKAEMGVVREENQRLKMCLNKIMNEYRTLEMQFQDILKQQGTKKNVDKGKADSHEEILEESDLVSLCLGRVPTINARSDEKIKVSNKPLKDDEGFNNEELTLGLDCEVPKEEGGESKEALKTMRDSTEDEVAQQNPTKKPRVCVRARCDTPTMNDGCQWRKYGQKISKGNPCPRAYYRCTIAPSCPVRKQVQRCADDKSILITTYEGTHNHSLPPTATAMASTTSAAASMLLSGSSTSNSNSASIPSATPTNLHGLNFYLSEGSKPRQLYLSNPALSSSPSHPTITLDLTTSHPAASSSSSSPFFRFNSNYNNNNQPRYPSSSSSLSFSSNNSSQIANAISWSNGFLNHNNRDILSSVNFGRQQQMENVNNNNNNTSLVPQADTISAATKVITADPTFQSALAAALSSFIGGGGVGNTRGSQGCNFGESLSLGQKMKWGETESLMFLPPSSLPFSSTTKSASASPADNSNTTIN

SEQ ID NO: 339 - DNA, 1815 bp, Vitis vinifera
  GSVIVT01008046001
atgaacaaggaagaaagagctatggaggccgctttgagaagatctggtcatggggttgttgtgaaggaagagaggagacctgaagcaccatgcgatgacgatgaaggttgcagagacaaggctgctgccaaggctgataaaacgaagtcatcttcccccagacgcgaggatttaaactgcagttctgtgcagttaccagcaataagtaagatggaaagatcgatatcgtctgctgaaccggactcaggagcgagttcctcgagccacaaggatcaggatgatcagcttgaatcagccaaagctgaaatgggcgaggtgagagaagaaaatcaaaggctaaggatgtatttagatcaaattatgaaggattacaagactcttcaaatgcaattctacgacgttgtccgacaagaagctaaggaatccacagaaaaggcgagcattttacaaattgaggaacccgagtttgtttcccttagcctgggaagagtttcaagtgacccaaaaaaggatgaaaagaacaaaactactagcaaagtggaggatgacggagtcaaaggcggccttagtctcggacttgactgcaaatttgaagtgctgaatccaagccctgagaatagctttggaggaccaaaggaagctgccggagagagttggccacctagtaaaagcctgaagacaatgagaaccggagatgatgaaatttcacaacagaaccccgcgaagaggtgtagggtttctgtgagagctagatgtgataccccaacgatgaatgatggatgtcaatggaggaaatatgggcagaagattgcaaaaggaaacccatgtccacgagcatactatcgctgcacagttgcaccatcttgcccagttagaaaacaggtacaaagatttgctgaagacatgtccatcttgattaccacctatgaagggacacacaaccatccactcccttactcagccactgcaatggcttccaccacttcagcagctgcttccatgctcatgtccggctcctcgagctctcaatctggctctggctcctgcccgttatcagccactagtgctgatctccatggggtgaacttttatctatctgacaactcaaaatcaaagcaattctactcaatcaactcgtcgctctcggctgtgtcttcaaacccaacaattacacttgaccttacaacagcctcatcctcttcctcttcctcatcccatttcaataggttatcttcaaattatcctcccccaagatttccttctacaggtttcaacttcagttcttctgaatccaactctctgcctatctcctggagcaatggattgcttagctatggcagtactactactactcaaccctacaacaggaaccatactggatcccaaaattctggacgacatactcaggaaaatttctttcatccccacgtccaaaagaacaacccagctcctgttcaacagcccctaccagatcctattgcagctgcaacaaaggcaatcgcatcagacccgagtttccaatctgctttagcagctgcccttacatcaataatgggtgctaatggtggaacccatgctaaccatagtggaggagaggcctttggccagaaattgatgtggggtagtgaatcccttcctgctgtttctacctatcagtcaacctctaaaggaaatggatgtgcatccagctacttgaacaaatcgccacccacaaattctcagccgggaagcttgatgtttcttcctcctgcattgccattttccacctctaagaatgcatctgcatcccctgctgaaaatagagagcacactagt

SEQ ID NO: 340 - protein, 605 aa, Vitis vinifera
  GSVIVT01008046001
MNKEERAMEAALRRSGHGVVVKEERRPEAPCDDDEGCRDKAAAKADKTKSSSPRREDLNCSSVQLPAISKMERSISSAEPDSGASSSSHKDQDDQLESAKAEMGEVREENQRLRMYLDQIMKDYKTLQMQFYDVVRQEAKESTEKASILQIEEPEFVSLSLGRVSSDPKKDEKNKTTSKVEDDGVKGGLSLGLDCKFEVLNPSPENSFGGPKEAAGESWPPSKSLKTMRTGDDEISQQNPAKRCRVSVRARCDTPTMNDGCQWRKYGQKIAKGNPCPRAYYRCTVAPSCPVRKQVQRFAEDMSILITTYEGTHNHPLPYSATAMASTTSAAASMLMSGSSSSQSGSGSCPLSATSADLHGVNFYLSDNSKSKQFYSINSSLSAVSSNPTITLDLTTASSSSSSSSHFNRLSSNYPPPRFPSTGFNFSSSESNSLPISWSNGLLSYGSTTTTQPYNRNHTGSQNSGRHTQENFFHPHVQKNNPAPVQQPLPDPIAAATKAIASDPSFQSALAAALTSIMGANGGTHANHSGGEAFGQKLMWGSESLPAVSTYQSTSKGNGCASSYLNKSPPTNSQPGSLMFLPPALPFSTSKNASASPAENREHTS

SEQ ID NO: 341 - DNA, 1572 bp, Solanum lycopersicum
  Solyc03g113120.2.1
atggagactgttttcagaaaatcaactcatggaggtgtagtcaaacaggacataaagattaaagctagtgaagaaggttttgttgaagatataaatgatcttaaggttgaaaaggagagaaaatcaatacataacgaggacgataattcgaagtcctctcagcaaaaggatctcactggggacaaaaaggacgatcagctggaatcagccaaagccgatatggaagaagtaatggaagaaaatcaaaggctaaagaaacacttagataaaatcatgaaggattatcggaatcttcaaatgcaattccatgaagttgcacaaagagatgctgaaaaaactaatactgatgttaaacatgacgaagctgaacttgtttcccttagcctaggaaggacttcaagtgacacaaaaaaggagttatccaaattaattttgagcaaaaaagagaatgatgagaaggaagaagataacctaaccctagcattagattgcaagtttcaatcatcgaccaaatcttcaccatcaaatctcagtccagagaatagtttaggagaagtgaaggacgacgaaaaaggaactgatcaaacatggccacctcacaaagttctcaagacgataaggaatgaagaagatgatgtgacacaacaaaaccctactaaaagagcaaaggtttccgtcagagttagatgtgacaccccaacgatgaacgatggatgtcaatggagaaaatatggacaaaaaattgcaaaagggaacccatgtcctagagcttactaccgttgcacggtagcaccaaattgccccgtaagaaaacaggtacaaagatgcattcaagacatgtctatattgatcacaacatacgaaggaacacataaccatccacttcctcattcagccacatcaatggctttcaccacttcagcagccgcttccatgctattatccggttcatccagctccggatcgggccccacaagtagtacagcctctgccacaacctctgcgctcaactattgcttctctgataactcaaaaccaaacccattttataaccttccacattcatccatttcttcatcatcacattctcagtaccctacaatcactcttgatttaacatcaaactcgtccacttcctcatttcctggccaaaattatagaacaatcgcgaatagtaataattatcccccgcgatataataataataattcatccacaaatattctcaatttcagttcctttgaatctaatcatcttcttcctatgtcttggagtaacagaaataaccaagacacccattcccagtcttatctacaaaacaatataaaaagcgcggcatctacacagactttattaccacaagacacaattgcagctgcaacaaaagcaataacatcagatccgaagtttcaatctgcattggctgttgctcttacatctatcattggctcacgcagcggaaatcatcatattgacgaaaaatctgggcagaatatgaaggttactgagccatttccagtgctttgtagcttcccatccacctctcctggtgatcacaaagattacacactg

SEQ ID NO: 342 - protein, 524 aa, Solanum lycopersicum
  Solyc03g113120.2.1
METVFRKSTHGGVVKQDIKIKASEEGFVEDINDLKVEKERKSIHNEDDNSKSSQQKDLTGDKKDDQLESAKADMEEVMEENQRLKKHLDKIMKDYRNLQMQFHEVAQRDAEKTNTDVKHDEAELVSLSLGRTSSDTKKELSKLILSKKENDEKEEDNLTLALDCKFQSSTKSSPSNLSPENSLGEVKDDEKGTDQTWPPHKVLKTIRNEEDDVTQQNPTKRAKVSVRVRCDTPTMNDGCQWRKYGQKIAKGNPCPRAYYRCTVAPNCPVRKQVQRCIQDMSILITTYEGTHNHPLPHSATSMAFTTSAAASMLLSGSSSSGSGPTSSTASATTSALNYCFSDNSKPNPFYNLPHSSISSSSHSQYPTITLDLTSNSSTSSFPGQNYRTIANSNNYPPRYNNNNSSTNILNFSSFESNHLLPMSWSNRNNQDTHSQSYLQNNIKSAASTQTLLPQDTIAAATKAITSDPKFQSALAVALTSIIGSRSGNHHIDEKSGQNMKVTEPFPVLCSFPSTSPGDHKDYTL

SEQ ID NO: 343 - DNA, 1947 bp, Solanum lycopersicum
  Solyc06g070990.2.1
atggagaacaagaacaaagctgaatattatagtcctgatgatgaagatcgcgatatcgataatcaagaaaatattatccatcagtttggaaagggaagaaaagagcgtgaggatgataaatcaaagccatcctcccctcaccacaaggattacatgaacattgacaatatagagggaggtgctgttaatgttatggtaaagagagaaagatccccaccagaacacaactcaatggcttcttcatctactcacaaagaacaggacgatcagctagcatcagccaaagatgaaatgcgagaagtaatggaagaaaatcagaggcttcgaatgcacttagatcgaatgatgaaggaatatcgaaatctccagaaccaatttcacgatatcgttcaaaaagaaactgatcaaaaatcaagcagtactactgtcaacactagtacaacacatcatgatcatgaatctgatcaagaagctgatcaacttgtgtccctcagcttaggaagaactactagcgatatgaagaaagatgatttatctaaaatcttaaagaaagataaagttcatgacgatgaaggagttagtaataataataaaagccttgatttaggattggattgcaagttcgaaacaacgccaactgaatgttcaccagtgaattatagtccggagaatagcttagatgatattcaagctaataaggatgaaaatgaagagacgtcgaataaaaatctcaagacgatgagaaataatggagatggagatgatgtttcgcaacaaaaccctactaaaagagctagggtttctgttagagtcagatgtgatgcccctacgatgaatgatggatgccaatggagaaaatatggtcaaaaaatagcaaaaggaaatccatgccctagagcttactatcgttgcaccgtagcaccaaattgcccagttagaaagcaggttcaaagatgtgccgaagacatgtcaatattgatcaccacatatgaaggaacacacaaccatacccttcctctttcagccaccgcaatggcttctaccacctcagcggccgctagcatgctgttatccggttcatctaattcatcagacccaaacccacaagtaactgccaccaccaccactacccctactaccactacttctgccaatatcaacggactcaacttctatctctctgatacctcaaaacatcataaatcgccatattactttcctaattcatccatctcagcatccgcacctaattccctccctacaattacactcgatttgacttccacctcgtcctcgtccccgtcctccttatctcatctaaacagaatgactcagaattttcctcctagatataattacaataacaataattccaccacaaacctcaattttagctcagtacttgaatccaattcccttcccatttcttggaccaataattatccaaatcaaacctataacaaaaataaccaaaattttggtccacttacattttcatcaagatcaagtcaagataacattttccaatcatatttacagaaaaatactacacaatcttctttaccaccagacacaattgcagctgcaaccaaagcaataacatcagacccaaattttcattccgcattagctgcagctcttacatcgatcattggaaattctccaattgaaaacaaatccgtccataatttaaatgttactgagccatttccaattttatccagtctcccttcaagctcaaatccgaataaatgttcgtcaagttttttaaataaaccaacctcttctgcttccgcgaataataataataatagtaatagtaatagtaatagtacacagcagcctgggaataatagcatggtgtttttcgggcaatcttcttcttcgttaccattttcgacgtctaataagggtaaatctacctctcctggtgatagtaagtttgat

SEQ ID NO: 344 - protein, 649 aa, Solanum lycopersicum
  Solyc06g070990.2.1
MENKNKAEYYSPDDEDRDIDNQENIIHQFGKGRKEREDDKSKPSSPHHKDYMNIDNIEGGAVNVMVKRERSPPEHNSMASSSTHKEQDDQLASAKDEMREVMEENQRLRMHLDRMMKEYRNLQNQFHDIVQKETDQKSSSTTVNTSTTHHDHESDQEADQLVSLSLGRTTSDMKKDDLSKILKKDKVHDDEGVSNNNKSLDLGLDCKFETTPTECSPVNYSPENSLDDIQANKDENEETSNKNLKTMRNNGDGDDVSQQNPTKRARVSVRVRCDAPTMNDGCQWRKYGQKIAKGNPCPRAYYRCTVAPNCPVRKQVQRCAEDMSILITTYEGTHNHTLPLSATAMASTTSAAASMLLSGSSNSSDPNPQVTATTTTTPTTTTSANINGLNFYLSDTSKHHKSPYYFPNSSISASAPNSLPTITLDLTSTSSSSPSSLSHLNRMTQNFPPRYNYNNNNSTTNLNFSSVLESNSLPISWTNNYPNQTYNKNNQNFGPLTFSSRSSQDNIFQSYLQKNTTQSSLPPDTIAAATKAITSDPNFHSALAAALTSIIGNSPIENKSVHNLNVTEPFPILSSLPSSSNPNKCSSSFLNKPTSSASANNNNNSNSNSNSTQQPGNNSMVFFGQSSSSLPFSTSNKGKSTSPGDSKFD

SEQ ID NO: 345 - DNA, 1494 bp, Citrus clementina
  clementine0.9_008233m
atggcgaaggattatcagtctttacaatcgcatttcttagatattcttcagcaagaagaagctcaaaagtctaaagataaaatttctacacatcatgatcaggaaaatgaagaagttgatgaactcgttttgcttagccttgggagaacatcagcgcagcctaagaaggatgagaaaaagatttgcaataatttgagtgatgggcatgaaaagaacgataaagaagggcttgcacttgggttggactgcagcagatttgagtttagtagtaattcaagagaatctgagaatcgtccgagccctgcaaatactacttgtgaacaattgaaggaacaggagccaactgagatatggtcgccaagcaagattaatatcaagagtaagagaagtgatgatcaagatgaagaggtcttccaaaaggcccagctaaagaaagctagggtttctgttagagctagatgcgacaccccaacaatgaatgatggatgccaatggagaaaatatggacaaaaaatagccaaagggaatccatgccctcgggcatactaccgttgcacaatctctccaacttgccctgtcagaaaacaggtacaaagatggcatgaggacatgtccatcttgatcactacctacgaaggtacacataaccacccacttccaatttcggccacagccatggcttccaccacatctgccgctgcttccatgctacaatgccgttcatcaacctcacaacttggaacctcagtttccgcgtctactccacccaacctccacggattgaacttcattttctccgaaaatgcaagaccacatgatcaacttaatttctctagctcttctatctcaaacaccaatgctcacccaactatcgttcttgatctcacagcaccagccactttctctcatttcaataggctttcttcttcagctccaagatataattcttcatcgacgtctctcaatttttcctccccattttctacaaattctctacaaacttcttggagcagtggctattccaataattatgagaattatctgggaaagcaaccagctcaagaacatatttacaaaccatatatgcaaacgatgaacaacccgcgtactcctcctcctattcctcaagtacagtctctcacagaaagtactatagctgctacaacgaaaattatcacttcgaaccctaatttccaatcggcattagcagctgcgatctcgtcatacatcggtcagcagaatgttggaggcccaggtgagagttctagcttggatatgaagtggggtaaacctaatttttcaataaaatcggctgccgactcatcagcccagaatggtactctagggtttgcatctagccttttggacaagtacttgccctcatctactcatcagcaacctgctgtgtctattttcccacttaattcaccgccattttctgcgtctaagactgctttagggtctccagttgaagtcaaagaccatgttaagata

SEQ ID NO: 346 - protein, 498 aa, Citrus clementina
  clementine0.9_008233m
MAKDYQSLQSHFLDILQQEEAQKSKDKISTHHDQENEEVDELVLLSLGRTSAQPKKDEKKICNNLSDGHEKNDKEGLALGLDCSRFEFSSNSRESENRPSPANTTCEQLKEQEPTEIWSPSKINIKSKRSDDQDEEVFQKAQLKKARVSVRARCDTPTMNDGCQWRKYGQKIAKGNPCPRAYYRCTISPTCPVRKQVQRWHEDMSILITTYEGTHNHPLPISATAMASTTSAAASMLQCRSSTSQLGTSVSASTPPNLHGLNFIFSENARPHDQLNFSSSSISNTNAHPTIVLDLTAPATFSHFNRLSSSAPRYNSSSTSLNFSSPFSTNSLQTSWSSGYSNNYENYLGKQPAQEHIYKPYMQTMNNPRTPPPIPQVQSLTESTIAATTKIITSNPNFQSALAAAISSYIGQQNVGGPGESSSLDMKWGKPNFSIKSAADSSAQNGTLGFASSLLDKYLPSSTHQQPAVSIFPLNSPPFSASKTALGSPVEVKDHVKI

SEQ ID NO: 347 - DNA, 1653 bp, Eucalyptus grandis
  Eucgr.G02535.1
gccgatcgactcgaatcagctagagctcaaatgggtctggtcagagaagaaaaccaaaggctaaagtccatgttgtcccaaattgtgaaggactaccaatctttacaacaccagttctttgaggttgtccaagaagaagagaaggccgagatggaaccatcaccgaacaaacttttgcttcctcataaccaagaaaacaatgaagaagctgaactcttgtccctcaccctaggactgagctcgagccaactgaagaccgagggggagaggagaaacacattaacgatgcagagtgaaagcgcaaagaatggaaatagtgacatgaaacaagagttgtcacttggcttgtatgacggaaagatcatgagtcgtgatcatgagagctcgaaagacacgaaggaaggtgaaatttcaaagaaatggccgccaagtaaagttctcaagaccgcgagaagtgatgatgagcaggctttggagcaaacccatttgaagaaagctagggtttgcgtcagagttaggtgtgacgcatccactatggaagatggatgccactggaggaagtacggacagaaaattgcgaaagcaaatccatgtcctcgatcatactaccgttgcactgtctcgccatcttgtccagtcaaaaagcaagtacaaagatgcgtggaggacatgtccgtcttgatcaccacttatgaagggaatcacaaccaccctcttcctgtctcggccacggctatggctttcgccacatctgcagccacttccatgatacaatctcactcatcgacctcacaacaacaacaacaacaccctggccttccatctccgacgtcttcaggccctgcttctgccacgtcttctagtggcttgtacggactcgatttcgcgggcgatcgaaatccaaagctgcctcgactttatttctctaactctacttcgatttcgacttgcaattctcaccccaccatcacccttgatctcacctcgagccctgaattctccaatcacgatggatatcgatcctcttcatggttcccatctttaccgaaactcccttcaacatttctcagcttctcctcatcaccaccttcatcatcattgccgagtcacttagataccacaacccataaatcatcttcgggcattggtcctagggttttaaatcatggggtgccaccccaacatcaattgtacctaccccaattgtggccagttaccaatacccaagcttctcatccacaatctttagccgacaagttcggcgctgaagcaacgaaagcaacatcttcgaatttatcttcccaatccgcgttagtagccgcgatgacctcgttcgttggcgacagggcaactggctttctcggtgataaaggaaaggaaggaggttttgggctgaacttgaagttcggtgatgatccagcgacaccaattgaattactccgaccatccccgcaagctgatggtatatcgtgtgcttcttcaagctacatggacaatccaatggctttgggctctcaacatggaccgaagagctcgatttggtttccgcattcatcagtggcattatccacatctaagaagagtgcctgtgcttcaatgtctcctgccgagaccaaggatcatctcattaagtttcttgccaattctgaaatg

SEQ ID NO: 348 - protein, 551 aa, Eucalyptus grandis
  Eucgr.G02535.1
ADRLESARAQMGLVREENQRLKSMLSQIVKDYQSLQHQFFEVVQEEEKAEMEPSPNKLLLPHNQENNEEAELLSLTLGLSSSQLKTEGERRNTLTMQSESAKNGNSDMKQELSLGLYDGKIMSRDHESSKDTKEGEISKKWPPSKVLKTARSDDEQALEQTHLKKARVCVRVRCDASTMEDGCHWRKYGQKIAKANPCPRSYYRCTVSPSCPVKKQVQRCVEDMSVLITTYEGNHNHPLPVSATAMAFATSAATSMIQSHSSTSQQQQQHPGLPSPTSSGPASATSSSGLYGLDFAGDRNPKLPRLYFSNSTSISTCNSHPTITLDLTSSPEFSNHDGYRSSSWFPSLPKLPSTFLSFSSSPPSSSLPSHLDTTTHKSSSGIGPRVLNHGVPPQHQLYLPQLWPVTNTQASHPQSLADKFGAEATKATSSNLSSQSALVAAMTSFVGDRATGFLGDKGKEGGFGLNLKFGDDPATPIELLRPSPQADGISCASSSYMDNPMALGSQHGPKSSIWFPHSSVALSTSKKSACASMSPAETKDHLIKFLANSEM

SEQ ID NO: 349 - DNA, 1389 bp, Glycine max
  Glyma01g05050.1
atgttagagttctatggaatccttcatcacgataaacctgatgatgctacaaatgctaaaggtgtgtttagccatattgaggaaaacgaagaaagtgaacttgtgtcactttctcttgggatatcaatatctaaaggcaagcctagcaagaatgagaaaatgattaataatggaattgaaaagagagaagatgaggatgtgcataaacgacttgtacttgggttagatatcaatttggaccctgtagatcaagatgaattagctgcaaataattccacccctgaaagtagctttggtgagggagggaaggaagatgaaccaactgagatgtggccacccagtaaagtttcgaagacaatgaaaagtgaggataaaagtgaagcttcaccacattatcagcccaagaagactagggtttctattagagccagatgtgatacccaaacgatgaatgatgggtgccaatggagaaaatatggacagaaaatggccaaaggaaatccatgcccccgagcttactatcgatgcactgcttctccatcttgccctgtaagaaagcaggtgcaaagatgtgctgaagacatgtccatattgattaccacctatgaaggaacacacaatcaccctcttcctatgtcagccactgcaatggcctgcacaacttctgctgcagcttccatgcttcaatctccctcattgagttcacaacatggactagtcgattcagctatatcctccatcatcaactccagtgctgctaattactacaatcctaataatgctctaaacttctccacacaccaagtttctagaccaaaccaattctacttctccaactcatccatttcaaccttgaattctcaccctacaatcactctggaccttacagcacccccaacttcctcaaactcaagcttcactcacatgccaaaatactcatcaacaaacctgaatttctcctctggtttctctcctctacattctagcatgcctcaatcaccttggagcagttataattacttcaattctggaacactttctcaaaatagaaaacatggtggtaattacttgttaaacactggaaatcaaaatcaaccacattctttaggaaatctccatcaacctatttacatgagaagcaataccatttctcagcattctttgcctgatcccattgttgctgcaaccaaggcaatcacaagtaacccaaagtttcaatcagcactagcaactgctctcacaacatatgttggcaatgaagctggtggtggtaggttaagagaaaatcatgttcttgagagtgcagaactgatgaacttaaagctatgtagtgaaaatagcataggaaactcaagtatagttcaactaccactactggagcaatggaag

SEQ ID NO: 350 - protein, 463 aa, Glycine max
  Glyma01g05050.1
MLEFYGILHHDKPDDATNAKGVFSHIEENEESELVSLSLGISISKGKPSKNEKMINNGIEKREDEDVHKRLVLGLDINLDPVDQDELAANNSTPESSFGEGGKEDEPTEMWPPSKVSKTMKSEDKSEASPHYQPKKTRVSIRARCDTQTMNDGCQWRKYGQKMAKGNPCPRAYYRCTASPSCPVRKQVQRCAEDMSILITTYEGTHNHPLPMSATAMACTTSAAASMLQSPSLSSQHGLVDSAISSIINSSAANYYNPNNALNFSTHQVSRPNQFYFSNSSISTLNSHPTITLDLTAPPTSSNSSFTHMPKYSSTNLNFSSGFSPLHSSMPQSPWSSYNYFNSGTLSQNRKHGGNYLLNTGNQNQPHSLGNLHQPIYMRSNTISQHSLPDPIVAATKAITSNPKFQSALATALTTYVGNEAGGGRLRENHVLESAELMNLKLCSENSIGNSSIVQLPLLEQWK

SEQ ID NO: 351 - DNA, 1315 bp, Glycine max
  Glyma02g02430.1
atgggagaggctagagaagaaaacaagatgttagaattctttgagattcttcaacaagataaacctgaagatgctacaaatgctaaaggtgtgtttagccatgatgaggaaaatgaagaaagtgaacttgtgtcactttctcttgggatatcaatatcaaaaggcaagcctaccaaggatgagaaaatattgaaaaacaaaaatggaattgaaaagacagaagatgaggatgtgcataataaaagacttgtgcttgggttagatatcaatttggaccctgtagatcaagatgaattgactgcaaataattccaccactgaaagtagctttgttggtgagagagggaaggaagaggaaccaactgagatgtggccacccagtaaagttttgaagacaatgaaaagtgtggataaaagtgaagtttctcaacatgatcagcccaagaagactagggtttctattagagccagatgtgatacccaaacgatgaatgatgggtgccattggagaaaatatggacagaaaatggccaaaggaaatccatgcccccgagcttactatcgatgcactgcttctccatcttgtcctgtaagaaaacaggtgcaaagatgtgctgaagacatgtccatattgattaccacctatgaaggaactcacaatcaccctcttcctatgtcagccactgcaatggcctgcacaacttctgctgcagcttccatgctccaatctccctcattgagttcacaacatggattagttgattcagctatatcctccatcatcaactctagtgctccttattacaaccctaataatgctctaaacttctctacacaccaagtttcaagaccacaacaattctacttccccaactcatccatttcaaccttgaattctcaccccacaatcactttagatcttacaacacctccaacttcttcctcaaactcaagcttcacttgcatgccaaaatactcatcaacaaaccttaacttttcctcaggtttctctcctctgcattctagcatgccgcaatcaccttggaacagttatagtggttacttcaactctggaacactttctcaaaatagacaccatggtggtaattacatgttaaacacgggaaatcaaaatcaaccacattctctagggcatctccatcaacctatttacatgagcaacaatagtaccatttctcagcattctttccctaatcccattgttgctgcaactgaggcaataatcacaagcaacccaaaatttcaatcagcactagcaactgctctcacagcatatgttggcaatgaagctagtg

SEQ ID NO: 352 - protein, 440 aa, Glycine max
  misc_feature (440)..(440): Xaa can be any naturally occurring amino acid
  Glyma02g02430.1
MGEAREENKMLEFFEILQQDKPEDATNAKGVFSHDEENEESELVSLSLGISISKGKPTKDEKILKNKNGIEKTEDEDVHNKRLVLGLDINLDPVDQDELTANNSTTESSFVGERGKEEEPTEMWPPSKVLKTMKSVDKSEVSQHDQPKKTRVSIRARCDTQTMNDGCHWRKYGQKMAKGNPCPRAYYRCTASPSCPVRKQVQRCAEDMSILITTYEGTHNHPLPMSATAMACTTSAAASMLQSPSLSSQHGLVDSAISSIINSSAPYYNPNNALNFSTHQVSRPQQFYFPNSSISTLNSHPTITLDLTTPPTSSSNSSFTCMPKYSSTNLNFSSGFSPLHSSMPQSPWNSYSGYFNSGTLSQNRHHGGNYMLNTGNQNQPHSLGHLHQPIYMSNNSTISQHSFPNPIVAATEAIITSNPKFQSALATALTAYVGNEASGX

SEQ ID NO: 353 - DNA, 1245 bp, Glycine max
  Glyma18g16170.1
atgggagaggttggagaaggaaacgataacttgaaactttcattggcaaagcttgtaaaggattcaactagcgatgaagaaagtgaacttgtttccctttctcttggaatttcatccacaggccaacatgagatgaagaaaaagaagaatagaaatgaaaagatgagagaaaatgaggatttgaaagatatacttgcacttggattagatatcagatttgactcttcagctataaaaaatctaagcactgaaaagacatggccaccaagtaaagttgtcaagacaattatgagaactagagataaaagtgaagtttctcaacatgctgaactcaagaaggccagggtttgtatcagagcgagatgtgataccctaacgatgaatgatgggtgccaatggagaaaatatggacagaaaatggcaaaagggaatccgtgccctcgagcatactatcgatgcactgtttctccatcttgtcctgtgagaaaacaggttcaaagatgtgctgaagacatgtcaatcttgattaccacctatgaaggaactcacaaccacccacttcctacttcagccactaccatagcctacacaacttctgcagcagcttccatgcttcagtctccttcattgagctcacaactaggaccagccaattcagatacggtccctctcatcaattctagcgttgcttataaccttaatgccctaaacttcacatcatcaagctatgatcagcagttttcaaaatcatcacaacacttgtacttccacaactcatctatttcaacctctaattctcaccccacaatcactcttgacctcacctcacctcaaacttcacctcatgttggaaagttcaccccaggcttgtctttcataccaaaacattcatcaacaaatcttcatttttcctcaagtactttctctcctttgcaatcaagcatgctacagtcaccttggagtccttatggtgattgcttcaactatgagggattgatcacccaaaatagtaaccaaaatggtttccttactaagactggaaaacaaccatttcaggggcatctttatcaacccaattacattagcaaccctgcaaccaaggcaatcacggctaccccaaaatttcaatctgcaatagcagctgcactcacagcatatgttggtaatggggttagagaaaatcatgttggggctgaaagtgcagataaaaatgtgattgagaagaaaaattccactaaaggtagt

SEQ ID NO: 354 - protein, 415 aa, Glycine max
  Glyma18g16170.1
MGEVGEGNDNLKLSLAKLVKDSTSDEESELVSLSLGISSTGQHEMKKKKNRNEKMRENEDLKDILALGLDIRFDSSAIKNLSTEKTWPPSKVVKTIMRTRDKSEVSQHAELKKARVCIRARCDTLTMNDGCQWRKYGQKMAKGNPCPRAYYRCTVSPSCPVRKQVQRCAEDMSILITTYEGTHNHPLPTSATTIAYTTSAAASMLQSPSLSSQLGPANSDTVPLINSSVAYNLNALNFTSSSYDQQFSKSSQHLYFHNSSISTSNSHPTITLDLTSPQTSPHVGKFTPGLSFIPKHSSTNLHFSSSTFSPLQSSMLQSPWSPYGDCFNYEGLITQNSNQNGFLTKTGKQPFQGHLYQPNYISNPATKAITATPKFQSAIAAALTAYVGNGVRENHVGAESADKNVIEKKNSTKGS

SEQ ID NO: 355 - DNA, 1782 bp, Vitis vinifera
  GSVIVT01020060001
atggaggctgctgctttggagatacccgtgtctggtgatccagttaagggagaagagacaaccctgatgaaatttaacggcggagataaagggggtgtttgtgattccatgaaggtgcatcttgtggccgccacagaaagatcatccatggagaacaattcaatagacccctcaacacaaaagaatcaggaggatcggatcaaatcagccaaagaagaggtgggcgaggttagagaagaaaatgaaaggttgaagcagatattagcaaaaatcaagaaggactaccagtcactgcaaatgcagttcagtgaaattgctcaacatgaggaagctaggaaatctacagatacaattcttactcatcaggaagaagaagaagaagaaactgatcttatctcccttagcctaggaagagtttcaagtgccgagtctaagaaggatgacaaaaagacaagctttctgagtggtaaaggaaaaggggatgagaagatggatgaaggacttgcactagggctggaatgcaaatttgaacccgcccctaccgaacacatgatgaatgcaagccctgaaaatagctttgaaggacccaaggaagaggagccctctactgagacatggccacccagtaagattctaaagatggggagaagtcgggatgaagaagttttagagcaaacccatttgaagaaagctagggtttctgtccgagctagatgcgacacccccacgatgaatgatggatgccaatggaggaaatatggacagaaaatagcaaaaggaaacccttgccctagagcatactaccggtgcacagtctcaccatcatgccctgtgagaaagcaggtgcaaagatgtgcggaggacacgtccatcttgatcaccacctatgaaggaactcacaaccacccacttcctgtttcagcaacagcaatggcttccaccacatctgctgccgcctccatgctacgctccggctcctccacctcacaaccaggcatggaggccttcgctacctcctctactgccaacctccacggcttaaacttttctataccccaaaattcaagatcacagcaattctacttccccaattcttcattctcaacttccaattcacacccaactatcactcttgatctcactgcaccaactgcttctcatttcaataggttgtcttcaagtttcccttctgcaccaagatatcctgcaacttgcctcaacttttcttcttcttcatcttcgtctcctttagatcccaacaacctaccaacatcttggggtacccttcctagttatggggcactgtcgtcctacaacaaaaaccagattgggcctttcaactttggaatgcaaccaccctcccaagaaaacatttatcaaccttacatgcagaagatcaacaaccaggctccttcccaacaatctcttacagagaccatagccaccgcaaccaaggcaatcgcagccgacccgacattccgatcagcattagctgctgtcatcacgtcatttgttggtaatgcaggtggtgcaggtggaggagagaaccacgtcaagggagaaaaccctagccataatttgaagtggggtgagttcttatctgtgaactccgcattggcatcttctcataatggagtagggtgtgcctcaagttacttgaaccgttcctcttctgcaaattctcaacaacaagggaacttgatttcgtacccgccttcatttccattttctgtacctaagagtgcttctgcttccccttctgatcacaaagataatatccag

SEQ ID NO: 356 - protein, 594 aa, Vitis vinifera
  GSVIVT01020060001
MEAAALEIPVSGDPVKGEETTLMKFNGGDKGGVCDSMKVHLVAATERSSMENNSIDPSTQKNQEDRIKSAKEEVGEVREENERLKQILAKIKKDYQSLQMQFSEIAQHEEARKSTDTILTHQEEEEEETDLISLSLGRVSSAESKKDDKKTSFLSGKGKGDEKMDEGLALGLECKFEPAPTEHMMNASPENSFEGPKEEEPSTETWPPSKILKMGRSRDEEVLEQTHLKKARVSVRARCDTPTMNDGCQWRKYGQKIAKGNPCPRAYYRCTVSPSCPVRKQVQRCAEDTSILITTYEGTHNHPLPVSATAMASTTSAAASMLRSGSSTSQPGMEAFATSSTANLHGLNFSIPQNSRSQQFYFPNSSFSTSNSHPTITLDLTAPTASHFNRLSSSFPSAPRYPATCLNFSSSSSSSPLDPNNLPTSWGTLPSYGALSSYNKNQIGPFNFGMQPPSQENIYQPYMQKINNQAPSQQSLTETIATATKAIAADPTFRSALAAVITSFVGNAGGAGGGENHVKGENPSHNLKWGEFLSVNSALASSHNGVGCASSYLNRSSSANSQQQGNLISYPPSFPFSVPKSASASPSDHKDNIQ

SEQ ID NO: 357 - DNA, 1176 bp, Solanum lycopersicum
  Solyc05g007110.2.1
atgctaaggaaagatagagcaatggattctactaagaaggatgaagataagctaaattcaacaaaatgtgagatatatgaagccaaagaagaaaatgaaaggctaaaaaggatgttatctaaaatgatgaatgattataaatctttggaaatgtattttcaaggcatattaactcaaaaaaatacaaagaatattattgcaacaagtaataatattcatgaagaaaaagaacaagtggaacttgtttctttgagcttagggagaaatagtagtacttcaagagagttgatcaagaaggagttattatatgatgatcaaaataaaagtaataaaaaccatagtaaattattatttgatgggcttgagcttggattaggttgtaaattcactcaagaaaatagtttcgaggggccaaagaaggagaatataaataatgaacgacgagtattgatacaaaattaccttccatcggattactgtggcgaagaatttttgcagcaaattcctcaaaagaaggctagagtatctatacgggctgtgtgtgacactattacgatgaatgatggatgtcaatggagaaaatatggacaaaaaatagctaaagggaatccatgccctagggcttactatcgttgcaccgtctccccctcatgcccagtcaggaaacaggttcaaagatgttctaaagacacgtccattttgaccactacatatgaaggaacacataatcacccccttccattttctgcaaccgacatggcttctacaacctctgccgcagcctctatgttaagatgcacctcaacatcatcaacatcacaacaatttttaccaaatattgatcaaaatcttcatggaaaaatcaactttaccaataatacttcaaataataacttattattagccactcataacaattcaccaactttctacttaccaaaaacttcaatttctacttcccaatcacaccccacaattactcttgatttcactacaaactcatcaagtactaattcttcatcatccaattcctactccacattgtgtaataatatcaaaagtgaaattggaccttcttcatatctagggaggccatgttattctaatcagccttatattacttcaaaagaacaatcagaacatgatcgttcagtacagtgccggagtcagaatttt

SEQ ID NO: 358 - protein, 392 aa, Solanum lycopersicum
  Solyc05g007110.2.1
MLRKDRAMDSTKKDEDKLNSTKCEIYEAKEENERLKRMLSKMMNDYKSLEMYFQGILTQKNTKNIIATSNNIHEEKEQVELVSLSLGRNSSTSRELIKKELLYDDQNKSNKNHSKLLFDGLELGLGCKFTQENSFEGPKKENINNERRVLIQNYLPSDYCGEEFLQQIPQKKARVSIRAVCDTITMNDGCQWRKYGQKIAKGNPCPRAYYRCTVSPSCPVRKQVQRCSKDTSILTTTYEGTHNHPLPFSATDMASTTSAAASMLRCTSTSSTSQQFLPNIDQNLHGKINFTNNTSNNNLLLATHNNSPTFYLPKTSISTSQSHPTITLDFTTNSSSTNSSSSNSYSTLCNNIKSEIGPSSYLGRPCYSNQPYITSKEQSEHDRSVQCRSQNF

SEQ ID NO: 359 - DNA, 855 bp, Arabidopsis thaliana
  AT3G23250.1
atgggaagagctccatgctgtgagaagatggggttgaagagaggaccatggacacctgaagaagatcaaatcttggtctcttttatcctcaaccatggacatagtaactggcgagccctccctaagcaagctggtcttttgagatgtggaaaaagctgtagacttaggtggatgaactatttaaagcctgatattaaacgtggcaatttcaccaaagaagaggaagatgctatcatcagcttacaccaaatacttggcaatagatggtcagcgattgcagcaaaactgcctggaagaaccgataacgagatcaagaacgtatggcacactcacttgaagaagagactcgaagattatcaaccagctaaacctaagaccagcaacaaaaagaagggtactaaaccaaaatctgaatccgtaataacgagctcgaacagtactagaagcgaatcggagctagcagattcatcaaacccttctggagaaagcttattttcgacatcgccttcgacaagtgaggtttcttcgatgacactcataagccacgacggctatagcaacgagattaatatggataacaaaccgggagatatcagtactatcgatcaagaatgtgtttctttcgaaacttttggtgcggatatcgatgaaagcttctggaaagagacactgtatagccaagatgaacacaactacgtatcgaatgacctagaagtggctggtttagttgagatacaacaagagtttcaaaacttgggctccgctaataatgagatgatttttgacagtgagatggacttctggttcgatgtattggctagaaccggcggggaacaagatctcttagccgggctc

SEQ ID NO: 360 - protein, 285 aa, Arabidopsis thaliana
  AT3G23250.1
MGRAPCCEKMGLKRGPWTPEEDQILVSFILNHGHSNWRALPKQAGLLRCGKSCRLRWMNYLKPDIKRGNFTKEEEDAIISLHQILGNRWSAIAAKLPGRTDNEIKNVWHTHLKKRLEDYQPAKPKTSNKKKGTKPKSESVITSSNSTRSESELADSSNPSGESLFSTSPSTSEVSSMTLISHDGYSNEINMDNKPGDISTIDQECVSFETFGADIDESFWKETLYSQDEHNYVSNDLEVAGLVEIQQEFQNLGSANNEMIFDSEMDFWFDVLARTGGEQDLLAGL

SEQ ID NO: 361 - DNA, 738 bp, Arabidopsis thaliana
  AT1G06180.1
atggggagaagaccatgctgtgagaagataggattgaagaaagggccatggagtgctgaagaagatcgaatcttgatcaattatattagtctccatggccatcccaattggagagctctccctaaactagccgggctacttcggtgcggaaaaagttgcaggcttcgttggattaattatttgagaccagacatcaaacgtggcaatttcactcctcatgaagaagatactatcatcagcttacatcaactcttaggcaacagatggtctgcgatagctgcaaaattgcctggacgaacagacaacgaaattaaaaatgtttggcacactcatttaaagaaaagactccaccacagtcaagatcaaaacaacaaggaagatttcgtctctactacagctgcggagatgccaacctctccgcaacaacaatctagtagtagtgccgacatttcagcaattacaacattgggaaacaacaatgacatctccaatagcaacaaagactccgcgacgtcatccgaagatgttcttgcaattatagatgagagcttttggtcagaagtggtattgatggactgtgacatttcaggaaatgagaagaatgagaaaaagatagagaattgggagggctcactagatagaaacgataagggatataaccatgacatggagttttggtttgaccatctcactagtagtagttgtataattggagaaatgtccgacatttctgagttt

SEQ ID NO: 362 - protein, 246 aa, Arabidopsis thaliana
  AT1G06180.1
MGRRPCCEKIGLKKGPWSAEEDRILINYISLHGHPNWRALPKLAGLLRCGKSCRLRWINYLRPDIKRGNFTPHEEDTIISLHQLLGNRWSAIAAKLPGRTDNEIKNVWHTHLKKRLHHSQDQNNKEDFVSTTAAEMPTSPQQQSSSSADISAITTLGNNNDISNSNKDSATSSEDVLAIIDESFWSEVVLMDCDISGNEKNEKKIENWEGSLDRNDKGYNHDMEFWFDHLTSSSCIIGEMSDISEF

SEQ ID NO: 363 - DNA, 747 bp, Arabidopsis thaliana
  AT2G31180.1
atgggaagagcaccatgttgtgagaaaatgggggtgaagagaggaccatggactcctgaagaagatcaaatcttgatcaattatattcatctttatggtcattctaattggcgagctctcccaaaacacgcaggtttacttagatgtgggaaaagttgcagacttcgttggatcaattatcttagaccagacattaaacgtggcaatttcactcctcaagaagaacaaactattatcaatctgcatgaaagcttaggcaacagatggtctgcgattgctgcaaaattgccgggacgaaccgacaatgaaataaaaaatgtttggcacactcatttgaagaaaagactcagcaaaaatctaaacaatggcggagacaccaaagacgttaacggaattaacgagaccacaaatgaagacaaaggatctgtgatagtcgacacagcctctttacaacaattttctaatagtattacaacatttgatatttcaaatgataacaaggacgatattatgtcgtacgaggatatttctgccttgatagatgatagtttttggtcggacgtcatatcggtagataattcgaataagaatgagaagaagatagaggattgggaaggattgatcgatagaaatagtaaaaaatgtagctatagtaattctaagttgtataatgatgacatggagttttggtttgatgttttcactagtaatcgtagaattgaggaattttccgacatacccgagttt

SEQ ID NO: 364 - protein, 249 aa, Arabidopsis thaliana
  AT2G31180.1
MGRAPCCEKMGVKRGPWTPEEDQILINYIHLYGHSNWRALPKHAGLLRCGKSCRLRWINYLRPDIKRGNFTPQEEQTIINLHESLGNRWSAIAAKLPGRTDNEIKNVWHTHLKKRLSKNLNNGGDTKDVNGINETTNEDKGSVIVDTASLQQFSNSITTFDISNDNKDDIMSYEDISALIDDSFWSDVISVDNSNKNEKKIEDWEGLIDRNSKKCSYSNSKLYNDDMEFWFDVFTSNRRIEEFSDIPEF

SEQ ID NO: 365 - DNA, 756 bp, Brachypodium distachyon
  Bradi3g28830.1
atggggagagcgccgtgctgcgacaaggaggggctgcggaggggcgcgtggagccccgacgaggaccagcttctcgccgactacatcgcgcagcacggccaccccaactggcgcgccctccccaagcacgccgggctgctgcggtgcgggaagagctgccggctgcgttggatcaactacctccgtcccgacatcaagcggggaaacttcaccgccgacgaggaggaccagatcatccgcctccaccactccctcggcaacaggtggtccgcaatcgcagcgcagctgccgggacgcactgacaacgagatcaagaacgtctggcacacccatctcaagaagaggctgctggaggacaaccagaagaccactcccggcgatggcggccgccgccagaagaagcgcaagcagaaggccaaggctactaaaagcgctcccgtcagtgtcaagcatgagcagctctcgccggggcggtcgagcagcagcgtgacatataactcaacagtgactgagactgcggcgcccgtctcgtcctcgccggccatcaccagcgcgagccaccagcttgtcaaggaggagagcttcagctcggccgtggtcaccgacgacagcttctggttctcgacggatgtaacggggatgatgaaccttggcagtatggaagaggagctgagcctggcgcctacgaggaacgaggacatggatttctggctcaagatgttcgagtccggagacatgagggacttggccgtctct

SEQ ID NO: 366 - protein, 252 aa, Brachypodium distachyon
  Bradi3g28830.1
MGRAPCCDKEGLRRGAWSPDEDQLLADYIAQHGHPNWRALPKHAGLLRCGKSCRLRWINYLRPDIKRGNFTADEEDQIIRLHHSLGNRWSAIAAQLPGRTDNEIKNVWHTHLKKRLLEDNQKTTPGDGGRRQKKRKQKAKATKSAPVSVKHEQLSPGRSSSSVTYNSTVTETAAPVSSSPAITSASHQLVKEESFSSAVVTDDSFWFSTDVTGMMNLGSMEEELSLAPTRNEDMDFWLKMFESGDMRDLAVS

SEQ ID NO: 367 - DNA, 828 bp, Oryza sativa
  LOC_Os10g33810.1
atggggagggcgccgtgctgcgagaaggaggggctgaggagaggggcgtggagccccgaggaggacgaccgcctcgtcgcctacatccgccgccacggccaccccaactggcgcgcgctccccaagcaagccgggcttctccgctgcgggaagagctgcaggctgcggtggatcaactacctccggccggacatcaagcgggggaacttcaccgccgacgaggaggacctcatcgtccgcctccacaactccctcggcaacaggtggtcagccatcgccgcccagatgccgggtcgcactgacaacgagatcaagaacgtgtggcacactcacctcaagaagaggctggacgacgaacggaagctcgccgccgccggcggtggcggtggccgccggccgcatacgcgcaagcagcccaaggcggcaaagagcgccgccgccgtcaagcgcgaggcgacgccgtccgtcagcgtcgacaccagtagcggcgtgacgtgctccacggtgaccgagtcgtcgccgtcgtcggccgacggcgaccaccggcggcagcagcagcaaacgcagcatgccgctgtcaaggaggagagcttcagctcgggcggcgagctgccggcggcggcggcggcgcccacggcagcggccgacatggacgagagcttctggtcgtcgacggaggtgaccgggatgatggccggcctcggcgacatggacgaggagctggccatcgccggcacgtcgtcggcggcggcggcgaggagcgacgacatggagttctggctcaagatgctcctcgagtccggcgacatgagggatttggccgtcttg

SEQ ID NO: 368 - protein, 276 aa, Oryza sativa
  LOC_Os10g33810.1
MGRAPCCEKEGLRRGAWSPEEDDRLVAYIRRHGHPNWRALPKQAGLLRCGKSCRLRWINYLRPDIKRGNFTADEEDLIVRLHNSLGNRWSAIAAQMPGRTDNEIKNVWHTHLKKRLDDERKLAAAGGGGGRRPHTRKQPKAAKSAAAVKREATPSVSVDTSSGVTCSTVTESSPSSADGDHRRQQQQTQHAAVKEESFSSGGELPAAAAAPTAAADMDESFWSSTEVTGMMAGLGDMDEELAIAGTSSAAAARSDDMEFWLKMLLESGDMRDLAVL

SEQ ID NO: 369 - DNA, 816 bp, Zea mays
  GRMZM2G147346_T01
atggggagggcgccgtgctgcgagaaggaggggctgcggcggggcgcgtggagcgccgaggaggaccagcgcctggtggcctacgtccggcagaacggccaccccaactggcgcgcgctgccacgccaggccggcctgctccgctgcggcaagagctgccgcctccgctggatcaactacctccgccccgacatcaagcgcggcaacttcacccccgacgaggaggccctcatcgtccgcctccaccgcgagctcggcaacaggtggtcagcgatcgcggcgcagctgccggggcgcaccgacaacgagatcaagaacgtgtggcacacccacatcaagaagcgcctggaggacggccacggggaggagaagaaggcgcgcaaaggcaagcccgccgccaagaaggccgccgacgccgtgggccgcagcagcgagcacgggccgttcctgaccgcgtcgccggggctgtcgagcagcggcgtcacgttctccgccgcggcggactccgccgcggccgtgtcgtcgtcggccgacaacgcggccaccaccagccaccacccgcagcaggtcggcgccagcaaggcggagtcgtcgacggagttggacagcggcctcagctccgccgagttcccgcccctcgacgacagcttctggtcgtcggcggacgtcgtggacatgggcctcggcgccacggacgaggagctgggcctcgcgtgcccgccgccgctgtcgtcgtcgtccaccagggacgaggacatggagttctggctcaacatgctgctggaggccggcgacatgagggacttgagcgtcttg

SEQ ID NO: 370 - protein, 272 aa, Zea mays
  GRMZM2G147346_T01
MGRAPCCEKEGLRRGAWSAEEDQRLVAYVRQNGHPNWRALPRQAGLLRCGKSCRLRWINYLRPDIKRGNFTPDEEALIVRLHRELGNRWSAIAAQLPGRTDNEIKNVWHTHIKKRLEDGHGEEKKARKGKPAAKKAADAVGRSSEHGPFLTASPGLSSSGVTFSAAADSAAAVSSSADNAATTSHHPQQVGASKAESSTELDSGLSSAEFPPLDDSFWSSADVVDMGLGATDEELGLACPPPLSSSSTRDEDMEFWLNMLLEAGDMRDLSVL

SEQ ID NO: 371 - DNA, 852 bp, Setaria italica
  Si040527m
atggggagggcgccgtgctgcgagaaggaggggctgcggcggggtgcgtggagccccgaggaggaccagcggctggtggcctacatccggcagcacggccaccccaactggcgcgcgctgccccggcaggccgggctcctccgctgcggcaagagctgccgcctccgctggatcaactacctccgcccggacatcaagcgcggcaacttctccgccgacgaggaggccctcatcgttcgcctccacctcgagctcggcaacaggtggtccgcgatcgcggcgcagctgccggggcgcaccgacaacgagatcaagaacgtgtggcacacccacatcaagaagcgcctggaagacgacgcggaggccaacgccgccgccgccggcggcggccggccgaagcagcagaaggcgcgcaagagcaagcccgctgccgcggccaagaaggctaccgccgccgccgccgccgtttcggacagcagcgagcagcagccgttcacgacggcgtcgccggggctgtcgagcagcgtgagcagcggcgagacgacgttctccacggcgaccgagtccaccgcggcggtgtcgtcgggcgacaacgcggccaccaccagcgcgagcccccagcccggcgccgccaaggcggagatggagatggagagcttcagctcggccgagttcccgcccatcgacgagagcttctggtcgtcgccggacgtggtagacatgggcctcggcgccatggacgaggagctgggcctcgcgggcccgccgtcgttgtccacgagggacgaggacatggagttctggctcaagatgctgctggaggccggcgacatgagggacttgagcgtcttg

SEQ ID NO: 372 - protein, 284 aa, Setaria italica
  Si040527m
MGRAPCCEKEGLRRGAWSPEEDQRLVAYIRQHGHPNWRALPRQAGLLRCGKSCRLRWINYLRPDIKRGNFSADEEALIVRLHLELGNRWSAIAAQLPGRTDNEIKNVWHTHIKKRLEDDAEANAAAAGGGRPKQQKARKSKPAAAAKKATAAAAAVSDSSEQQPFTTASPGLSSSVSSGETTFSTATESTAAVSSGDNAATTSASPQPGAAKAEMEMESFSSAEFPPIDESFWSSPDVVDMGLGAMDEELGLAGPPSLSTRDEDMEFWLKMLLEAGDMRDLSVL

SEQ ID NO: 373 - DNA, 780 bp, Eucalyptus grandis
  Eucgr.K03262.1
atggggagagctccgtgttgtgagaagatgggtttgaagaaaggcccctggacccccgacgaggaccgcatcctcatcaactacgtccagcatcacggccacgggaattggcggaggctccctaagctcgccggcttgttgaggtgtggcaagagttgcaggctcaggtggacaaattacttgagaccagatattaaaagaggaaactttagcagagaagaagaggacaccatcatccaactccacgaaatgcttgggaacagatggtcggcgatagcagcgaggttgccgggacgaacagacaatgagataaaaaacgtgtggcacacccatctaaagaagaggctaagaaaggagcacgaggcggcagtgctcgacaatgttccgtccaaaaggctagtcacgatgtcgcataccaacaacgaaccacatgctaaatatgaaagccacggtgggccaatctcatctccccaaactcaacagagctcaagcagcgtgtctctatcctctacgaccacggaagacaacagcggcaatgataacaaatgcatcaaagaggcgcttgaagatgcaatctccggattgatagacgagaatttctggtcagaattggtatcatcagatgacaacaactcagccatgagcgatgattttcttgcggttagcagtgagttccaatcgtccctaagttcaaacgttggaccgtgggacatgaatggaggtgggatggtggattgtttttggtatgatctcctcaaaggagctgaattagcagatgtc

SEQ ID NO: 374 - protein, 260 aa, Eucalyptus grandis
  Eucgr.K03262.1
MGRAPCCEKMGLKKGPWTPDEDRILINYVQHHGHGNWRRLPKLAGLLRCGKSCRLRWTNYLRPDIKRGNFSREEEDTIIQLHEMLGNRWSAIAARLPGRTDNEIKNVWHTHLKKRLRKEHEAAVLDNVPSKRLVTMSHTNNEPHAKYESHGGPISSPQTQQSSSSVSLSSTTTEDNSGNDNKCIKEALEDAISGLIDENFWSELVSSDDNNSAMSDDFLAVSSEFQSSLSSNVGPWDMNGGGMVDCFWYDLLKGAELADV

SEQ ID NO: 375 - DNA, 765 bp, Solanum lycopersicum
  Solyc06g083900.2.1
atggggagatctccttgctgtgagaaattggggttgaaaagaggtccatggagcaaagaagaagattatttactcatcaattacattaaaaagaatggtcatcctaattggcgtgcacttccaaaacttgcaggtctattaaggtgcggaaaaagttgtaggcttcgatggactaattacttgagacctgatattaagcgaggcaattttactcatcaagaagaagatacaattatcaagttgcatcaagttcttggaaacagttggtctgctattgcagcaagattacccggaagaacagataacgaaataaaaaacatttggcatactcgtctgaagaaaaaaaggaatgaatctcaacttaaagaaacccaatcggagcctgaaaatactaatgtagatgtacatttggaggaggccaacaattctaatgataaacattccgaaatatcgaatcttaaaataaacatcgaaatccaacaacaaccaagtccatcatcgtcagtatcatcatcaagtgaagattcatgttcaaatacaactgcaacgagttcagagtcgagaaatcaaataatgtccgataatttgttagaaattgatgacgatatttggtccgaggtagtatgggcacaagtcgatgacaattatgttgatttgtcattaatggaggataattaccacattaattctagctttgatgataattggttttgggatgatctttttacaagatctaatgagttgatgttagaattgcctgaatta

SEQ ID NO: 376 - protein, 255 aa, Solanum lycopersicum
  Solyc06g083900.2.1
MGRSPCCEKLGLKRGPWSKEEDYLLINYIKKNGHPNWRALPKLAGLLRCGKSCRLRWTNYLRPDIKRGNFTHQEEDTIIKLHQVLGNSWSAIAARLPGRTDNEIKNIWHTRLKKKRNESQLKETQSEPENTNVDVHLEEANNSNDKHSEISNLKINIEIQQQPSPSSSVSSSSEDSCSNTTATSSESRNQIMSDNLLEIDDDIWSEVVWAQVDDNYVDLSLMEDNYHINSSFDDNWFWDDLFTRSNELMLELPEL

SEQ ID NO: 377 - DNA, 750 bp, Eucalyptus grandis
  Eucgr.B02144.1
atggcgaggacaccatgctgtgagaagatggggatgaagaaaggaccgtggactccagaggaagaccagatcctgatctcccacatccaccagtttggtcactcaaactggcgtgcacttcctagacaagcaggtctgttaagatgtgggaagagttgcagactccggtggataaactacttgcgacccgacgtgaagcgagggaacttcaccgacgacgaaagagacaccatcatccaacttcatcaagttctgggcaacagatggtcggccatagcctcgagattgccggggcgaacggacaatgaaataaagaacttctggcacacccacctgaagaaacgggtgccacacagcctccccaactcaactcccttcaccataaaccctactcgttgcaccaccctcgatccctcattccagaatccaacctccgcgccgccgacgcagaagtttcaagaaccactgacaacgtcagagacggagtcaggcccctcgatagcagttcaagcgaacatcgaaagcagctcacaagctgtgccgtcttctcgtgcttcccagaagctcgagaagacaaaaaaggatctcatcgcgggttcagccccggcttttccgatggcagcgggctcacagtgcggcgggcagggagttctgagcatgaagggagacaaggacatggagttctggtacagtcttctggtgagagcaggagatggacatcatcaggtggggaacgccgccgggacgcta

SEQ ID NO: 378 - protein, 250 aa, Eucalyptus grandis
  Eucgr.B02144.1
MARTPCCEKMGMKKGPWTPEEDQILISHIHQFGHSNWRALPRQAGLLRCGKSCRLRWINYLRPDVKRGNFTDDERDTIIQLHQVLGNRWSAIASRLPGRTDNEIKNFWHTHLKKRVPHSLPNSTPFTINPTRCTTLDPSFQNPTSAPPTQKFQEPLTTSETESGPSIAVQANIESSSQAVPSSRASQKLEKTKKDLIAGSAPAFPMAAGSQCGGQGVLSMKGDKDMEFWYSLLVRAGDGHHQVGNAAGTL

SEQ ID NO: 379 - DNA, 627 bp, Glycine max
  Glyma03g41100.1
atgacgagaactccttgttgtgagagaatgggattgaagaagggaccttggactgctgaagaagatcagatattggtttctcatattcaacgatatggccatggaaactggcgtgcgcttcctaaacaagctggtttgttaaggtgtggcaagagttgtaggcttcgttggataaattacttgaggccagatattaaacgagggaaattcagcaaggaagaagaggataccatcctaaagctacatggaattcttggaaacagatggtctgctatagcggcaagtttgcccggaagaacagacaacgaaataaagaatttttggcatacccatttgaagaagaggatccagaaaagtggagtgcacaatggcaatccttcctcacgtatcttgcaagaggcacaagcaaatactagttcgaatgcatcaagtgtaatgattgccaattacggtttaccctcaaggaatattaatccacctattgcaggattttacggtgcagtctcctcagatacttttggagaaattaaggacaatcatggttcttgtcagctcagtgaagaaatggaattttggtacaatatatattcatcaaatcagggcaaacatcatgagacaatggaaatc

SEQ ID NO: 380 - protein, 209 aa, Glycine max
  Glyma03g41100.1
MTRTPCCERMGLKKGPWTAEEDQILVSHIQRYGHGNWRALPKQAGLLRCGKSCRLRWINYLRPDIKRGKFSKEEEDTILKLHGILGNRWSAIAASLPGRTDNEIKNFWHTHLKKRIQKSGVHNGNPSSRILQEAQANTSSNASSVMIANYGLPSRNINPPIAGFYGAVSSDTFGEIKDNHGSCQLSEEMEFWYNIYSSNQGKHHETMEI

SEQ ID NO: 381 - DNA, 636 bp, Glycine max
  Glyma19g43740.1
atgacgagaactccttgttgtgagagaatgggattgaagaagggaccttggactgctgaagaagatcagatattggtttctcatattcaacaatatggccatggaaactggcgtgcccttcctaaacaagctggtttgttaaggtgtggcaagagttgtaggcttcgttggataaattacttgaggcctgatattaaacgagggaaattcagcaaagaagaagaacataccatcctaaagctacatggaattcttggaaacagatggtctgctatagcggcaagcttacccggaagaacagacaacgaaataaagaatttttggcatacccatttgaagaagaggatccagaaaagtggagtgcacaatggcaatgcttcctcacgtatcttgcaagaggcacaagcaaatactagtttggatgcatcaagtgctgcttctagtactgtcactgcaaatgtaatgattgccaattacggtttacccgtaaggaatattaatccacctattgcaggattttacggtgcagtctcctcagatacttttggagaaattgaggacaatcatggttcttgtcagctcagtgaagaaatggaattttggtacaatatatttatcaaatcagggcaaacatca

SEQ ID NO: 382 - protein, 212 aa, Glycine max
  Glyma19g43740.1
MTRTPCCERMGLKKGPWTAEEDQILVSHIQQYGHGNWRALPKQAGLLRCGKSCRLRWINYLRPDIKRGKFSKEEEHTILKLHGILGNRWSAIAASLPGRTDNEIKNFWHTHLKKRIQKSGVHNGNASSRILQEAQANTSLDASSAASSTVTANVMIANYGLPVRNINPPIAGFYGAVSSDTFGEIEDNHGSCQLSEEMEFWYNIFIKSGQTS

SEQ ID NO: 383 - DNA, 630 bp, Glycine max
  Glyma10g30860.1
atggtgagaactccatgttgtgagaagatgggcttgaagaagggatcttggacacgagaagaagatcagatattgatttctcacattcaacgatatggccatggaatctggcgtgcccttccaaaacaagctggtctgttaaggtgtggtaagagttgtagacttcgttggataaattatttgagtccagatattaaacgagggaaattcagcaaggaagaagaagagatcatcctcaaattacatggaattcttggaaatagatgggctactattgcgacaagattaccaggacgaaccgacaacgaaataaagaatttttggcacacccatttgaagaagaggcttgagagaagtaaagtgataaatacctactctaatcccttgcaagaggcacaaacagcttctagtgcaaggactttaataagtgttccacgagtagcggtggaagcttcgggtgcttcttctagtagaaatccacctattgtaggtctaggattttatggtgttgcctcttctgatattctaggacaaataattggcaatagttctcacagtcgtcagatcgataaagaactggaatttcggtctaatgtgtatatgaacagtcatcacaagggtatgaaaatg

SEQ ID NO: 384 - protein, 210 aa, Glycine max
  Glyma10g30860.1
MVRTPCCEKMGLKKGSWTREEDQILISHIQRYGHGIWRALPKQAGLLRCGKSCRLRWINYLSPDIKRGKFSKEEEEIILKLHGILGNRWATIATRLPGRTDNEIKNFWHTHLKKRLERSKVINTYSNPLQEAQTASSARTLISVPRVAVEASGASSSRNPPIVGLGFYGVASSDILGQIIGNSSHSRQIDKELEFRSNVYMNSHHKGMKM

SEQ ID NO: 385 - DNA, 585 bp, Populus trichocarpa
  POPTR_0019s03490.1
atggggagagctccttgttgtgaaatgatggggttaaagaagggaccttggactcccgaagaagatcaaatcttggtatcttacattcgaagttatgggcatggaaattggcgagcactccctaaacaagctggtttattaaggtgtggtaagagttgtaggcttaggtggataaattacttacgtccagacattaaacgaggaaatttcagcaatgaagaggaagaaactatcattaagctacatcaaattcttggaaataggtatgtgttcttgacaagattacctgcaggaagaacagataacgagataaagaattattggcacagccatctaaaaaagagatttcaacagaatatgggacgcccaactgaacattgcagaaaaacaccagaaagggcaatggttaataacactagttcatcgcagcctgcgagtttcaaggttcatcaaagtaaatgtcaaaggcaaagcccctcggataatgcaccaattttccaggaagcttcgtcccaagaaatgtttagttctatggccacgatggaagccatgaatggtttcagtggtaaaaatgatatagaggag

SEQ ID NO: 386 - protein, 196 aa, Populus trichocarpa
  POPTR_0019s03490.1
MGRAPCCEMMGLKKGPWTPEEDQILVSYIRSYGHGNWRALPKQAGLLRCGKSCRLRWINYLRPDIKRGNFSNEEEETIIKLHQILGNRYVFLTRLPAGRTDNEIKNYWHSHLKKRFQQNMGRPTEHCRKTPERAMVNNTSSSQPASFKVHQSKCQRQSPSDNAPIFQEASSQEMFSSMATMEAMNGFSGKNDIEEF

SEQ ID NO: 387 - DNA, 654 bp, Solanum lycopersicum
  Solyc05g055030.1.1
atggtaagagctccatgttgtgagaaaatggggttgaagaaagggccatggactcaagaagaagatcaaattttgataaattttattcaaaaatatggacatgaaaattggagggcacttcctaaacaagcaggtttattaagatgtggaaaaagttgtagattaaggtggacaaattacttaaggccagatattaaaagaggaaactttagtgaggaagaagaacaaatcatcattaagctacatcaacttcttggaaacagatggtctgcaattgcctcaaggctgccaggaagaacagataacgaaatcaagaatttctggcatactcacttgaagaaaagattggaacaaagcaataatctagcatctactataactaccaagagaagagatgaaataacaacaaatgcttcacaaaatattgatgagcatcatataatttcttcaaattattatcaagattctcaaaatattgttgcctatcatccaacttattgtcattatcaagaagatattcaatcaaacaaggaggagaacatgcaatattcaacaaattatgaacacaaggacatgactagtttcaacaatgatatggttttttggtacaacgtcctcatgagttcgggaaacaacgcgtctgatgagatcagt

SEQ ID NO: 388 - protein, 218 aa, Solanum lycopersicum
  Solyc05g055030.1.1
MVRAPCCEKMGLKKGPWTQEEDQILINFIQKYGHENWRALPKQAGLLRCGKSCRLRWTNYLRPDIKRGNFSEEEEQIIIKLHQLLGNRWSAIASRLPGRTDNEIKNFWHTHLKKRLEQSNNLASTITTKRRDEITTNASQNIDEHHIISSNYYQDSQNIVAYHPTYCHYQEDIQSNKEENMQYSTNYEHKDMTSFNNDMVFWYNVLMSSGNNASDEIS

SEQ ID NO: 389 - DNA, 792 bp, Glycine max
  Glyma02g00820.1
atggttagagctccttgttgtgaaaagatgggattgaagaagggtccttggaccccagaggaagatcaaatcctcatgtcatacatccaaaaacatggccatggaaattggcgtgccctcccaaagcttgcagggttattaaggtgtggcaagagctgcaggctaaggtggattaactatttaaggccagatatcaagagaggaaatttttcaagcgaagaagaggaaattatcattaagatgcatgagttgctggggaacaggtggtcagcaattgcagcaaaattaccaggaagaactgacaatgaaataaaaaatgtgtggcacacccacttgaagaagaggctactgaattcagatatccaaaaaagggtttccaagccaagaatcaaacgatctgattccaattccagcacactaactcaattagaacctacatcatcagcatgcactacttctttaagtgacttttcatcatttagtgaagggactaaaaacatggacaacatgatcaagagtgaagacatagagtctgtggagacaataatgcctccaattgatgaaagcttttggtcagaggcaacagtggattatgaaagctccaccatgatgacatcaaattcttggacaatttcaaatgaattagcaccccctcaataccaatttaattcagtggaaagcttccaacaacaaagtgttgattataatggttcaaacgatgatcatgatggcatggatttctggtatgacatattcatcaaatcaggggagtcaatcgaattgccagagttc

SEQ ID NO: 390 - protein, 264 aa, Glycine max
  Glyma02g00820.1
MVRAPCCEKMGLKKGPWTPEEDQILMSYIQKHGHGNWRALPKLAGLLRCGKSCRLRWINYLRPDIKRGNFSSEEEEIIIKMHELLGNRWSAIAAKLPGRTDNEIKNVWHTHLKKRLLNSDIQKRVSKPRIKRSDSNSSTLTQLEPTSSACTTSLSDFSSFSEGTKNMDNMIKSEDIESVETIMPPIDESFWSEATVDYESSTMMTSNSWTISNELAPPQYQFNSVESFQQQSVDYNGSNDDHDGMDFWYDIFIKSGESIELPEF

SEQ ID NO: 391 - DNA, 792 bp, Glycine max
  Glyma10g00930.1
atggttagagctccttgttgtgaaaagatgggattgaaaaagggtccttggaccccagaggaagatcaaatcctcatgtcatacatccaaaaacatggccatggaaattggcgtgccctcccaaagcttgcaggactattgaggtgtggaaagagctgcagactaaggtggattaactatctaaggcctgatatcaagagaggcaatttctcaagtgaagaagaggaaattatcattaagatgcatgagttgctggggaacaggtggtcagcaattgcagcaaaattaccaggaagaactgacaatgaaataaaaaatgtgtggcacacccacttgaaaaagaggttaatgaattcagataccaacaaaagggtttccaagccaagaatcaaacgatctgattccaattccagcacacttactcaatcagaacctacatcatcatcaggatgcactacttctagtgatttttcatcatttagtgaagggactaaaaacatggacaacatgatcaagagggaagacatagagtctatggagacagtaaagcctccaattgatgaaagcttttggccacaagaaacagtggattatgaaagctccaccatgatgcaatcatcaaattcttggacaatttctaatgaattagcaccccctcaataccaatttaattcagtggaaacctttcaacagcaaagtgttggttataatgattcaaaatttgatgatggcatggatttctggtatgacatattcatcaaatcaggagagtcaatcgaattgccagagttc

SEQ ID NO: 392 - protein, 264 aa, Glycine max
  Glyma10g00930.1
MVRAPCCEKMGLKKGPWTPEEDQILMSYIQKHGHGNWRALPKLAGLLRCGKSCRLRWINYLRPDIKRGNFSSEEEEIIIKMHELLGNRWSAIAAKLPGRTDNEIKNVWHTHLKKRLMNSDTNKRVSKPRIKRSDSNSSTLTQSEPTSSSGCTTSSDFSSFSEGTKNMDNMIKREDIESMETVKPPIDESFWPQETVDYESSTMMQSSNSWTISNELAPPQYQFNSVETFQQQSVGYNDSKFDDGMDFWYDIFIKSGESIELPEF

SEQ ID NO: 393 - DNA, 825 bp, Glycine max
  Glyma10g32410.1
atggtgagagctccttgttgtgaaaagatgggtttgaagaagggtccttgggctcccgaggaagatcaaatcctcacatcttacattgacaaacatggtcatggcaattggcgtgccctcccaaagcaagcaggcttgttaaggtgtgggaaaagctgtagactccgctggattaactatttgaggcctgatattaaaagagggaatttcacaattgaagaagaagaaactatcattaagctgcatgacatgctggggaacaggtggtcagcaattgcagccaaattgccaggaagaactgacaatgagattaaaaatgtttggcacaccaatttgaagaagaggctgctgaaatcagaccagtccaagtccaaaccaagttccaaaagagccattaagccaaaaatcgaacgttctgattcaaattccagcatcataactcaatcagaacctgacaattttaatttcagagaaatggacacaataacatcatcagcatgcactacttctagtagtgatttttcatcggtcacggttggtgacagcaaaaatatcaagagtgaagacacagagtctacggaaacaatgcctgtgattgatgagagcttttggtcagaagctgcaattgatgatgaaacccccaccatgtcatcatctcagtctttgacaatctcaaatgagatgcgacttcaatacccttttgctaactatgaggaaactttccagcagggtcatcatgcttatgattcaaactttgatgatggcatggatttctggtatgacatatttaccaggaccaatgattcaatagaattgctagagttc

SEQ ID NO: 394 - protein, 275 aa, Glycine max
  Glyma10g32410.1
MVRAPCCEKMGLKKGPWAPEEDQILTSYIDKHGHGNWRALPKQAGLLRCGKSCRLRWINYLRPDIKRGNFTIEEEETIIKLHDMLGNRWSAIAAKLPGRTDNEIKNVWHTNLKKRLLKSDQSKSKPSSKRAIKPKIERSDSNSSIITQSEPDNFNFREMDTITSSACTTSSSDFSSVTVGDSKNIKSEDTESTETMPVIDESFWSEAAIDDETPTMSSSQSLTISNEMRLQYPFANYEETFQQGHHAYDSNFDDGMDFWYDIFTRTNDSIELLEF

SEQ ID NO: 395 - DNA, 816 bp, Glycine max
  Glyma20g35180.1
atggtgagagctccttgttgtgaaaagatgggtttgaagaagggtccttgggctaccgaggaagatcaaattctcacatcttacatccaaaaacatggccatggcaattggcgtgccctcccaaagcaagcaggccttctaaggtgtgggaaaagctgcagactccgctggattaactatttgaggcctgatatcaagagagggaatttcacaattgaagaagaagaaactatcattaagctgcatgagatgttgggaaacaggtggtcagcaattgcagccaaattgccaggaagaactgacaatgagataaaaaatgtttggcacaccaatttgaagaagaggctgctgaaatcagaccagtccaagccaagttccaaaagagccactaagccaaaaattaaacgttctgattccaattccagcatcataactcaatcagaacctgctcatcttagattcagagaaatggacacaacatcaacagcatgcaatacttctagtagtgatttttcatcagtcacggttggtgacagcaaaaatattatcaagagtgaagacatagagtctatggaaacaatgcctgtgatagatgagagcttttggtcagaagctgcaattgatgatgaaacccccaccatgtcatcacaatctttgatcacaatctcaaatgacatgccacttcaatacccttttgctaactatgaggaaactttccaacagagtcatgcttatgattcaaactttgatgatggcatggatttctggtatgacatattcaccaggaccaatgattcaatagaattgtcagagttc

SEQ ID NO: 396 - protein, 272 aa, Glycine max
  Glyma20g35180.1
MVRAPCCEKMGLKKGPWATEEDQILTSYIQKHGHGNWRALPKQAGLLRCGKSCRLRWINYLRPDIKRGNFTIEEEETIIKLHEMLGNRWSAIAAKLPGRTDNEIKNVWHTNLKKRLLKSDQSKPSSKRATKPKIKRSDSNSSIITQSEPAHLRFREMDTTSTACNTSSSDFSSVTVGDSKNIIKSEDIESMETMPVIDESFWSEAAIDDETPTMSSQSLITISNDMPLQYPFANYEETFQQSHAYDSNFDDGMDFWYDIFTRTNDSIELSEF

SEQ ID NO: 397 - DNA, 783 bp, Citrus clementina
  clementine0.9_019060m
atggtgaggacaccttgctgtgataaaacaggactgaagaagggaacatggacacctgaagaagatagaaagctaatagcttatgtgactaagtatggctactggaactggcgccagcttcctaagtatgcaggtctggcaaggtgtgggaagagctgcagattgaggtggatgaattacttgaggcctaatatcaaaagagggaattacaccaaagaagaagaagatataatcatcagactacacgagtcactgggaaatagatggtccgcgattgctgcccagttaccgggaagaactgacaatgagatcaaaaaccactggcacacaagcctcaagaaacgcttgaaacgaaattcaatcaccaatactaatggagccaaagataccccaaaacgaaaagatcctgaaatatacaatcatgatgacactgaagccaacccagtgcaagaatcaaatcttgtcgacattattcctccaattcttgaaagctcttcttcatcaagtgaccagatttcctccttgtccatgaccacagatattacctcagttggaaaaaatacaaataccactgatgagttgattcttgacaataataatgaggctgtttttcatccatatgcggacaccagtggaagtttctggaccgagccgttctattctgataatttctacaatttatatatttccaatgattttcaggcacccagcttgttgccggccgatcctggatttgcatctgttcactccccatttcttgatggagaaattatcttatggcct

SEQ ID NO: 398 - protein, 261 aa, Citrus clementina
  clementine0.9_019060m
MVRTPCCDKTGLKKGTWTPEEDRKLIAYVTKYGYWNWRQLPKYAGLARCGKSCRLRWMNYLRPNIKRGNYTKEEEDIIIRLHESLGNRWSAIAAQLPGRTDNEIKNHWHTSLKKRLKRNSITNTNGAKDTPKRKDPEIYNHDDTEANPVQESNLVDIIPPILESSSSSSDQISSLSMTTDITSVGKNTNTTDELILDNNNEAVFHPYADTSGSFWTEPFYSDNFYNLYISNDFQAPSLLPADPGFASVHSPFLDGEIILWP

SEQ ID NO: 399 - DNA, 990 bp, Eucalyptus grandis
  Eucgr.H03057.1
atggtgagatcttcgtgctgttggagggcggggctgaagaaagggccatggacacctgaagaagaccaaaaactcttctcctacatccagaagcatggccaccctaactggcgagctcttcccaagcatgctggactgttgagatgtgggaagagctgcaggcttcggtggaccaactacttgaggccagacataaagaggggcaacttcagctccgaggaagaggagaccatcatcaagttgcacgaaatgctgggaaataggtggtcagcgattgtagcaaaattgcctggacgtacagacaacgagataaagaacgtctggcacacccgccttaagaagagagtcaagcagaaacaagccaaccaccacccaagcaccgcctctgcctcagcctcctcctccgccgccacgcctgccttgtccatcaattctagcaccgtcaatgacccgccggaaccagaagattcgaactgctcaagaccgcccggattcgagagcccacggtacgctcgaagttcatcacctccacgatcttctagcaaaatttcttgcacctcggaccctgtgatggccactgcggaaccgaactacaacctagacgtcctcattgttgatcaaaacccgaccgagtccatcgaatcggtcccagatttctggtcggatccaatctcagccaattcctacgtcagcttgtcatcggattttgcgggattaaccagtagtgacgatcaagctcaacaggttgaatttcccttggacaaaactcttaacgacttgcaattttggcccgaattcaaagacgtgccatcagattttggccaggccaatgaagcgcagcaacatgaattcccatgggacatgaatgatcggtttgaactgtggagtggcgatagcaattcaatgatcgacgacggggttgactatttctggtacgatcttttggtgagagctgagggttcagaagaactgccgttcccggaaattaat

SEQ ID NO: 400 - protein, 330 aa, Eucalyptus grandis
  Eucgr.H03057.1
MVRSSCCWRAGLKKGPWTPEEDQKLFSYIQKHGHPNWRALPKHAGLLRCGKSCRLRWTNYLRPDIKRGNFSSEEEETIIKLHEMLGNRWSAIVAKLPGRTDNEIKNVWHTRLKKRVKQKQANHHPSTASASASSSAATPALSINSSTVNDPPEPEDSNCSRPPGFESPRYARSSSPPRSSSKISCTSDPVMATAEPNYNLDVLIVDQNPTESIESVPDFWSDPISANSYVSLSSDFAGLTSSDDQAQQVEFPLDKTLNDLQFWPEFKDVPSDFGQANEAQQHEFPWDMNDRFELWSGDSNSMIDDGVDYFWYDLLVRAEGSEELPFPEIN

SEQ ID NO: 401 - DNA, 801 bp, Citrus clementina
  clementine0.9_018739m
atggtgagagctccatgctgcgagaagatgggattgaagaaaggtccatggactcctgaagaagatcaaattttaatcaattacattcaactttatggccatggcaactggcgggcacttcccaaacaagcaggtttattaagatgtggaaagagttgccggctccggtggataaattacttgcggccggatattaaacggggaaatttcaccagagaagaagaggacactatcatcaacctacatgaaatgctcggaaatagatggtcagcaatcgcagcaagacttccgggaagaacggacaacgaaattaaaaatgtttggcacactcacttgaaaaagcgtctcaagcaaaagcaacaacaagagcccgtgattaataatcatagtaacgctaatcatgttacggcgagatccgagatctgcagcggcgccagtactcccgatcggcaagactcgactactacttcaagcgacatgtcgtccgtcacctcctccgcggctaataacgcttgcgtgaaaacagagccgtcgtcgtccgaaaacaatcacgacagcttggttgaaatagatgagaatttttggacggaagtgttgtcggctgagaactcgggcattagtattgaggacagcaatgatcgtttttcagcggttggaggcgccgacccactgtctatagttgaatttcaatcatcactcgatgcttttagacctggttctactttgtgtgataacaccgacttttggttcaatcttttcaccaaagctggagatttctcagaaatgttaccagaaatttta

SEQ ID NO: 402 - protein, 267 aa, Citrus clementina
  clementine0.9_018739m
MVRAPCCEKMGLKKGPWTPEEDQILINYIQLYGHGNWRALPKQAGLLRCGKSCRLRWINYLRPDIKRGNFTREEEDTIINLHEMLGNRWSAIAARLPGRTDNEIKNVWHTHLKKRLKQKQQQEPVINNHSNANHVTARSEICSGASTPDRQDSTTTSSDMSSVTSSAANNACVKTEPSSSENNHDSLVEIDENFWTEVLSAENSGISIEDSNDRFSAVGGADPLSIVEFQSSLDAFRPGSTLCDNTDFWFNLFTKAGDFSEMLPEIL

SEQ ID NO: 403 - DNA, 882 bp, Glycine max
  Glyma03g31980.1
atggggagagctccatgctgcgagaaaatggggttgaagagagggccatggactccagaagaagatcaaattctcatcaattatatcaacacttatgaccatgctaattggcgtgcattgcccaaactagctgggctgttaaggtgtggaaagagttgcagactccggtggataaattatctgagaccggacatcaaacggggcaactttaccagagaagaagaggacaccataatcagtttgcatgaaatgttgggaaacagatggtcggctatagcggcaaggttgccagggagaacagacaacgagataaaaaacgtgtggcacacccacttgaagaagaggctgccacaaaattataaacaaagccacgaccagaaaaaacgaagcaaaaaacaaccaaagttagatgtggacgcctccaaatcaaaccaagacgccaaactagaacaacaacaagagcccgtgaataataattttccctttcatgcatcgaactcagaggacatgatgccactatctcctccacaatgttctagccacatgtcctcctcctccctcaccactagtgacaacaacggtagcattaacaataaccatgacatgtccttaaatgttaatgatgatatcgacacgccggagaataatcttgcattggacgaggatttctggtcggaagtgttgtcgtctgataattccggtgagacaacaagcggatttccgaccattgactatgatcatcagtttctaccgatgtctcctctaatgaccgaagaaggggtccttatagatgctagttcgtcgagtgtgtgcgacgacggcatggacttttggtgcaatgtttatgccagagctgaggaatttacgcagttattggaattg

SEQ ID NO: 404 - protein, 294 aa, Glycine max
  Glyma03g31980.1
MGRAPCCEKMGLKRGPWTPEEDQILINYINTYDHANWRALPKLAGLLRCGKSCRLRWINYLRPDIKRGNFTREEEDTIISLHEMLGNRWSAIAARLPGRTDNEIKNVWHTHLKKRLPQNYKQSHDQKKRSKKQPKLDVDASKSNQDAKLEQQQEPVNNNFPFHASNSEDMMPLSPPQCSSHMSSSSLTTSDNNGSINNNHDMSLNVNDDIDTPENNLALDEDFWSEVLSSDNSGETTSGFPTIDYDHQFLPMSPLMTEEGVLIDASSSSVCDDGMDFWCNVYARAEEFTQLLEL

SEQ ID NO: 405 - DNA, 816 bp, Glycine max
  Glyma19g34740.1
atggggagagctccatgctgtgagaaaatggggttgaagagagggccatggactccagaagaagatcaaattctcatcaattacatcaacacttatggccatgctaattggcgtgcactgcccaaactagctgggctattaaggtgtggaaagagttgtagactccggtggataaattatctgagaccggacatcaaacggggcaactttaccagagaagaagaggacactataatcagtttgcatgaaatgttgggaaacagatggtcggctattgcggcaaggttgtcagggagaacagacaacgagataaaaaacgtgtggcacacccacttgaagaagaggctgccacaaaattaccaacaaagccatcacactaaaaaacgaagcaaaaaacaaccaccaaagttggatgcggacgcctccaaatccaaccaagacgccaaactagaacaacaagaccccgttaatattcatggatcgaactctgaggacatgatgatgccactatctcctcctcattgttctagcgacatgtcctcctccctcaccaccagtgacaacaatagtaacgttaatattattaataataatcatgatatgtccttaaatgttaatgattatgatattgacaccccagagaataatcttgcattggacgaggatttctggtcggaagttttgtcatctgataattccggcgtgacaagcggatttccgacccttgactatgatcaaagaaggggtccttatagattgttcgtcgagtacgtgcgacgatggcatggatttttggtgcaatgtttactcgagagc

SEQ ID NO: 406 - protein, 272 aa, Glycine max
  Glyma19g34740.1
MGRAPCCEKMGLKRGPWTPEEDQILINYINTYGHANWRALPKLAGLLRCGKSCRLRWINYLRPDIKRGNFTREEEDTIISLHEMLGNRWSAIAARLSGRTDNEIKNVWHTHLKKRLPQNYQQSHHTKKRSKKQPPKLDADASKSNQDAKLEQQDPVNIHGSNSEDMMMPLSPPHCSSDMSSSLTTSDNNSNVNIINNNHDMSLNVNDYDIDTPENNLALDEDFWSEVLSSDNSGVTSGFPTLDYDQRRGPYRLFVEYVRRWHGFLVQCLLES

SEQ ID NO: 407 - DNA, 816 bp, Populus trichocarpa
  POPTR_0002s03960.1
atggtgagagctccatgctgtgagaagatgggattgaagagaggtccctggactgctgaagaggatcggattctcatcaatcacattcaactttatggccatggcaattggcgtgcacttcctaaacaagctggtctgctgaggtgtggaaagagctgcaggctccggtggataaattacttgaggcctgacattaaacgaggaaatttcagcagagaagaagaggataccatcatcaaattgcatgagatgttaggcaatagatggtcggcaattgcagcaagattaccaggacgcacagacaacgaaattaaaaatgtgtggcacacccacttgaaaaaaagacttgagcaaaaccatttcgccccagaaatcaatggaagatctgttgatgtttctagattcaatcacgaattaaagactggtccagaaatagtgagttcatcaaacgttgttgcagcaggatgtgatcaaagcaaggaacatagaccaatttcaccacaacaatgttcaagtgatgtctcttcggtgaccacagttgataccagtaatgacatgtgcacgaaggtagcggagtcggatgattttcttgaaatggatgagattttttggtcagaagtactgtctgctgataattcaagcatgatgagtgattattctgccattagcactgagccgcaacttcaatttccattttctccactgataattgatgtggaacaagtccaagccactaattcaaatatgtatgatggcatggacttttggcacaacctcttcacaagagctggggaattaccagaattaacagaaatt

SEQ ID NO: 408 - protein, 272 aa, Populus trichocarpa
  POPTR_0002s03960.1
MVRAPCCEKMGLKRGPWTAEEDRILINHIQLYGHGNWRALPKQAGLLRCGKSCRLRWINYLRPDIKRGNFSREEEDTIIKLHEMLGNRWSAIAARLPGRTDNEIKNVWHTHLKKRLEQNHFAPEINGRSVDVSRFNHELKTGPEIVSSSNVVAAGCDQSKEHRPISPQQCSSDVSSVTTVDTSNDMCTKVAESDDFLEMDEIFWSEVLSADNSSMMSDYSAISTEPQLQFPFSPLIIDVEQVQATNSNMYDGMDFWHNLFTRAGELPELTEI

SEQ ID NO: 409 - DNA, 819 bp, Populus trichocarpa
  POPTR_0005s24550.1
atggtgagagctccatgctgtgagaaaatggggttgaagaaaggtccatggactgctgaggaagatcagattctcatcaattacattcaacttcacggccatggcaattggcgtgcactgcctaaacaagctggtttactgaggtgtggaaagagctgcaggctccgatggataaattacttgaggcccgacatcaaacgaggaaatttcagcagagaagaagaggataccatcatcaaattgcatgagatgttaggaaacagatggtctgcaattgcagcaagattaccgggacgcacggacaacgaaattaaaaatgtttggcacacccacttgaaaaaaagacttgagaaaaatcatgtcaccccagaaatcaagggaagatccgttgatatttctagatttgatcacgaattaaatacagatcaagaattactcgattcatcaaatcttgcagcaggatctgatcagaccgaggaacacagaccaatctccccgcaacaatgttcaagtgacacctcctctttgatcacaggtgatattgatatcagtaataacatgtgcatgaagatcgagtcgtcggatgattttcctgaaatggatgagagtttttggtcagaagtattgtctgctgataattcaagaattgtgagtgatttttcggccattggcactgagccacaacttcaatttccattttctccactagtaattgaggtggaacaagtctatgccactaattcaaatatgtatgatagcactgaatattggcacgaccttttcacaagagctgggggatcactagatttaccagaaatt

SEQ ID NO: 410 - protein, 273 aa, Populus trichocarpa
  POPTR_0005s24550.1
MVRAPCCEKMGLKKGPWTAEEDQILINYIQLHGHGNWRALPKQAGLLRCGKSCRLRWINYLRPDIKRGNFSREEEDTIIKLHEMLGNRWSAIAARLPGRTDNEIKNVWHTHLKKRLEKNHVTPEIKGRSVDISRFDHELNTDQELLDSSNLAAGSDQTEEHRPISPQQCSSDTSSLITGDIDISNNMCMKIESSDDFPEMDESFWSEVLSADNSRIVSDFSAIGTEPQLQFPFSPLVIEVEQVYATNSNMYDSTEYWHDLFTRAGGSLDLPEI

SEQ ID NO: 411 - DNA, 699 bp, Vitis vinifera
  GSVIVT01028328001
atggggagagctccatgttgtgagaagatggggttgaagaaaggtccatggactcccgaagaagatcagattttggtcaattacatccacctttatggccatggaaactggagggcacttcccaaacaagctggcttattgaggtgtggaaagagttgcagacttcgatggacgaattatctgaggccggatatcaaacggggaaacttcaccagtgaagaagaagaaaccatcatcgagttacatgaaaggctgggcaatagatggtcagcgatagcagcgaaactaccggggaggacagacaatgagataaaaaatgtgtggcacacccacttgaagaagaggctcaagcacaaccacgccacgccaccccctaaaagacactctcttgatgcgtcccacgtcgaaaaacaacaaaaccccattagttctgcaaccaattcgagatcggagagccttgggtatggaccagtactgtccccacagcagtcctttagcgatatctcctcagccgccaccaccacgaccaccgccaccatgtccgacattactacaccctgcattaaggtcgattcactggaggagttcccagaaatggacgagaatttctggtcggaagtactcacgtatgacatggacatggaattttggtacaatattttcacaaggtccggggagttgcatgaattatcagaaata

SEQ ID NO: 412 - protein, 233 aa, Vitis vinifera
  GSVIVT01028328001
MGRAPCCEKMGLKKGPWTPEEDQILVNYIHLYGHGNWRALPKQAGLLRCGKSCRLRWTNYLRPDIKRGNFTSEEEETIIELHERLGNRWSAIAAKLPGRTDNEIKNVWHTHLKKRLKHNHATPPPKRHSLDASHVEKQQNPISSATNSRSESLGYGPVLSPQQSFSDISSAATTTTTATMSDITTPCIKVDSLEEFPEMDENFWSEVLTYDMDMEFWYNIFTRSGELHELSEI

SEQ ID NO: 413 - DNA, 807 bp, Citrus clementina
  clementine0.9_018638m
atggggagggctccctgctgtgagaagatggggttgaagaaggggccatggactcctgaagaagatagaattttaatcgtccacataaacaaacacggccatcccaattggcgtgcgttaccaaagcaagccggtttgttgagatgtggaaagagttgcagactccgatggataaattacttgaggcctgatattaagaggggaaacttcagcaaagaagaagaggaaactatcatcaacttgcatgacatgttggggaataggtggtcagctatcgcaggaaggttaccaggaaggacagataatgagattaaaaacgtgtggcacacgcacttgaagaagaaagcagcagcagtactgaagcaaaaccagaaggccaatactaataataataatagtaattcggatgatcacaaacaaaactctaaagcaacaacagctcatgatcatcagtctgcagaatctgcaatgtctccccaggcatcatcttccagtgatgagctctcctcggtcactactggagaaacaaataataataataataataataatagtgatcagtactgcatggataagcatgtgaaaagtgatcatgagcaaaatgttgactcgtttgaaagttttcctgtgattgatgaaagcttctggacagacaccagcttatctgaaaattcaagcaatttgacatcagatttcggaggcggccttaatgaatttgcgatcggtcatcatgattacggtggcggcatggacttctggtacaacattctggtcacgtccggggcagactcattaacattaccattt

SEQ ID NO: 414 - protein, 269 aa, Citrus clementina
  clementine0.9_018638m
MGRAPCCEKMGLKKGPWTPEEDRILIVHINKHGHPNWRALPKQAGLLRCGKSCRLRWINYLRPDIKRGNFSKEEEETIINLHDMLGNRWSAIAGRLPGRTDNEIKNVWHTHLKKKAAAVLKQNQKANTNNNNSNSDDHKQNSKATTAHDHQSAESAMSPQASSSSDELSSVTTGETNNNNNNNNSDQYCMDKHVKSDHEQNVDSFESFPVIDESFWTDTSLSENSSNLTSDFGGGLNEFAIGHHDYGGGMDFWYNILVTSGADSLTLPF

SEQ ID NO: 415 - DNA, 798 bp, Eucalyptus grandis
  Eucgr.H00158.1
atgggattaaagaggggtccatggacgcctgacgaagatcaagtcttgatctcttacatccagaggaatggtcatggaaattggagggctcttcccaagcaagctggactcttgagatgtgggaagagttgccggcttcggtggataaattatctgcggcctgatataaagcgaggaaatttcaatagcgaagaagaggaaacaatcattaagttgcatgaaatgcttggaaataggtggtcagctattgcagcaagattaccggggcgcacagacaacgaaataaaaaatgtgtggcacacacatttgaagaagaggctcaaacaaaatcaagtcacgccagcgacgacaacgaccaacaacaaatcattcaatttggattcttccgagccaacgataccgagattgttagaaagttcagtccatgctccaatgtcgcctcaaccttcctcgagcgaaatatcctcggtcacggatgcttcaacgtccacaggaattggagaggcgaacaacatcgagatcaagggcgaggacatggaatactccatggagtccttccctttaatcgacgagagtttttggtcggacaacccagggtttttacctgatgaatactcgagcgactcgtctggattgtcctgcttcaacgtagatacgcaaactcagtactcggtggctccgatggctgataatgtgcaagggtggcctagtgatggtgtaagccacgtcgacaatggaatggacttctggtacgatcttttcataagagctgggggtgcagaagaattgccagccttc

SEQ ID NO: 416 - protein, 266 aa, Eucalyptus grandis
  Eucgr.H00158.1
MGLKRGPWTPDEDQVLISYIQRNGHGNWRALPKQAGLLRCGKSCRLRWINYLRPDIKRGNFNSEEEETIIKLHEMLGNRWSAIAARLPGRTDNEIKNVWHTHLKKRLKQNQVTPATTTTNNKSFNLDSSEPTIPRLLESSVHAPMSPQPSSSEISSVTDASTSTGIGEANNIEIKGEDMEYSMESFPLIDESFWSDNPGFLPDEYSSDSSGLSCFNVDTQTQYSVAPMADNVQGWPSDGVSHVDNGMDFWYDLFIRAGGAEELPAF

SEQ ID NO: 417 - DNA, 861 bp, Populus trichocarpa
  POPTR_0008s16660.1
atggtgagggctccttgctgtgagaaaatgggattgaaaagggggccatggacacctgaagaagatcagatcttgatctcctacgttcagaaatatggccatagcaattggcgtgcgctgcctaagcaagctggtttacaaagatgtggcaagagttgcagactccgatgggtaaactacttgcggccagatataaagagaggcaacttcagcaaggaagaagaggaagctatcatcaagttgcatgaaattcttggaaataggtggtcagcaattgcatcaagattaccaggaaggacagacaatgagattaagaatgtatggcacacccacttgctaaaaagactcaaacaaaatggcgaacccaagtcacaacaacacatcagaataccagattgtcatctcaatgacaataaactatcacaatcggcaaattcgactattccttctctttcagggtgtaagagcatagagtacgcgcagatctcccctcaaccctcttctagtgatcactcctcagtcacggatacttcagtcaccacttcagaaacaaacaacaccggcttgatcaaggttgaaaacatagactcatcagagatttatccagtgattgatgaagatttctggtcagaaccagaaatggttgagaattctggcatgccatcatcaaattttctagacgactcacaatttccattcccctcaccagacactatggaacgggcaggatgttatggttacggtccaaaggttgacgataacatggaattttggtacaacctttttattaaatctgggggaatagaagaactaccagttcaatacttgcagaggtatagctatctggcggatgaaagaatc

SEQ ID NO: 418 - protein, 287 aa, Populus trichocarpa
  POPTR_0008s16660.1
MVRAPCCEKMGLKRGPWTPEEDQILISYVQKYGHSNWRALPKQAGLQRCGKSCRLRWVNYLRPDIKRGNFSKEEEEAIIKLHEILGNRWSAIASRLPGRTDNEIKNVWHTHLLKRLKQNGEPKSQQHIRIPDCHLNDNKLSQSANSTIPSLSGCKSIEYAQISPQPSSSDHSSVTDTSVTTSETNNTGLIKVENIDSSEIYPVIDEDFWSEPEMVENSGMPSSNFLDDSQFPFPSPDTMERAGCYGYGPKVDDNMEFWYNLFIKSGGIEELPVQYLQRYSYLADERI

SEQ ID NO: 419 - DNA, 759 bp, Vitis vinifera
  GSVIVT01027811001
atggtaagagctccttgttgtgataaggtgggattgaagaaggggccatggacgactcaggaagatcaaattttgacggcctacgttctacaacatggccatggaaactggcgagcccttccaaaacaagccggattactaagatgtgggaagagttgcagactccgatggataaactacttacgacctgatatcaagagaggaaatttcagcagagaagaagaggataccatcattgagttacatgaaaagcttggcaataaatggtcggccatagcagccagcctcccgggtcggaccgacaacgagataaaaaatgtctggcacacacacctgaaaaagaggctcaaaaaaaaattggccactccggattccaaaggccactttactgcagcagcttccacatgtgactcggattcttttaattcctccggaaaaatgtcccctcaaccgtcctccagtgaattctcttcatttacagactcctcaacaaggaccatggaaacacacagcactggcgtcaagaatgaacagatggaggagtactcaacggaatcatttcctgaaatcgatgaaagtttttggtcagacgcgctgtcctctgataattcaagcatggcgtcagatttcccagcagtcgcagacgaattacagcttcagacaccggaactcgcctatggacaaatttcaaacatgatggatgatggcatggagttctggtatgacgttttcattagatctggcggcttacaggagctt

SEQ ID NO: 420 - protein, 253 aa, Vitis vinifera
  GSVIVT01027811001
MVRAPCCDKVGLKKGPWTTQEDQILTAYVLQHGHGNWRALPKQAGLLRCGKSCRLRWINYLRPDIKRGNFSREEEDTIIELHEKLGNKWSAIAASLPGRTDNEIKNVWHTHLKKRLKKKLATPDSKGHFTAAASTCDSDSFNSSGKMSPQPSSSEFSSFTDSSTRTMETHSTGVKNEQMEEYSTESFPEIDESFWSDALSSDNSSMASDFPAVADELQLQTPELAYGQISNMMDDGMEFWYDVFIRSGGLQEL

SEQ ID NO: 421 - DNA, 753 bp, Solanum lycopersicum
  Solyc03g005570.2.1
atggacagagcaccttcttgtgagaaaacgagcttgaagaaagggtcatgggatcacgaagaagaccaaattctcatctcttacattaacaaaaatggccatggcaattggcgcgcactccctagacaagctggattattgagatgtggaaaaagttgcagattgaggtggatgaattatttgagtccacatattaagaggggaaatttcaccaaagaagaagaagataatatcatcaatttacatgaaattcttggaaatagatggtcagcaatagcagcaagattaccgggaagaacggataatgaaataaaaaatatttggcacacccacttgaagaaaaggctaaaaaattgtcagtctcctcgaagcttcaaaagacacaaaaaaattaatcaaataaataattgcatgcatgctcctaactcaccagaaatatcgtctagcgagacgtcaatcatgacaaccaattcatcatcaagtggtactttcgatacgacgatcgacgatcaaatagtgattaaacaagaagaaatggactcatcggagtatttcgccaagatcgatgagagcttctggacggatgaattaacgatagagaacaatttcgactttgttactaatatggatggtgaagaatttgaaagcttagacatgtttaatagtacaacaataatggaggatgacattgacatggactttttgttcaactttttcataaagactgaggaattttcagaattaccagaactt

SEQ ID NO: 422 - protein, 251 aa, Solanum lycopersicum
  Solyc03g005570.2.1
MDRAPSCEKTSLKKGSWDHEEDQILISYINKNGHGNWRALPRQAGLLRCGKSCRLRWMNYLSPHIKRGNFTKEEEDNIINLHEILGNRWSAIAARLPGRTDNEIKNIWHTHLKKRLKNCQSPRSFKRHKKINQINNCMHAPNSPEISSSETSIMTTNSSSSGTFDTTIDDQIVIKQEEMDSSEYFAKIDESFWTDELTIENNFDFVTNMDGEEFESLDMFNSTTIMEDDIDMDFLFNFFIKTEEFSELPEL

SEQ ID NO: 423 - DNA, 795 bp, Solanum lycopersicum
  Solyc06g053610.2.1
atgggtagagctccttgttgtgagaaaatgggattgaagaaaggtccatggactcctcaagaagacaatattctcatatcttacattcaaaataatggacattccaattggcgtgcccttcctaaacttgctggactattgagatgcggaaagagttgcagattgcgatggactaattatttgcgtccagatataaagagaggaaatttcaccaaagaagaagaagacactataatcaagcttcatgaaaatcttggcaatagatggtccgcaatagcagcaagattaccaggacgaacagataatgaaataaaaaacatttggcacaccaacttgaagaaaaaactcaagaattatcagccttgtcaaaattccaaaagacactccaagactagtcatgtttccaacaagggtcctacaacttctgaatcctccaataactctgatcttagtacaagtactaaacaacacattaagattgcacctaactcaccacaactttcatctagtgaaatgtcaagtgtgacgttagttgttgatgataatcagatggtgattataaaggaagaaaaaatcgagtcatcatcgtcggagtattttccaaagatcgatgagagtttctgggcagatgaattatcgacggagaataatatgattattggtcatgatcaagaaatacaagtgagggaagaaaatgtagacatatttactactagttcaaaaatggaggaggacatggacttttggtacaatgttttcataaagacaggggatttgccagaattaccagaattt

SEQ ID NO: 424 - protein, 265 aa, Solanum lycopersicum
  Solyc06g053610.2.1
MGRAPCCEKMGLKKGPWTPQEDNILISYIQNNGHSNWRALPKLAGLLRCGKSCRLRWTNYLRPDIKRGNFTKEEEDTIIKLHENLGNRWSAIAARLPGRTDNEIKNIWHTNLKKKLKNYQPCQNSKRHSKTSHVSNKGPTTSESSNNSDLSTSTKQHIKIAPNSPQLSSSEMSSVTLVVDDNQMVIIKEEKIESSSSEYFPKIDESFWADELSTENNMIIGHDQEIQVREENVDIFTTSSKMEEDMDFWYNVFIKTGDLPELPEF

SEQ ID NO: 425 - DNA, 804 bp, Solanum lycopersicum
  Solyc09g090130.2.1
atggttagagctccttgttgtgagaagatggggttaaagaaagggccatggactcccgaagaagatcaaattctcatctcttacattcaatcaaatggtcatggcaattggagagccctccctaaattagccggattattgcgatgtggaaaaagttgcagacttagatggacgaattatttacgtccagatattaaaagaggaaatttcacaagagaagaagaagatagtattattcaattacatgaaatgcttggcaatagatggtctgcgatagcagctagattaccgggacgaacagataatgaaataaaaaatgtatggcacactcacttgaaaaaaaggcttaaaaattatcagcctcctcaaagctccaaaagacactcaaaaaacaaggattccaaagctccttgtacttctcaaattgccttgaaaagttcaaacaattttagcaacatcaaagaagacgggcccgggcttgggtccggcccgaactcgccacaattgtcatctagcgagatgtcgactgtcacggccgattcactagccgtgacaatggacatctcgaacagtaacgaccaaatagactcatctgaaaattttattccagagatcgatgagagtttctggacggacggtttgtccacgagtggtggtggtgaagaattacaagttcaatttccatttcatgacatgaaacaagaaaatgtagagaaggatgttggagcaaaattagaggatgatatggacttttggtacagtgttttcataaagtctggggacttattagagttaccagaattt

SEQ ID NO: 426 - protein, 268 aa, Solanum lycopersicum
  Solyc09g090130.2.1
MVRAPCCEKMGLKKGPWTPEEDQILISYIQSNGHGNWRALPKLAGLLRCGKSCRLRWTNYLRPDIKRGNFTREEEDSIIQLHEMLGNRWSAIAARLPGRTDNEIKNVWHTHLKKRLKNYQPPQSSKRHSKNKDSKAPCTSQIALKSSNNFSNIKEDGPGLGSGPNSPQLSSSEMSTVTADSLAVTMDISNSNDQIDSSENFIPEIDESFWTDGLSTSGGGEELQVQFPFHDMKQENVEKDVGAKLEDDMDFWYSVFIKSGDLLELPEF

SEQ ID NO: 427 - DNA, 1035 bp, Arabidopsis thaliana
  AT2G26150.1
atggaagaactgaaagtggaaatggaggaagaaacggtgacgtttactggttctgtagcggcttcttcatctgtaggatcctcttcctctcctagaccaatggaagggcttaacgaaacagggccaccaccgtttctgactaagacttacgaaatggtggaagatccggcgacggacacggtggtttcttggagtaatggtcgtaacagctttgtggtgtgggattctcataagttctcaacaactctccttccacgttacttcaagcatagcaatttctcaagttttattcgtcagctcaatacttatggattcagaaagattgatccagatagatgggaatttgcaaatgaagggtttttagcaggacaaaagcatctcttgaagaacatcaaaagaaggaggaacatgggtttgcagaatgtgaatcagcaaggatctgggatgtcatgtgttgaggttgggcaatacggtttcgacggggaggttgagaggttgaagagggatcatggtgtgcttgtagctgaggtagttaggttgaggcaacagcaacacagctccaagagtcaagttgcagctatggagcaacggttgcttgttactgagaagagacagcagcagatgatgacgttccttgccaaggcgttgaacaatccgaactttgttcagcagtttgcggttatgagtaaagagaagaagagtttgtttggtttggatgtggggaggaaacggaggcttacttctactccaagcttggggactatggaggagaatttgttacatgatcaagagtttgatagaatgaaggatgatatggaaatgttgttcgctgcagcaatcgatgatgaggcgaataattcgatgcctactaaggaggaacaatgtttggaggctatgaatgtgatgatgagagatggtaatttggaagcagcgttggatgtgaaagtggaagatttggttggttcgcctttggattgggacagccaagatctacatgacatggttgatcaaatgggttttcttggttcggaacct

SEQ ID NO: 428 - protein, 345 aa, Arabidopsis thaliana
  AT2G26150.1
MEELKVEMEEETVTFTGSVAASSSVGSSSSPRPMEGLNETGPPPFLTKTYEMVEDPATDTVVSWSNGRNSFVVWDSHKFSTTLLPRYFKHSNFSSFIRQLNTYGFRKIDPDRWEFANEGFLAGQKHLLKNIKRRRNMGLQNVNQQGSGMSCVEVGQYGFDGEVERLKRDHGVLVAEVVRLRQQQHSSKSQVAAMEQRLLVTEKRQQQMMTFLAKALNNPNFVQQFAVMSKEKKSLFGLDVGRKRRLTSTPSLGTMEENLLHDQEFDRMKDDMEMLFAAAIDDEANNSMPTKEEQCLEAMNVMMRDGNLEAALDVKVEDLVGSPLDWDSQDLHDMVDQMGFLGSEP

SEQ ID NO: 429 - DNA, 1140 bp, Brachypodium distachyon
  Bradi2g41530.1
atggcttcctcctcccgttgcgcactcttcgtcggctccaagaggacgcgcacaagcggcggggcaggaggagccggcggagaggaagcaatggcctgggggtcggcggtggtgaagcgagaggtgaagccggaggagcaggaggaggaggaggcaagggaggcgcgggcggcgtggccgcgcccgatcgaggggctcggcgagccagggccggcgccgttcgtgggcaagacgtacgagatggtggcggacgcggccaccgatgcggtggtgtcatgggcgggccgcgggagcagcttcgtggtgtgggacccgctcgcgctcgcggccgccgtcctcccccgcttcttcaagcacgccaacttcgcctccttcgtcaggcagctcaacacctacggattccgaaaggtcaatcaggagaggtgggagtttgcgaatgaagacttcttagctggtcagaagcatttgctgaaaaacatcaggaggcggcgtgcttccaggcatcatatgaagtcacaactaagaaatggatcaagtgtttgttatcggcagcctgaatctctcagtgaagtggagaatttgaagagagaccatacagctctcagagcagaagccgtcaagcttaagcagcagtacagcatctgtaaatctcagctccttgccatggagcagagggtcctaagcaatgaaaggaagcaacagcagatcatcactttcttcgtcaagtcactcagtaacccagtctttttgcaacagatttggctcaactatggtaataagaaagaactaggaagcacagtcaaaagacagcggctgatggaaaatgaggaacagcacgttgtggatgcgctattgaagaagggcacagacgctgcatttgagaaggaggttagcatttctgcagggagcagtgactgcggcacagttgagaacgatgaacccatgcgcaagtggaatgatcagaacataggcgacatgtgcgatgatgtatgggaagagttggatgcgatacctggaattgaaatgaagcaagaaggcaaggccgatatcggcttcgacgtggaggagttcactggaaggccttgtagttgggttgatgactgcccatatctggtggagccactgcagtttgtcgaacac

SEQ ID NO: 430 - protein, 380 aa, Brachypodium distachyon
  Bradi2g41530.1
MASSSRCALFVGSKRTRTSGGAGGAGGEEAMAWGSAVVKREVKPEEQEEEEAREARAAWPRPIEGLGEPGPAPFVGKTYEMVADAATDAVVSWAGRGSSFVVWDPLALAAAVLPRFFKHANFASFVRQLNTYGFRKVNQERWEFANEDFLAGQKHLLKNIRRRRASRHHMKSQLRNGSSVCYRQPESLSEVENLKRDHTALRAEAVKLKQQYSICKSQLLAMEQRVLSNERKQQQIITFFVKSLSNPVFLQQIWLNYGNKKELGSTVKRQRLMENEEQHVVDALLKKGTDAAFEKEVSISAGSSDCGTVENDEPMRKWNDQNIGDMCDDVWEELDAIPGIEMKQEGKADIGFDVEEFTGRPCSWVDDCPYLVEPLQFVEH

SEQ ID NO: 431 - DNA, 1116 bp, Glycine max
  Glyma04g05500.1
atgaagggagttacagtgaaagttgaagaaacaatggcgtatgctaatgctgcttcaactagcccaacaacatcttcaaacctctccccgcaacccatggaagggttgcacgaggtgggtccccctccgtttctcaccaaaaccttcgacgtggtggaagacccatccaccaacgacatcgtttcgtggagcagatcccgcaacagtttcgtcgtttgggactctcacaagttctctaccaccatcctgcctcgctacttcaagcacaacaatttctccagcttcgtacgacaactcaacacctacggttttagaaaaattgatcctgacaagtgggagtttgcgaacgaagggtttttggcggggcagaggcaattgttgaagacgataaagaggaggaggcacgtgacagtgacacagacacagtcacacgagggaggaagtggggcttgtgttgaattgggggagtttgggttggaaggtgagatggagaggttgaggagagacaggacagtgttgatggctgaaattgtgaggttgagacaacaacagcacaactcgagggagcaattgttgtccatggagactaggttgcaagccactgagaagaaacatcaacagatgatgaattttctggctaaagcactcaacaaccaggcttttattcagcagtttcttcaaaggaatgctcagaacaaagagttgcaaggtgcgagaagaaagaggagactaactgctaccccaagtgtggagaatttgcagcaagatcatttcgctttgtcaattgaagaaggatcggctactattgagtcacagatggagtcttttttctcagctgcgtgtaatgatccgttagaatcaaacagtgaactcaaagacccaatattgagttcagttccagttgcaagtgggagtaatttgggggaggtgagtgattctgtttgggaggacttgctgaaccaagacttggttgctggggaccctgaagaggaagttgtgattggtgatttttcacaagttgatgttcctgtggaggatttgattgcggatgctgatgagtggagtgaggatttgcagaaccttgtggatcacatgggttatcttgggtccaaaccg

SEQ ID NO: 432 - protein, 372 aa, Glycine max
  Glyma04g05500.1
MKGVTVKVEETMAYANAASTSPTTSSNLSPQPMEGLHEVGPPPFLTKTFDVVEDPSTNDIVSWSRSRNSFVVWDSHKFSTTILPRYFKHNNFSSFVRQLNTYGFRKIDPDKWEFANEGFLAGQRQLLKTIKRRRHVTVTQTQSHEGGSGACVELGEFGLEGEMERLRRDRTVLMAEIVRLRQQQHNSREQLLSMETRLQATEKKHQQMMNFLAKALNNQAFIQQFLQRNAQNKELQGARRKRRLTATPSVENLQQDHFALSIEEGSATIESQMESFFSAACNDPLESNSELKDPILSSVPVASGSNLGEVSDSVWEDLLNQDLVAGDPEEEVVIGDFSQVDVPVEDLIADADEWSEDLQNLVDHMGYLGSKP

SEQ ID NO: 433 - DNA, 1116 bp, Glycine max; identical to SEQ ID NO: 431
  Glyma04g05500.2

SEQ ID NO: 434 - protein, 372 aa, Glycine max; identical to SEQ ID NO: 432
  Glyma04g05500.2

SEQ ID NO: 435 - DNA, 1086 bp, Glycine max
  Glyma14g11030.1
atggagagaattagagtgaaggaggaagaagcagtgacatgtggtggtggttcatcatcatcatcatcttcgtcttcaagcttttctccacagcctatggaagggttgcacgaggtgggtccccctccgtttctgagcaagatctttgacatggtagaagattcttccacggactccattgtgtcatggagcatggctcgcaacagctttgtggtgtgggattctcacaagttttctgctgacattctgcctcgttacttcaagcacggcaatttctccagcttcattcgccagctcaacgcctatgggtttaggaaagttgatcctgatagatgggaatttgcaaacgaaggttttttggcaggacaaaggcacttattgaagaccattaagagaagaagaaatgtgtcacagagtttgcaacaaaaaggaggaagtggagcttgtgttgaagtgggggagtttggactcgaaggtgagttggagaggttgaaaagagacaggaacattttgatggcagaaattgtgagattgaggcaccaacaactgaactcaagggaacaattgaattccatggagaccagattgcaagccactgagaagaaacagcagcaaatgatgagtttccttgcaaaagcactgagtaacccatctttcacgaaacaattagtccaaaagaccccccaaagcagagaagtgttgggtgttgaaatcaataggaaaaggagactgactgctagtccaagtgttgagaacttgcaacaagatgatcaagatttggcaactttggattatccaagccatgatcgagatttggcaactatggagactgatatggacacttttttctcaccggcttatgataatgaacttagcagtgaaaccaatgagcctgcatcaatttcggttgaggatacaatcttggaggactttctcaacaaagacttggttacttggaatccggaggatgaagttataattggggatagttcccaagtcgatgtgccggtggaggatttggttgcaaaccctgatgattggagtgagcaattgcaggaccttgtggatcatatggactatctaggc

SEQ ID NO: 436 - protein, 362 aa, Glycine max
  Glyma14g11030.1
MERIRVKEEEAVTCGGGSSSSSSSSSSFSPQPMEGLHEVGPPPFLSKIFDMVEDSSTDSIVSWSMARNSFVVWDSHKFSADILPRYFKHGNFSSFIRQLNAYGFRKVDPDRWEFANEGFLAGQRHLLKTIKRRRNVSQSLQQKGGSGACVEVGEFGLEGELERLKRDRNILMAEIVRLRHQQLNSREQLNSMETRLQATEKKQQQMMSFLAKALSNPSFTKQLVQKTPQSREVLGVEINRKRRLTASPSVENLQQDDQDLATLDYPSHDRDLATMETDMDTFFSPAYDNELSSETNEPASISVEDTILEDFLNKDLVTWNPEDEVIIGDSSQVDVPVEDLVANPDDWSEQLQDLVDHMDYLG

SEQ ID NO: 437 - DNA, 1003 bp, Glycine max
  Glyma17g34540.1
atggagagaatcagagtgaaggaggaagaagcaatgacatgtggaggtggtggttcatcatcttcaagctttatttctccacaggcacagcccatggaagggttgcacgaggtgggtccccctccgtttctgagcaagatctttgacatggtggaagatccttccacggattccattgtttcatggagcatggctcgcaacagctttgtcgtgtgggactctcacaagttttctgctcacattctgcctcgttacttcaagcacgccaatttctccagcttcattcgccagctcaacacctatgggtttaggaaagttgatcctgataaatgggaatttgcaaacgaaggttttctggcaggacaaaggcacttattgaagaccataaagagaagaagaaatgtgtcacacagcaatcaacaaaaaggaggaagtggagcttgtgttgaagtggggaagtttggactagaaggtgagttggagaggttgaaaagggatagaaacattttgatggcagaaattgtgagattgaggcaccaacaactgaactcaagggaccaattaagtgccatggaggcaagaatgcaagccacagagaagaaacagcaacaaatgatgagtttcttagcaaaagcactaagcaatccatctttcatgcagcaattagtccacaaaaccccccaaagcagagaagtgttgttgggtgttgaaatcaataggaaaaggagactacctgcttgtccaagtgtggagaacttgcaacaagataatcaagatttggcaactatggagactgatatggacacttttttcgcaccggcttatgataatgaattcggtaatgaaatcgatgagcctgcatcgattttggttgaggattcaatcttggaggactttctcaacaaagacttgattactgggaatccggaggatgaagttataattggtgattgcacccaagtcgatgtgccgatggaggatttggtagcaaaccctgatgatt

SEQ ID NO: 438 - protein, 336 aa, Glycine max
  misc_feature (336)..(336): Xaa can be any naturally occurring amino acid
  Glyma17g34540.1
MERIRVKEEEAMTCGGGGSSSSSFISPQAQPMEGLHEVGPPPFLSKIFDMVEDPSTDSIVSWSMARNSFVVWDSHKFSAHILPRYFKHANFSSFIRQLNTYGFRKVDPDKWEFANEGFLAGQRHLLKTIKRRRNVSHSNQQKGGSGACVEVGKFGLEGELERLKRDRNILMAEIVRLRHQQLNSRDQLSAMEARMQATEKKQQQMMSFLAKALSNPSFMQQLVHKTPQSREVLLGVEINRKRRLPACPSVENLQQDNQDLATMETDMDTFFAPAYDNEFGNEIDEPASILVEDSILEDFLNKDLITGNPEDEVIIGDCTQVDVPMEDLVANPDDWX

SEQ ID NO: 439 - DNA, 1152 bp, Citrus clementina
  clementine0.9_012795m
atggagggagtgagggtgaaggaagaagagacggtgacgtacgcagcgacgacagctactgctgcatcagcgtcgtcgtcttcgtcgtcttccaactttatgccgcagccgttggagggtttgcacgatgcaggcccgcctccgtttctgacgaaaacctacgaaatggtcgaggatctatcaacggatgcgatcgtttcctggagcagaactcgcaatagcttcattgtgtgggactctcaccagttctctactactttgcttccgaaatatttcaagcacagtaatttttctagcttcattcgccagctcaacacttatggttttagaaaggttgatcctgatagatgggaatttgccaatgaaggatttttgggagggcagaagcatctactgaaaacaatcaagagaaggcgacacgtctcacagagtatgcaacagcgaggaggagaagcttgtcttgaggtgggacaatatggactggatggtgagcttgaaagattaaagagggaccgaaatgtgttgatggcagaaattgttaggctgaggcaacatcagcagcaatcaagagatcaactcagtgcaatggaggataggttattaagcacagaaaagaagcagcagcagatgatgacattccttgcaaaagcactcaaaaacccatcgtttttccagcaattagctcagagtaatgcacacagaagagaactgggaggtgttcaaactgggagaaagcggagactaacggccacaccaagcatggagaacttacaagaaacaatttccgtggcacctgtgggtctggattgtggtccggttgtagattacacagtccaagatcaaaatgaattgacctccatggaaactgagatagagacgtttctttcttcgccggtggacaacgaatcaagcagtgatatcgacaacccaaatgctggttcagtacctgccccaagtggtggcaatttcagtagtgtcaatgagacaatatgggaggattttatggctgacgatctgattgccggcgatccggaagaagtggtggtgaaggatcagtcagaggctgaggtggaattggaggatttggttgcaacacctacagattggggtgaggaattgcaagacctagtagatcagatgggttatctcagg

SEQ ID NO: 440 - protein, 384 aa, Citrus clementina
  clementine0.9_012795m
MEGVRVKEEETVTYAATTATAASASSSSSSSNFMPQPLEGLHDAGPPPFLTKTYEMVEDLSTDAIVSWSRTRNSFIVWDSHQFSTTLLPKYFKHSNFSSFIRQLNTYGFRKVDPDRWEFANEGFLGGQKHLLKTIKRRRHVSQSMQQRGGEACLEVGQYGLDGELERLKRDRNVLMAEIVRLRQHQQQSRDQLSAMEDRLLSTEKKQQQMMTFLAKALKNPSFFQQLAQSNAHRRELGGVQTGRKRRLTATPSMENLQETISVAPVGLDCGPVVDYTVQDQNELTSMETEIETFLSSPVDNESSSDIDNPNAGSVPAPSGGNFSSVNETIWEDFMADDLIAGDPEEVVVKDQSEAEVELEDLVATPTDWGEELQDLVDQMGYLR

SEQ ID NO: 441 - DNA, 1152 bp, Citrus clementina; identical to SEQ ID NO: 439
  clementine0.9_012796m

SEQ ID NO: 442 - protein, 384 aa, Citrus clementina; identical to SEQ ID NO: 440
  clementine0.9_012796m

SEQ ID NO: 443 - DNA, 1167 bp, Eucalyptus grandis
  Eucgr.C00664.1
atggagatgaagggaggggtcgtcccgaaagaggaggaggcgtcgtcggacgtggggcagccgccgccgccgccgccgccgccgccgcagcccatggaggggctgggcgaggcggggccgccgccgttcctgacgaagacgttcgagatcgtggaggacccggcgacggacccgatcgtgtcgtggagcgaggggaggaacagcttcatcgtctgggacgcccaccagttcgccgccaccctgctccccaagcacttcaagcacggcaacttctccagcttcatccggcagctcaacacctacggtttcaggaaggtggatccggatcggtgggagtttgccaacgaagggttcttaggagggcagagacacctcctgaagaccatcaagaggaggcggaacgtcttgcatagcccacgccagccaggaggagcatgcgtcgaactgggtcattatgggctcgacagcgagctggagaggttgaggagagacaggggcttgctggtggccgaggttgcaagattgaggcagcagcaggagcagtcgagggaccatatctttgcgatggagcaacggatacagcgtactgagaggaagcaacagcagatgttggctttcctcgctaaagcgtgcaataacccgtccttcattcggcaactcatgcagagaaatgctcgtggaagggatatcagaggagttgaaattggacacaagcgccggctgactgctacaccaagcctggagaatctgcaagatgaggacacggtggctgctctaggccgtggtggagcaggagatagtgcgatccccatgcaagaggaaatggtcaccttggagtcagaaatgcagacaatgttttcggctgccttggatgacgaatcaagcagcgacgtgaacgaactgagtgcagctccagttcttgctacaagaggtggcaacacggatgctgtcaatcagacgatcctggaagaattgctgagtgaagatctgatgactgggaatccggaggaagaaatattggttggcgaccggcctgaaatcgacatggaggccgaggatctcgtgcccgggcgaaggaatgccagcgaggaatcacaagacttatctcaacttgaagccgtgactccgtccagctcattacggcaggataaattcatggaagagtgg

SEQ ID NO: 444 - protein, 389 aa, Eucalyptus grandis
  Eucgr.C00664.1
MEMKGGVVPKEEEASSDVGQPPPPPPPPPQPMEGLGEAGPPPFLTKTFEIVEDPATDPIVSWSEGRNSFIVWDAHQFAATLLPKHFKHGNFSSFIRQLNTYGFRKVDPDRWEFANEGFLGGQRHLLKTIKRRRNVLHSPRQPGGACVELGHYGLDSELERLRRDRGLLVAEVARLRQQQEQSRDHIFAMEQRIQRTERKQQQMLAFLAKACNNPSFIRQLMQRNARGRDIRGVEIGHKRRLTATPSLENLQDEDTVAALGRGGAGDSAIPMQEEMVTLESEMQTMFSAALDDESSSDVNELSAAPVLATRGGNTDAVNQTILEELLSEDLMTGNPEEEILVGDRPEIDMEAEDLVPGRRNASEESQDLSQLEAVTPSSSLRQDKFMEEW

SEQ ID NO: 445 - DNA, 1098 bp, Eucalyptus grandis
  Eucgr.C03056.1
atggagagggtgatcgtgatcaaagaagaagaccgagaccaagaacgtgaagatgtgatcgtgtgttcgactgggtcgtcgtcgtcgtcgggctcggccgctgctgctgctccgaggccgatggaggggctccacgaggtaggcccgccgccgttcctgatgaagacgttcgagatggtggaggacccgtcgacggacgcggtggtgtcgtggagcggggcgaagaacagcttcatcgtgtgggactcccaccggttcgcctccaccctgctccctaagtacttcaagcacggcaacttctccagcttcatccggcagctcaacacttacggatttaggaaggtggatccagacagatgggaattcgcgaatgaaggtttcttgggagggcagaagcatctgctcaagaccatcaagaggaggaggaacgtcccgcagaatcagcagcagcatggagccacggcctgcgtcgaactgggacagttcggattggaaggcgagctcgagaggttgacacgagaccgcaacttgttgatgtctgaaattgcgaagctgaagcagcagcaacagcactcgatggagctgattgcagcaatggaagataggttgcagagaacagagaataagcagcagcagatgctgactttcctcgccaaagcgctcagtaacccatctttcgttcagaacttggcacaaagaaaggaattgcaaagtcttggcatcggaaagaagcggagattgactgctagcccgagcttggagaatttgcaagcagaccaagatctagaagagctggggccgattgaatccgatatggagacacttctctatggtgccttggagaatgaatcaagcatcgacattgaagacccacttggaagttcgatgccagggaccaacggtgatgagctggattctgtgaacgagacgatctgggaggaactattgaatgaggacgcaattccggaggaagagtggccactcggcgacgaatcggatttcgaggtggatgtggaggatttggtcgagaaccctccggattggggagaggacttgaatgagctggcggaccaaataggttatctcagatcgaagcca

SEQ ID NO: 446 - protein, 366 aa, Eucalyptus grandis
  Eucgr.C03056.1
MERVIVIKEEDRDQEREDVIVCSTGSSSSSGSAAAAAPRPMEGLHEVGPPPFLMKTFEMVEDPSTDAVVSWSGAKNSFIVWDSHRFASTLLPKYFKHGNFSSFIRQLNTYGFRKVDPDRWEFANEGFLGGQKHLLKTIKRRRNVPQNQQQHGATACVELGQFGLEGELERLTRDRNLLMSEIAKLKQQQQHSMELIAAMEDRLQRTENKQQQMLTFLAKALSNPSFVQNLAQRKELQSLGIGKKRRLTASPSLENLQADQDLEELGPIESDMETLLYGALENESSIDIEDPLGSSMPGTNGDELDSVNETIWEELLNEDAIPEEEWPLGDESDFEVDVEDLVENPPDWGEDLNELADQIGYLRSKP

SEQ ID NO: 447 - DNA, 1098 bp, Eucalyptus grandis; identical to SEQ ID NO: 445
  Eucgr.C03056.2

SEQ ID NO: 448 - protein, 366 aa, Eucalyptus grandis; identical to SEQ ID NO: 446
  Eucgr.C03056.2

SEQ ID NO: 449 - DNA, 1164 bp, Populus trichocarpa
  POPTR_0006s24330.1
atggagggagttgtagtgaaagaagaggagacagtgacatgtactggaggtggagcttcttcatcttcatcatcctctagtttctctccgcatccaatggaggggttaaatgaagtgggcccacctccgttcttgacgaagacatatgaaatggtggaagacccttcaacggatacagtggtttcgtggagtggaggtcgcaatagcttcatagtttgggactctcataagttctctactactttgcttccgaaacacttcaaacacagtaacttctccagcttcattcgacagctcaacacttatggtttcaggaaggttgatcctgaccggtgggaatttgccaatgaagggtttttgggagggcagaagcatctattgaagaccatcaaacggaaaagacatctctcacagaccacacaacaacaaggtggaggagcttgcattgagttaggacaatttgaatttgaaggagagcttgaaaggttaaaaagagaccgaaacgtgttaatggcagagattgtaaggcttaggcagcaacaacagcagtcgagggaacacattgctgcgatggaggataggttacgaagcacagagagaaaacagcagcgggtgatgacattccttgctaaagctctcaacaacccatcctttatcgagcaatttgcacaaagggctgcacagaggagagaaataagaggtgttgaaattgggcgtaagaggagactcactgcaagcccaagtgttgaaaatttgcaagaagttgcatctgtggcattaggtagcagccaatttgttgattacatgaatcaggatttaccaactattgagaacgagatggagacgcttttctctgctgtcttggacaatgaatcaagcagtgatatcaaggacccaatagcaagttctatggacacagcaagtggtggtagcactttggatgctgttaatgagacaatttgggaggagttacttactgatgatttagtttccggggaacctaatgaagttgttgtgagtgatgaaccagaagttgatgtggaagttgaggatttggttgcgaaacctgtggactggagtgatgattttcaggaccttgtggatcaaatgggttatctcaggccggaacgccaacaaagaatttttcggaggggtgtctggatt

SEQ ID NO: 450 - protein, 388 aa, Populus trichocarpa
  POPTR_0006s24330.1
MEGVVVKEEETVTCTGGGASSSSSSSSFSPHPMEGLNEVGPPPFLTKTYEMVEDPSTDTVVSWSGGRNSFIVWDSHKFSTTLLPKHFKHSNFSSFIRQLNTYGFRKVDPDRWEFANEGFLGGQKHLLKTIKRKRHLSQTTQQQGGGACIELGQFEFEGELERLKRDRNVLMAEIVRLRQQQQQSREHIAAMEDRLRSTERKQQRVMTFLAKALNNPSFIEQFAQRAAQRREIRGVEIGRKRRLTASPSVENLQEVASVALGSSQFVDYMNQDLPTIENEMETLFSAVLDNESSSDIKDPIASSMDTASGGSTLDAVNETIWEELLTDDLVSGEPNEVVVSDEPEVDVEVEDLVAKPVDWSDDFQDLVDQMGYLRPERQQRIFRRGVWI

SEQ ID NO: 451 - DNA, 897 bp, Vitis vinifera
  GSVIVT01035385001
atgggctcatcatcatcatcatcttcttcaccaggctttgctcctcacccattggaggctcgcaacagcttcattgtttgggattcgcacaagttctctactactcttcttcccaggtacttcaagcacagtaacttctccagcttcattcgccagctcaacacatatggttttagaaaagtcgatccagatcgatgggagtttgcaaatgaagggtttttgggagggcagaagcatctgctgaagaacatcaagagaagaagacatgtctcacagaatacacagcaaggaggactaggagcttgtgtggaattagggcaatacggattggaggatgaacttgaaagattgaagagagacagaaacgtattaatggcagagatcgggaagctgcggcagcaacaacagaattccaggaatgaactagttgccatggagggtcgaatgcagaacacagagaagaagcagatgcagatgatgacctttctcgccaaagcattaaacaacccttcctttgtccagcaatttatccagcagagaagggaacttcgaggggctgaaatcgggcgaaaacgacgattaaccaccagtcaaagtgctgagaatttgcaggaagtgataacggacccgaaagcggattccattgataacaacttgggttctgtcaatgatgtaatctgggaggaactattgagtgatgatctgattgctggcaatgaggaagaagtacccccactccgactgggtgatcatcatgaaccagaaactgatgtggaggtggaggatttggttgcaacgccttcagactggggtgaggacttccaagaccttgtggaccaaatggcttttctcaggccaaacctcagatccagactcgaaagaagggttctcaatctt

SEQ ID NO: 452 - protein, 299 aa, Vitis vinifera
  GSVIVT01035385001
MGSSSSSSSSPGFAPHPLEARNSFIVWDSHKFSTTLLPRYFKHSNFSSFIRQLNTYGFRKVDPDRWEFANEGFLGGQKHLLKNIKRRRHVSQNTQQGGLGACVELGQYGLEDELERLKRDRNVLMAEIGKLRQQQQNSRNELVAMEGRMQNTEKKQMQMMTFLAKALNNPSFVQQFIQQRRELRGAEIGRKRRLTTSQSAENLQEVITDPKADSIDNNLGSVNDVIWEELLSDDLIAGNEEEVPPLRLGDHHEPETDVEVEDLVATPSDWGEDFQDLVDQMAFLRPNLRSRLERRVLNL

SEQ ID NO: 453 - DNA, 1053 bp, Solanum lycopersicum
  Solyc08g062960.2.1
atggaggatgtagtgaaagtgaaggtcgaagaagatggcattccgacggccgtgctgcctatggaagggctgcacgacgttggtccgccgccatttctgagcaaaacttatgagatggtggaagattcctcaactgatcaagtcatatcatggagcacaacaaggaatagctttattgtttgggactctcataagttttccaccacattgttgcctaggtttttcaagcacagcaatttttccagtttcattcggcagcttaacacatatggatttagaaaggtggatcctgacagatgggaatttgcgaatggaggttttctgggagggcaaaagcatcttttgaagacgataaagaggaggaggaatgttggtcagagtatgaatcaacaaggatctggtgcttgcattgaaattggttattatgggatggaggaggagctagaaagattaaagcgggataaaaacgtgttgatgactgaaatagttaaacttaggcagcaacagcagagtacgaggaatcatatcattgccatgggagaaaaaatcgaaacacaggagaggaaacaagtgcagatgatgagtttcttagcaaagattttcagcaatccaacttttctccagcagtacttggacaaacatgtgcacagaaaagataaacaacgtatcgaagttggacaaaagaggagactaacgatgacccccagtgctacaggaagtgatcagcctatgaattactcctcatcacaccaagagagtgaagctgagcttgcaagtattgaaatgttattctctgctgcaatggacaatgaatcaagcagcaatgtcaggccggattctgttgtgacagcaaatggaactgatatggaaccagtggctgatgatatttgggaagagttgctcagtgaagatcttatatccggggatcgagcagcagaggaagtagtggttgttgaacaacctgaattcgacgtggaagttgaagatcttgttgtgaaaacacctgaatggggtgaggaattacaagaccttgtggatcagcttggtttcctt

SEQ ID NO: 454 - protein, 351 aa, Solanum lycopersicum
  Solyc08g062960.2.1
MEDVVKVKVEEDGIPTAVLPMEGLHDVGPPPFLSKTYEMVEDSSTDQVISWSTTRNSFIVWDSHKFSTTLLPRFFKHSNFSSFIRQLNTYGFRKVDPDRWEFANGGFLGGQKHLLKTIKRRRNVGQSMNQQGSGACIEIGYYGMEEELERLKRDKNVLMTEIVKLRQQQQSTRNHIIAMGEKIETQERKQVQMMSFLAKIFSNPTFLQQYLDKHVHRKDKQRIEVGQKRRLTMTPSATGSDQPMNYSSSHQESEAELASIEMLFSAAMDNESSSNVRPDSVVTANGTDMEPVADDIWEELLSEDLISGDRAAEEVVVVEQPEFDVEVEDLVVKTPEWGEELQDLVDQLGFL

SEQ ID NO: 455 - DNA, 1068 bp, Solanum lycopersicum
  Solyc07g040680.2.1
atggaagaggagaaaactatgttgattgatgtgaatgagaaagagatgaatgttaatggtggagtagtagtagaggtgaaagaagaaccagttatatttattaatgatgaagatgacattattggggattcagtaccaaagcctttggatgggttgcgtgatgtaggtccacctccgtttttgaagaagacgtttgaaatggtggatgatccaaataccgactctataatctcatggagtaacagtcaaaacagctttgttgtttgggatcctcacaaattttcaattcatcttctacctaaacattttaagcacaacaacttctctagctttatccgccagctcaatacctatcgtttcaggaaaattgattcagatagatgggaatttgcaaatgagggttttcagaaagggaaaaagcatttgctgataaatatcaagagaagaaagcagtatcctcaactaggaggaggaggtggtggaggagcaaaatcttgggtaggaggttgttgcaaggatggaactgaagcagcagagatagaaaagctgaaaaaggatcacaacactttgaagatggaaattctgaagcttaaacagcaacaagagagcactgataactatttagctactatgaaggagaggttacagaatagtgagattaaacaaaagtatatggtgatcttcctggcgaaaacgttccacaaccctatgtttgttcaacatctgattgaaaaggtgaaacaggggaagacaacaacggttgagaatgggaccaagaagagaaggttgtgtagtgatgaaaatcaagaggagtacacaacaattaagtcggagatacaaacactcttctcttgtgatgaatcgtcgaatagtccagttgaggaacaaaaaggcaagggaaataacagcagcccggagatggtatctgagaactatatattgtgggagaagttgatggaggatgacatgatttgtgagaatggagcagaaacagataagtatcaaagtgagattgttcttgaactagaggatttgatctcgaacccatccgagtgcaagtgtatgcct

SEQ ID NO: 456 - protein, 356 aa, Solanum lycopersicum
  Solyc07g040680.2.1
MEEEKTMLIDVNEKEMNVNGGVVVEVKEEPVIFINDEDDIIGDSVPKPLDGLRDVGPPPFLKKTFEMVDDPNTDSIISWSNSQNSFVVWDPHKFSIHLLPKHFKHNNFSSFIRQLNTYRFRKIDSDRWEFANEGFQKGKKHLLINIKRRKQYPQLGGGGGGGAKSWVGGCCKDGTEAAEIEKLKKDHNTLKMEILKLKQQQESTDNYLATMKERLQNSEIKQKYMVIFLAKTFHNPMFVQHLIEKVKQGKTTTVENGTKKRRLCSDENQEEYTTIKSEIQTLFSCDESSNSPVEEQKGKGNNSSPEMVSENYILWEKLMEDDMICENGAETDKYQSEIVLELEDLISNPSECKCMP

SEQ ID NO: 457 - DNA, 951 bp, Arabidopsis thaliana
  AT3G15500.1
atgggtctccaagagcttgacccgttagcccaattgagcttaccgccgggttttcggttttatccgactgacgaagagctgatggttgaatatctctgtagaaaagccgccggtcacgacttctctctccagctcatagctgaaatcgatctctacaagtttgatccatgggttttaccaagtaaggcgttattcggtgaaaaagaatggtattttttcagcccgagggataggaagtatccaaacgggtcaagacctaatcgggttgccgggtcgggttattggaaagccaccggtacggataaagttatctcgacggagggaagaagagttggtatcaagaaagctttggtgttttacattggaaaagctccaaaaggaaccaaaaccaattggattatgcatgagtaccgtctcatcgaaccctctcgtcgaaatggaagcaccaagcttgatgattgggttttatgtcgaatatacaaaaagcaaacaagcgcacaaaaacaagcttacaataatctaatgacgagtggtcgtgaatacagcaacaatggttcgtcgacatcttcttcgtctcatcaatacgacgacgttctcgagtcgttgcatgagattgacaacagaagtttggggtttgccgccggttcatcaaacgcgctgcctcatagtcatagaccggttttaaccaatcataaaaccgggtttcagggtttagccagggagccaagttttgattgggcgaatttgattggacagaactcggtcccggaactcggactgagtcataacgttccgagtattcgttacggtgacggtggaacgcagcaacaaactgaggggattcctcggtttaataataactcggacgtctcggctaatcagggttttagtgttgacccggttaacggatttgggtactcgggtcaacaatctagtgggttcgggtttatt

SEQ ID NO: 458 - protein, 317 aa, Arabidopsis thaliana
  AT3G15500.1
MGLQELDPLAQLSLPPGFRFYPTDEELMVEYLCRKAAGHDFSLQLIAEIDLYKFDPWVLPSKALFGEKEWYFFSPRDRKYPNGSRPNRVAGSGYWKATGTDKVISTEGRRVGIKKALVFYIGKAPKGTKTNWIMHEYRLIEPSRRNGSTKLDDWVLCRIYKKQTSAQKQAYNNLMTSGREYSNNGSSTSSSSHQYDDVLESLHEIDNRSLGFAAGSSNALPHSHRPVLTNHKTGFQGLAREPSFDWANLIGQNSVPELGLSHNVPSIRYGDGGTQQQTEGIPRFNNNSDVSANQGFSVDPVNGFGYSGQQSSGFGFI

SEQ ID NO: 459 - DNA, 951 bp, Arabidopsis thaliana
  AT1G52890.1
atgggtatccaagaaactgacccgttaacgcaattgagtttaccaccgggtttccgattttacccgaccgatgaagagcttatggttcaatatctctgtagaaaagcagctggttacgatttctctcttcagctcatcgccgaaatagatctttacaaattcgatccatgggttttaccaaataaagcattatttggagaaaaagaatggtatttttttagtcctagggatagaaaatatccaaacgggtcaagacctaaccgggttgccggatcgggttattggaaagctacgggtacggataaaataatctcgacggaaggacaaagagttggtattaaaaaagctttggtgttttacatcggaaaagctcctaaaggtactaaaaccaattggatcatgcatgagtatcgtctcattgaaccttctcgtagaaacggaagcactaagttggatgattgggttctatgtcgaatatacaagaagcaatcaagtgcacaaaaacaagtttacgataatggaatcgcgaatgctagagaattcagcaacaacggtacttcgtccacgacgtcgtcttcttctcactttgaagacgttcttgattcgtttcatcaagagatcgacaacagaaatttccagttttctaacccaaaccgcatctcgtcgctcagaccggacttaaccgaacagaaaaccgggttccacggtcttgcggatacttctaacttcgattgggctagttttgccggtaatgttgagcataataactcggtaccggaactcggaatgagtcatgttgttcctaatctcgagtacaactgtggctacctgaagacggaggaggaagtcgagagcagtcacgggtttaataactcgggcgagttagctcaaaagggttatggtgttgactcgtttgggtattcggggcaagttggtgggtttgggtttatg

SEQ ID NO: 460 - protein, 317 aa, Arabidopsis thaliana
  AT1G52890.1
MGIQETDPLTQLSLPPGFRFYPTDEELMVQYLCRKAAGYDFSLQLIAEIDLYKFDPWVLPNKALFGEKEWYFFSPRDRKYPNGSRPNRVAGSGYWKATGTDKIISTEGQRVGIKKALVFYIGKAPKGTKTNWIMHEYRLIEPSRRNGSTKLDDWVLCRIYKKQSSAQKQVYDNGIANAREFSNNGTSSTTSSSSHFEDVLDSFHQEIDNRNFQFSNPNRISSLRPDLTEQKTGFHGLADTSNFDWASFAGNVEHNNSVPELGMSHVVPNLEYNCGYLKTEEEVESSHGFNNSGELAQKGYGVDSFGYSGQVGGFGFM

SEQ ID NO: 461 - DNA, 942 bp, Arabidopsis thaliana
  AT4G27410.3
atgggtgttagagagaaagatccgttagcccagttgagtttgccaccaggttttagattttatccgacagatgaagagcttcttgttcagtatctatgtcggaaagttgcaggctatcatttctctctccaggtcatcggagacatcgatctctacaagttcgatccttgggatttgccaagtaagcaaacatgtttcacatttgtaggggagtataattgtaactatttaggtaaggctttgtttggagagaaggaatggtatttctttagcccaagagatcggaaatatccgaacgggtcaagacccaatagagtagccgggtcgggttattggaaagcaacgggtactgacaaaattatcacggcggatggtcgtcgtgtcgggattaaaaaagctctggtcttttacgccggaaaagctcccaaaggcactaaaaccaactggattatgcacgagtatcgcttaatagaacattctcgtagccatggaagctccaagttggatgattgggtgttgtgtcgaatttacaagaaaacatctggatctcagagacaagctgttactcctgttcaagcttgtcgtgaagagcatagcacgaatgggtcgtcatcgtcttcttcatcacagcttgacgacgttcttgattcgttcccggagataaaagaccagtcttttaatcttcctcggatgaattcgctcaggacgattcttaacgggaactttgattgggctagcttggcaggtcttaatccaattccagagctagctccgaccaatggattaccgagttacggtggttacgatgcgtttcgagcggcggaaggtgaggcggagagtgggcatgtgaatcggcagcagaactcgagcgggttgactcagagtttcgggtacagctcgagtgggtttggtgtttcgggtcaaacattcgagtttaggcaa

SEQ ID NO: 462 - protein, 314 aa, Arabidopsis thaliana
  AT4G27410.3
MGVREKDPLAQLSLPPGFRFYPTDEELLVQYLCRKVAGYHFSLQVIGDIDLYKFDPWDLPSKQTCFTFVGEYNCNYLGKALFGEKEWYFFSPRDRKYPNGSRPNRVAGSGYWKATGTDKIITADGRRVGIKKALVFYAGKAPKGTKTNWIMHEYRLIEHSRSHGSSKLDDWVLCRIYKKTSGSQRQAVTPVQACREEHSTNGSSSSSSSQLDDVLDSFPEIKDQSFNLPRMNSLRTILNGNFDWASLAGLNPIPELAPTNGLPSYGGYDAFRAAEGEAESGHVNRQQNSSGLTQSFGYSSSGFGVSGQTFEFRQ

SEQ ID NO: 463 - DNA, 1068 bp, Solanum lycopersicum
  Solyc07g063410.2.1
atgggtgttcaagaaatggatcctcttacacagctaagcttaccacccgggttccggttttacccgactgatgaagaacttttagttcaatatttatgccgtaaagttgctggtcatgatttttctctgcaaattattgctgaaattgatttgtacaaattcgatccatgggttcttccaagtaaggcgattttcggagaaaaagaatggtatttcttcagtccaagagatcggaagtatccgaatggatctagaccaaacagagtagctgggtctggttattggaaagcaactggaactgataaagttattactacagacggtagaaaagtcggaatcaaaaaggctttagtgttttacattggtaaagcacctaaaggaactaaaacaaattggattatgcacgaatacaggctcagtgaacctacaacgaaaactggaagttcaaggctcgacgattgggttctatgtaggatttacaagaagaattcaggtggacaaaaatcgagttgctctgatttacagaacaaggatataagtcatgcttcatcatcgtcatcgtcatctcagtttgatgatatgctggaatctctaccggcaattgaagatcgttatttctcattgccgagggtgaattctataaggaattttcaacaaaatgacaagatcaatcttcaacaattgagctctgggaacttcgattgggctgctatggcgggattaaactcattcccggaattacgtaccggaaatcaagttccaacgccgggaaatcaaactccggtgctgataaacaccaatcagtatcacaatcacaacgacaatttgaataatttcaacgaatttttcgccaattcaacggcgttaaattttcacggtgaagttaagtttgaaggaggagttgatcaagaagtagaaagcagtgttagagctcaacgacttaacagcgttaacccgggtttcttccaagagaactcaaccgggttttcaagttcttatacaaactcggtacccgacccatttgggattcggtacccgacccaaacagtaaatatgggttttactggg

SEQ ID NO: 464 - protein, 356 aa, Solanum lycopersicum
  Solyc07g063410.2.1
MGVQEMDPLTQLSLPPGFRFYPTDEELLVQYLCRKVAGHDFSLQIIAEIDLYKFDPWVLPSKAIFGEKEWYFFSPRDRKYPNGSRPNRVAGSGYWKATGTDKVITTDGRKVGIKKALVFYIGKAPKGTKTNWIMHEYRLSEPTTKTGSSRLDDWVLCRIYKKNSGGQKSSCSDLQNKDISHASSSSSSSQFDDMLESLPAIEDRYFSLPRVNSIRNFQQNDKINLQQLSSGNFDWAAMAGLNSFPELRTGNQVPTPGNQTPVLINTNQYHNHNDNLNNFNEFFANSTALNFHGEVKFEGGVDQEVESSVRAQRLNSVNPGFFQENSTGFSSSYTNSVPDPFGIRYPTQTVNMGFTG

SEQ ID NO: 465 - DNA, 1047 bp, Solanum lycopersicum
  Solyc12g013620.1.1
atgggtgttcaagaaaaagatccacttttgcaattaagtttaccaccaggatttagattttatccaactgatgaagagcttttagttcaatatttatgtaagaaagttgctggacatgattttcctctacaaattattggtgaaattgatttatacaaatttgatccttgggttttacctagtaaggcgacatttggtgaaaaagaatggtatttcttcagtccgagggataggaagtatccgaatggatctagaccgaatcgagtagcaggttcgggttattggaaagcaacggggacggataaggtgataacttcgcaaggaagaaaagttggaattaagaaagctcttgtgttttatgtgggtaaagctccaaaaggatccaagacgaattggattatgcatgaatatagactttttgaatcttcaaggaaaaataatggaagttcaaagctagatgaatgggtgctttgtcgaatttataagaagaattcaagtggaccaaaacctctgatgtctggtttacacagcagtaatgaatacagccatggttcgtcgacttcgtcatcatcccaattcgatgatatgctcgaatcattaccagaaatggacgatcgattctccaatttaccgaggttgaactctctcaaggccgagaaattcaacctcgatcgtctggattcagccaatttcgattgggcaattctcgctgggctcaaaccaatgccggaattgggcccagcaaatcaagctccaggcgttcagggtcaggctcaggggcatgtcaataaccacattcacagcgacaacaacaatatgaattttctcaacgatgtttacgcccatcctccaaatttccgaggcaacacaaaggttgaaagtattaatctagacgaagaagttgaaagcgggaaaagaaatcaacggattgaccaatcgagttacttccaacagagtctcaatggattttcccaagcgtatacaaacaatgtggatcaattcgggatccaatgtccgaatcagacgttaaatctcgggttcaagcag

SEQ ID NO: 466 - protein, 349 aa, Solanum lycopersicum
  Solyc12g013620.1.1
MGVQEKDPLLQLSLPPGFRFYPTDEELLVQYLCKKVAGHDFPLQIIGEIDLYKFDPWVLPSKATFGEKEWYFFSPRDRKYPNGSRPNRVAGSGYWKATGTDKVITSQGRKVGIKKALVFYVGKAPKGSKTNWIMHEYRLFESSRKNNGSSKLDEWVLCRIYKKNSSGPKPLMSGLHSSNEYSHGSSTSSSSQFDDMLESLPEMDDRFSNLPRLNSLKAEKFNLDRLDSANFDWAILAGLKPMPELGPANQAPGVQGQAQGHVNNHIHSDNNNMNFLNDVYAHPPNFRGNTKVESINLDEEVESGKRNQRIDQSSYFQQSLNGFSQAYTNNVDQFGIQCPNQTLNLGFKQ

SEQ ID NO: 467 - DNA, 1041 bp, Citrus clementina
  clementine0.9_014634m
atgggcgtaccggagaccgacccgctctcacaattgaacttacctccgggttttcggttttacccgactgatgaggaacttctagttcaatatctctgtcgcaaagttgcagggcaacatttttcgctgcaaattatcggtgaaatagatttgtacaagtttgacccatgggttctaccaagcaaggcaatttttggtgagaaagaatggtactttttcagccccagggatagaaaatatccaaacgggtcccgacccaacagagtagccgggtccgggtattggaaggccacaggcaccgacaagattatcacaactgaaggtcgtaaggttggtatcaaaaaggctcttgttttttacgtaggcaaagctccaaaaggcaccaaaaccaattggatcatgcacgaatatcgactctttgaaccttctcgcaaaaatggcagctccaagttagatgattgggttctgtgcagaatctataagaagcattcaggttcccaaaaaccagtgtcagcaacaagtgtttcttcaagcaaagaacacagtaatggttcttgttcatcttcatcttctcatcttgatgatgtgctcgagtctttacctgaaattgatgaccgatttttcgctttgccacgcatgaactcactcaagactttacagcaagaagacaacaaggttaacaatttgcagcatctggggtcgggtaattttgactgggcgagtcttgcgggtcttcattcggtccccgaattcgtctccgctgcacagacacagacgacgactcagagtcatggggtggcctgttatgcgaacaatgacttttatgtcccctcgatgccccaaatgtaccacgtaaattccggaagggtgggcaactcggtggaagaggaggttcagagtgggcttaggaatcaacgggttgataactcggggctctttcagcataattcggccgtattgacccaaccgaacttctgtagcccggttgacccatatggattaaggcacccgacccaatcaagcgggtttgggtttagacat

SEQ ID NO: 468 - protein, 347 aa, Citrus clementina
  clementine0.9_014634m
MGVPETDPLSQLNLPPGFRFYPTDEELLVQYLCRKVAGQHFSLQIIGEIDLYKFDPWVLPSKAIFGEKEWYFFSPRDRKYPNGSRPNRVAGSGYWKATGTDKIITTEGRKVGIKKALVFYVGKAPKGTKTNWIMHEYRLFEPSRKNGSSKLDDWVLCRIYKKHSGSQKPVSATSVSSSKEHSNGSCSSSSSHLDDVLESLPEIDDRFFALPRMNSLKTLQQEDNKVNNLQHLGSGNFDWASLAGLHSVPEFVSAAQTQTTTQSHGVACYANNDFYVPSMPQMYHVNSGRVGNSVEEEVQSGLRNQRVDNSGLFQHNSAVLTQPNFCSPVDPYGLRHPTQSSGFGFRH

SEQ ID NO: 469 - DNA, 1029 bp, Populus trichocarpa
  POPTR_0001s41460.1
atgggagtgcaagaaacagaccctcttgcccaactgagcttgccaccgggttttcggtttcacccgactgatgaagagctattagtgcaatatttgtgcaggaaagttgctggtcaccatttctcgatgcaaatcattggtgaaattgatttatacaagtttgatccatggctcttaccaagcaaggcgatatttggtgaaaaagaatggtacttctttagtcctagagaccgtaagtacccaaatggatcccgacccaatagggttgccgggtctgggtattggaaggccaccggtactgataaaattatcacatcagatggacgtaaagtaggtatcaagaaagctctcgtcttttacattggcaaggccccaaaaggaaccaaaactaattggatcatgcatgaataccgccttattgaatcctctcgcaaacatggaagcacgaagttggacgaatgggtattgtgtcggatttataagaagaaatcaattgctgcacagaaatccatgtcaggtgtttcaagcaaggaacctagtactaatagtccatcttcatcattctcttctcatttcgatgatgatgtccttgacccgttgccggagattgatgaccgcttccttgacttgcctcgaaccaactcactcaaaccaaggcaacatgaagagaaaatcaacttggccactctgggctcagggagttttgattgggcgactcttgctgggctcaactcggtgcctcaactcgttcaaacacagccttgtgtgagttactcgaacagtaatgttcatgatgtgtatgttccttcaatgtcccaactatgccacatggatacatccgcggagaggatggaaaacttggttgaagaggaggttcaaagtggagttagaactcggctggatagtgttggtaacccagtgtttttccaacaaaactcgagcgtgaggccacagagcttctctaactcatttgacccgtatgggttaaggcactcgatccaaccgggtagtgggttcgggtttaatcag

SEQ ID NO: 470 - protein, 343 aa, Populus trichocarpa
  POPTR_0001s41460.1
MGVQETDPLAQLSLPPGFRFHPTDEELLVQYLCRKVAGHHFSMQIIGEIDLYKFDPWLLPSKAIFGEKEWYFFSPRDRKYPNGSRPNRVAGSGYWKATGTDKIITSDGRKVGIKKALVFYIGKAPKGTKTNWIMHEYRLIESSRKHGSTKLDEWVLCRIYKKKSIAAQKSMSGVSSKEPSTNSPSSSFSSHFDDDVLDPLPEIDDRFLDLPRTNSLKPRQHEEKINLATLGSGSFDWATLAGLNSVPQLVQTQPCVSYSNSNVHDVYVPSMSQLCHMDTSAERMENLVEEEVQSGVRTRLDSVGNPVFFQQNSSVRPQSFSNSFDPYGLRHSIQPGSGFGFNQ

SEQ ID NO: 471 - DNA, 762 bp, Populus trichocarpa
  POPTR_1659s00200.1
atgggagtgcaagaaacagaccctcttgcccaactgagcttgccaccgggttttcggtttcacccgactgatgaagagctattagtgcaatatttgtgcaggaaagttgctggtcaccatttctcgatgcaaatcattggtgaaattgatttatacaagtttgatccatggctcttaccaagcaaggcgatatttggtgaaaaagaatggtacttctttagtcctagagaccgtaagtacccaaatggatcccgacccaatagggttgccgggtctgggtattggaaggccaccggtactgataaaattatcacatcagatggacgtaaagtaggtatcaagaaagctctcgtcttttacattggcaaggccccaaaaggaaccaaaactaattggatcatgcatgaataccgccttattgaatcctctcgcaaacatggaagcacgaagctggacgaatgggtattgtgtcggatttataagaagaaatcaattgctgcacagaaatccatgtcaggtgtttcaagcaaggaacctagtactaatagtccatcttcatcattctcttctcatttcgatgatgatgtccttgacccgttgccggagattgatgaccgcttccttgacttgcctcgaaccaactcactcaaaccaaggcatcatgaagagaaaatcaacttggccactctgggctcagggagttttgattgggcgactcttgctgggctcaactcggtgcctcaactcgttcaaacacagcct

SEQ ID NO: 472 - protein, 255 aa, Populus trichocarpa
  POPTR_1659s00200.1
MGVQETDPLAQLSLPPGFRFHPTDEELLVQYLCRKVAGHHFSMQIIGEIDLYKFDPWLLPSKAIFGEKEWYFFSPRDRKYPNGSRPNRVAGSGYWKATGTDKIITSDGRKVGIKKALVFYIGKAPKGTKTNWIMHEYRLIESSRKHGSTKLDEWVLCRIYKKKSIAAQKSMSGVSSKEPSTNSPSSSFSSHFDDDVLDPLPEIDDRFLDLPRTNSLKPRHHEEKINLATLGSGSFDWATLAGLNSVPQLVQTQPC

SEQ ID NO: 473 - DNA, 1026 bp, Populus trichocarpa
  POPTR_0011s12400.1
atgggactgcaagaaacagaccctctagcccaattgagcttgccaccgggatttcggtttcacccgactgatgaagagcttttggtgcaatacttgtgtaagaaggttgctggtcaccatttctccttgcaaatcattggcgaaattgatttgtacaagtttgatccgtggttcttaccaggtaaggcaatatttggtgaaaaagaatggtattttttcagtccgagagaccgcaagtaccccaatggatcccgacccaacagggttgccgggtctgggtattggaaggccaccggtactgacaaagtaatcacgacagagggacgtaaagttggcatcaagaaagctttggtcttttacgttggcaaagccccaaaaggcaccaaaactaattggatcatgcatgaatatcgccttcttgaatcctctcgcaaaagtggaagtacaaagttggatgaatgggtattgtgtcggatttacaagaagaattcaagtgctgcacagaaatccatgtcaagcgtttcaagcaaagaatacagtactaatggttcatgttcatcatcctcttctcatttggaagatgtccttgactcattgacagagattgatgaccggctctttgctttgcctcgaaccaactcactcaaacaaatgcaacacgaagagaaaatcaacttagcaaatctgggttcagggagctttgactgggcgacacttgctgggctcaactcgttgcctgaactcctacaaactcagcctggtgcgaattactcgaataccaatgtcaatggtgtgcatgtcccttcaatgcccccactctgccacgcggattcatcaacagggaggatggggacctcggttgaagaggaggtccaaagtggggttagaactcagctgcgagatggcaactcgggggcttttcaacaaaactcgggcgtgatgacaccgaacttctcttctaccttactcgacccatatgagctaaggtattcgacccaaccgggaagtgggtatgggtttaggcag

SEQ ID NO: 474 - protein, 342 aa, Populus trichocarpa
  POPTR_0011s12400.1
MGLQETDPLAQLSLPPGFRFHPTDEELLVQYLCKKVAGHHFSLQIIGEIDLYKFDPWFLPGKAIFGEKEWYFFSPRDRKYPNGSRPNRVAGSGYWKATGTDKVITTEGRKVGIKKALVFYVGKAPKGTKTNWIMHEYRLLESSRKSGSTKLDEWVLCRIYKKNSSAAQKSMSSVSSKEYSTNGSCSSSSSHLEDVLDSLTEIDDRLFALPRTNSLKQMQHEEKINLANLGSGSFDWATLAGLNSLPELLQTQPGANYSNTNVNGVHVPSMPPLCHADSSTGRMGTSVEEEVQSGVRTQLRDGNSGAFQQNSGVMTPNFSSTLLDPYELRYSTQPGSGYGFRQ

SEQ ID NO: 475 - DNA, 1059 bp, Eucalyptus grandis
  Eucgr.F01093.1
atgggtgttccggggaccgatcctctggcccagctgagcctgccgcccggcttccggttttacccgaccgacgaggagctcctcgtccaatacctctgccgcaaggtggccggttacgagttcagtctggagatcatcggggagatcgatctgtacaagttcgatccctgggtcttgccaagcaaggcgatgtttggcgaaaaggagtggtacttcttcagcccccgagaccggaagtacccgaacgggtcccggccgaacagggttgccgggaccgggtactggaaggcgaccggcaccgacaaggtcatcagcaccgaaggccgccaggtcggcatcaagaaagccctcgttttctacatcggcaaagccccaaaaggtaacaagaccaactggatcatgcacgagtaccgcctcctcgcaagtacctgcaagagcggaagcactaagctggacgagtgggtcctgtgccgaatctacaagaagagctcgggcgggcagaagccgagcacctcgacttcctcgagcaaggaacagagccacggctcgcattcgccttcctcttcattggacaacatgttggacactctgcccgagatcaacgaccggcgcttcgcgttgccgcacgcgaactcgctcaggatcgcgcaacagcagcagcagcagcagcagcagcggcagcggcatgagcagaagcccagcctgcaggccctgatgggctcgggcagtttcgattgggccacgctcgcgagtctcaacttggagccccagcaacagctcgtcccggtcagccagcctcagcctcaggggctcgtgaactacggcggtaacgacgtgtttgtccctcagatgaaccgcctcgacggcctgcagaggcagcagctcggcggctcggcgaacgaggaggtgcagagcgggatcaggacccagccgccgccggcggcggcggccgggctttaccagccgagttcgaccgggttcgctcagaacctggcgaactcgctcgacccgtacgggttccgctactcggcccacaacgtcgggctcgggtttcggcaa

SEQ ID NO: 476 - protein, 353 aa, Eucalyptus grandis
  Eucgr.F01093.1
MGVPGTDPLAQLSLPPGFRFYPTDEELLVQYLCRKVAGYEFSLEIIGEIDLYKFDPWVLPSKAMFGEKEWYFFSPRDRKYPNGSRPNRVAGTGYWKATGTDKVISTEGRQVGIKKALVFYIGKAPKGNKTNWIMHEYRLLASTCKSGSTKLDEWVLCRIYKKSSGGQKPSTSTSSSKEQSHGSHSPSSSLDNMLDTLPEINDRRFALPHANSLRIAQQQQQQQQQRQRHEQKPSLQALMGSGSFDWATLASLNLEPQQQLVPVSQPQPQGLVNYGGNDVFVPQMNRLDGLQRQQLGGSANEEVQSGIRTQPPPAAAAGLYQPSSTGFAQNLANSLDPYGFRYSAHNVGLGFRQ

SEQ ID NO: 477 - DNA, 1011 bp, Glycine max
  Glyma06g38410.1
atgggagttccagagagagaccctcttgcacaattgagtttgcctcctgggtttaggttttaccccacagatgaggagcttttggttcagtacctttgccgcaaggttgctggccatcatttctctcttccaatcattgctgaagttgatttgtacaagtttgatccatgggttcttccaggtaaggcagtgtttggagagaaggagtggtacttttttagcccaagagacaggaagtacccgaatggttcacgaccaaacagagtcgcgggttctgggtattggaaagcaactggaacagacaagatcatcaccactgaaggtagaaaagttggcataaaaaaagcacttgttttctacattggcaaagcacccaaaggctccaaaaccaattggatcatgcacgagtatcgccttctcgattcttcccgcaaacacaacctcggaaccgcaaagcttgatgattgggttctatgtcgtatctataagaagaactcaagttcacaaaaggttgaggctaattttttggctatggaatgcagcaatgggtcatcaccttcttcatcgtcccacgtggatgacatgctgggatcgttgccggagataaatgaccggtgcttcaccctgccacgagtgaactcactcagaacaatgcaccagcaggatgagaaattcgggtctccgaacatgggatccgggtttttctcggattgggttaactcgaccgatctcgattcgatttccgaattcgagtcgggttgccaaacccaaagaatggtgaattatgattgcaatgacttttttgttccttctctgccgcccttgggccatgtggactacatggtggatgcacctttggaggaggaggttcaaagtggtgtgagaacccgacgggtcgacgggccggggcattttcaaccgaatccagatacccgattgttaccgggctcaggtgacccattcgggtttgggtttattatgggtcagcaagttgggttcggggttagggag

SEQ ID NO: 478 - protein, 337 aa, Glycine max
  Glyma06g38410.1
MGVPERDPLAQLSLPPGFRFYPTDEELLVQYLCRKVAGHHFSLPIIAEVDLYKFDPWVLPGKAVFGEKEWYFFSPRDRKYPNGSRPNRVAGSGYWKATGTDKIITTEGRKVGIKKALVFYIGKAPKGSKTNWIMHEYRLLDSSRKHNLGTAKLDDWVLCRIYKKNSSSQKVEANFLAMECSNGSSPSSSSHVDDMLGSLPEINDRCFTLPRVNSLRTMHQQDEKFGSPNMGSGFFSDWVNSTDLDSISEFESGCQTQRMVNYDCNDFFVPSLPPLGHVDYMVDAPLEEEVQSGVRTRRVDGPGHFQPNPDTRLLPGSGDPFGFGFIMGQQVGFGVRE

SEQ ID NO: 479 - DNA, 1020 bp, Glycine max
  Glyma12g22880.1
atgggagttccagagagagaccctcttgcacaattgagcttgcctcctggatttagattttatcccactgatgaggagcttttggttcagtacctttgccgcaaggttgctggccatcatttctctcttccaatcattgctgaagttgatttgtacaagtttgatccatgggttcttccaggtaaggcagcgtttggagagaaggagtggtacttcttcagtccaagagacaggaagtacccgaatggttcacgaccaaacagagttgcgggttctgggtattggaaagccactggaactgacaaaatcatcaccactgaaggtagaaaagttggcataaaaaaagcacttgttttctacgttggcaaagcacccaaaggctccaaaaccaattggatcatgcacgagtatcgccttctcgactcttcccgcaaacacaacctcggaaccgcaaagcttgatgattgggttctgtgtcgtatctataagaagaactcaagtgcgcaaaaggttgaggcaaatcttttggctatggaatgtagcaatgggtcatcaccttcttcatcgtcccacgtggacgacatgctggaatcgttgccggagatcgatgatcggtgcttcaccctgccgcgagtgaactcagtcagaacaatgcagcagcaggacgagaaattcggatttcagaacatgggatccgggtttttcaccgattgggtcaacccgacggatcttgattcagtttccgaatttgggtcgggttgccaaacccaagggatggtgaattatgattgtaatgacttatttgtcccttctgtgccgcccttcggccacagccatgtaaactacatggtgggggcaccaccgtccgaggaggaggttcaaagcggtgtgaggactcaacaggccgatggggccgcatgttttcagcagaacccaaatgcccgattgttaccgggctcgggcgacccatttgggtttgggttcatcatgggtcagcaagttgagttcgggtttagggac

SEQ ID NO: 480 - protein, 340 aa, Glycine max
  Glyma12g22880.1
MGVPERDPLAQLSLPPGFRFYPTDEELLVQYLCRKVAGHHFSLPIIAEVDLYKFDPWVLPGKAAFGEKEWYFFSPRDRKYPNGSRPNRVAGSGYWKATGTDKIITTEGRKVGIKKALVFYVGKAPKGSKTNWIMHEYRLLDSSRKHNLGTAKLDDWVLCRIYKKNSSAQKVEANLLAMECSNGSSPSSSSHVDDMLESLPEIDDRCFTLPRVNSVRTMQQQDEKFGFQNMGSGFFTDWVNPTDLDSVSEFGSGCQTQGMVNYDCNDLFVPSVPPFGHSHVNYMVGAPPSEEEVQSGVRTQQADGAACFQQNPNARLLPGSGDPFGFGFIMGQQVEFGFRD

SEQ ID NO: 481 - DNA, 1035 bp, Glycine max
  Glyma12g35000.1
atgggagttccagagaaagaccctctttcccaattgagtttgcctcctggttttcggttttaccccaccgacgaggagctcctcgttcagtatctatgccgcaaggtcgctggccaccatttctctcttccaatcattgctgaaattgatttgtacaagttcgacccatgggttcttccaagtaaggcgattttcggtgagaaagagtggtactttttcagccctagagacaggaaataccctaacgggtcccgacccaacagagtagccgggtcgggttattggaaagccaccggaaccgacaagatcatcaccaccgaaggtagaaaagttggcataaaaaaagccctcgttttctacattggcaaagcccccaaaggcaccaaaaccaattggatcatgcacgagtatcgcctcctcgactcttcccgaaaaaacaccggcaccaagcttgatgactgggttctgtgtcgtatctacaagaagaactcgagtgcacagaaggcggtgcaaaacggcgtcgttccgagcaacgagcacactcaatacagcaacggttcctcttcctcttcttcgtcacaactcgacgacgttctggaatcgctgccagcgattgatgaacggtgtttcccgatgccacgtgtcaacacgctgcagcaacagcagcacgaggagaaggtcaatgttcagaacttgggtgaaggggggttactggattggaccaacccttcggttctgaattcggtcgttgatttcgtatcggggaataataatcataatcaattggtgcaggaccagacgcaaggcatggtgaactacaacgcgtgcaatgacctctatgtccctacgttatgccatgtgggcacgtcagttccgcaaaagatggaggaagaggtgcaaagcggcgtgagaaaccaacgggtccagaacaattcctggtttcttcagaatgatttcacacaggggtttcagaattcggttgacacgtctgggtttaagtacccggttcaaccggtggggttcgggttcaggaat

SEQ ID NO: 482 - protein, 345 aa, Glycine max
  Glyma12g35000.1
MGVPEKDPLSQLSLPPGFRFYPTDEELLVQYLCRKVAGHHFSLPIIAEIDLYKFDPWVLPSKAIFGEKEWYFFSPRDRKYPNGSRPNRVAGSGYWKATGTDKIITTEGRKVGIKKALVFYIGKAPKGTKTNWIMHEYRLLDSSRKNTGTKLDDWVLCRIYKKNSSAQKAVQNGVVPSNEHTQYSNGSSSSSSSQLDDVLESLPAIDERCFPMPRVNTLQQQQHEEKVNVQNLGEGGLLDWTNPSVLNSVVDFVSGNNNHNQLVQDQTQGMVNYNACNDLYVPTLCHVGTSVPQKMEEEVQSGVRNQRVQNNSWFLQNDFTQGFQNSVDTSGFKYPVQPVGFGFRN

SEQ ID NO: 483 - DNA, 921 bp, Glycine max
  Glyma12g35000.2
atgggagttccagagaaagaccctctttcccaattgagtttgcctcctggttttcggttttaccccaccgacgaggagctcctcgttcagtatctatgccgcaaggtcgctggccaccatttctctcttccaatcattgctgaaattgatttgtacaagttcgacccatgggttcttccaagtaaggcgattttcggtgagaaagagtggtactttttcagccctagagacaggaaataccctaacgggtcccgacccaacagagtagccgggtcgggttattggaaagccaccggaaccgacaagatcatcaccaccgaaggtagaaaagttggcataaaaaaagccctcgttttctacattggcaaagcccccaaaggcaccaaaaccaattggatcatgcacgagtatcgcctcctcgactcttcccgaaaaaacaccggcaccaagcttgatgactgggttctgtgtcgtatctacaagaagaactcgagtgcacagaaggcggtgcaaaacggcgtcgttccgagcaacgagcacactcaatacagcaacggttcctcttcctcttcttcgtcacaactcgacgacgttctggaatcgctgccagcgattgatgaacggtgtttcccgatgccacgtgtcaacacgctgcagcaacagcagcacgaggagaaggaccagacgcaaggcatggtgaactacaacgcgtgcaatgacctctatgtccctacgttatgccatgtgggcacgtcagttccgcaaaagatggaggaagaggtgcaaagcggcgtgagaaaccaacgggtccagaacaattcctggtttcttcagaatgatttcacacaggggtttcagaattcggttgacacgtctgggtttaagtacccggttcaaccggtggggttcgggttcaggaat

SEQ ID NO: 484 - protein, 307 aa, Glycine max
  Glyma12g35000.2
MGVPEKDPLSQLSLPPGFRFYPTDEELLVQYLCRKVAGHHFSLPIIAEIDLYKFDPWVLPSKAIFGEKEWYFFSPRDRKYPNGSRPNRVAGSGYWKATGTDKIITTEGRKVGIKKALVFYIGKAPKGTKTNWIMHEYRLLDSSRKNTGTKLDDWVLCRIYKKNSSAQKAVQNGVVPSNEHTQYSNGSSSSSSSQLDDVLESLPAIDERCFPMPRVNTLQQQQHEEKDQTQGMVNYNACNDLYVPTLCHVGTSVPQKMEEEVQSGVRNQRVQNNSWFLQNDFTQGFQNSVDTSGFKYPVQPVGFGFRN

SEQ ID NO: 485 - DNA, 1029 bp, Glycine max
  Glyma13g35550.1
atgggagttccagagaaagaccctctttcccaattgagtttgcctcctggttttcggttttaccccaccgacgaggagcttctcgttcagtatctgtgccgcaaggtcgctggccaccatttctctcttccaatcattgccgaaattgacttgtacaagttcgacccatgggttcttccaagtaaagcgattttcggtgaaaaagagtggtactttttcagccccagagacaggaaatacccgaacgggtctcgacccaacagagtagctgggtcgggttattggaaagccaccggaaccgacaagatcatcaccaccgaaggtagaaaagttggcataaaaaaagccctcgttttctacgttggcaaagcccccaagggcaccaaaaccaattggatcatgcacgagtatcgcctcctcgactcttcccgaaagaacactggcaccaagcttgatgattgggttctgtgtcgtatatacaagaagaactcgagtgcacagaagacggcgcaaaacggcgtggttccgagcaacgagcacactcaatacagcaacggttcctcttcttcttcttcgtcccagctggaggacgttctggaatctctgccatcgattgatgaaaggtgtttcgcgatgccacgcgtcaacacgctgcaacaacaacagcaccacgaggagaaggtcaatgttcagaacttgggtgcagggggtttaatggattggaccaacccttcggttctgaattcggtcgccgatttcgcttcggggaataatcaagtggtacaggaccagactcaggggatggtgaactacaactgcaatgacctttatgtccctacgttatgccacttggactcatcggttccgttaaagatggaggaagaggtgcaaagcggcgtgagaaaccaacgggtcgggaataataattcgtggtttcttcagaatgatttcacacaggggtttcagaattcggttgacacgtgtgggtttaaatacccggttcagccggtcgggttcgggttcagaaat

SEQ ID NO: 486 - protein, 343 aa, Glycine max
  Glyma13g35550.1
MGVPEKDPLSQLSLPPGFRFYPTDEELLVQYLCRKVAGHHFSLPIIAEIDLYKFDPWVLPSKAIFGEKEWYFFSPRDRKYPNGSRPNRVAGSGYWKATGTDKIITTEGRKVGIKKALVFYVGKAPKGTKTNWIMHEYRLLDSSRKNTGTKLDDWVLCRIYKKNSSAQKTAQNGVVPSNEHTQYSNGSSSSSSSQLEDVLESLPSIDERCFAMPRVNTLQQQQHHEEKVNVQNLGAGGLMDWTNPSVLNSVADFASGNNQVVQDQTQGMVNYNCNDLYVPTLCHLDSSVPLKMEEEVQSGVRNQRVGNNNSWFLQNDFTQGFQNSVDTCGFKYPVQPVGFGFRN

SEQ ID NO: 487 - DNA, 999 bp, Vitis vinifera
  GSVIVT01014403001
atgggtgtaccggagactgacccgctttcacagcttagtttgccgcctgggttccgattttatcccaccgatgaggagcttctggtgcagtatctctgccggaaagtggccggacaggggttttcattggagataattggcgaaatcgatctgtacaagtttgacccatgggttcttcccagtaaagctatatttggagagaaagagtggtactttttcagtcccagagatcggaagtacccaaatgggtccagacccaatagggttgctgggtctgggtattggaaggccaccggaactgataaggtgattaccaccgagggccggaaagttggcatcaagaaagctctggtgttttacgtcggcaaagctccaaaaggaaccaaaactaattggatcatgcatgagtacagactcctagaaaattcgaggaaaaatggaagctccaagttggatgattgggttctgtgccgaatttacaagaagaattccaactcttcgaaacccatagcagctgtacttcccagcaaagcgcacagcaacggctcgtcatcgtcatcgtcgtcccacctcgacgacgtcctggagtcgctgccggagatcgatgacaggttcttttctcctaatcggatgaattctctgagagtttcacagccggacgagaaagtcaacttccataacctgggctcgggcaacttcgactgggccactctagcaggcgtctcctccttgcaggagttggtctccggcgtccaatcccacgcccagcctcccgcagctgtcaacaacagcaacgaaatgtacgttccgtcactgccgccgctaatccaagccgaagaagaagtccagagcggactcagaacccagagagtcgacccagtaatgaaccaagggttcttcccgcagaactcgaacgcgttcagtcagagtttctctaactcactcgacccgttcgggtttcggtacccgacccaacctagtggatttggatataggcag

SEQ ID NO: 488 - protein, 333 aa, Vitis vinifera
  GSVIVT01014403001
MGVPETDPLSQLSLPPGFRFYPTDEELLVQYLCRKVAGQGFSLEIIGEIDLYKFDPWVLPSKAIFGEKEWYFFSPRDRKYPNGSRPNRVAGSGYWKATGTDKVITTEGRKVGIKKALVFYVGKAPKGTKTNWIMHEYRLLENSRKNGSSKLDDWVLCRIYKKNSNSSKPIAAVLPSKAHSNGSSSSSSSHLDDVLESLPEIDDRFFSPNRMNSLRVSQPDEKVNFHNLGSGNFDWATLAGVSSLQELVSGVQSHAQPPAAVNNSNEMYVPSLPPLIQAEEEVQSGLRTQRVDPVMNQGFFPQNSNAFSQSFSNSLDPFGFRYPTQPSGFGYRQ

SEQ ID NO: 489 - DNA, 1302 bp, Physcomitrella patens
  Pp1s5_359V6.1
atggtgattatgtcatcaccttctggaggaccggtcgcccaactccagctgccaccagggtttcggttccatccgaccgatgaggagctggttcttcattacctgtgtcggaaagccgagtctaaggtgttcgcgattcctgttattgccgaaattgacctgtataagttcgacccttgggaccttcctggaaaagcaattttcggagagagggaatggtatttctttagtcctagagatagaaagtaccctaatggagccaggcccaacagagcggccgcttcagggtactggaaagccacagggacagacaaaccaattcataccgcagtagggggaatccggaagattggagtgaagaaggcactcgtgttctacgaaggccgggcaccaaaaggggtgaagaccaactggattatgcatgagtatcggttggccgagggagtatgtgcatctgtgcacgctcacagaaaaggctcccttcgtttggatgattgggtactctgccggatctataagaagagtacaaatgcgcagcgtactgggaaggagcgtgacagctcttcctgtgttgaagaggtgctagcctcgttgccagagatcgatgaccccaagctagtactccctcgcctcggctcgttcactggatttcctgaaccagaggacaatcatttcatggacagcttgctcttgggggagaacaaatctgtggatgcagaatcctcgcccgagtttaaaagaagcgttctgggcctccaaagaggaatgcaaccccagccagggactctaggaagccacattttgtcggcatttaattcaaagtttccgtttgggtggaagatgcccaggcccgtggatggccccttcgacagccagcagttcgacaaattcaaccgacagctgctggagctaggaccgacttcctcccagcgaccaacgactctgagtctacgacaacccgctcccgacagcgccatgcgccaagttgagaacgtgctcatgccactccggcctggcactggagcgattcctgagaatcgaacaatctccgacgaggaggtccagagcacatcccgggcttcctcaatgggtcaattttctggtaccagtaacaacgaaggtctggagtcgatcttcaccttcaactacgagcagccgcgctcgacaatcaatgcaatgcttcctgcaccgaccacgggccccaacactgagctgcgattttcaggaagtggcatgagcgccagccagcctcaatacactcaaagtcgcgcaccaaactacagttacaacccttcttcggcg

SEQ ID NO: 490 - protein, 434 aa, Physcomitrella patens
  Pp1s5_359V6.1
MVIMSSPSGGPVAQLQLPPGFRFHPTDEELVLHYLCRKAESKVFAIPVIAEIDLYKFDPWDLPGKAIFGEREWYFFSPRDRKYPNGARPNRAAASGYWKATGTDKPIHTAVGGIRKIGVKKALVFYEGRAPKGVKTNWIMHEYRLAEGVCASVHAHRKGSLRLDDWVLCRIYKKSTNAQRTGKERDSSSCVEEVLASLPEIDDPKLVLPRLGSFTGFPEPEDNHFMDSLLLGENKSVDAESSPEFKRSVLGLQRGMQPQPGTLGSHILSAFNSKFPFGWKMPRPVDGPFDSQQFDKFNRQLLELGPTSSQRPTTLSLRQPAPDSAMRQVENVLMPLRPGTGAIPENRTISDEEVQSTSRASSMGQFSGTSNNEGLESIFTFNYEQPRSTINAMLPAPTTGPNTELRFSGSGMSASQPQYTQSRAPNYSYNPSSA

SEQ ID NO: 491 - DNA, 2337 bp, Arabidopsis thaliana
  AT1G16150.1
atgaagaaagaaactcaaaacctccaatgtatcccactagtgatctctgtcttatctctgtttggcgtctcatcagcaagaaaacctccatatctgtgtaacagagtctgcggaggaatatcaattcctttccctttcggtatcggtggaaaagaatgctatctaaacccgtggtacgaggttgtatgtaacaccacaacctctgttccgttcctctcgaggatcaacagagaattggtgaacatctatcttccagatcctactgagtactactctaacggagttgttcacatcaaaggtcccgtaacttcctcagggtgttctaccggaacatctcaaccacttacaccgcagcctttaaacgttgcaggccaaggcagtccctatttcctcacggacaagaacctcctcatggccgttggttgcaacgtcaaggccgttatgatggatgtcaaatcgcagatcatcggttgcgagtcaagttgcgacgagagaaacagtagcagccaagttgtaagaaacaaaatctgcagtggtaataaatgttgccagacgaggataccggaagggcagccgcaagtaattggagtcaacatagagatccctgaaaacaaaaacacaacagaaggaggatgcaaagttgcatttttgacgagcaacaaatattcgagtttgaatgttacagagccagaagagtttcatagtgatggatacgcggtggttgagcttggatggtactttgatacttcggattctcgtgttttaagccccataggttgtatgaatgtgtcagatgcatcacaagatggcgggtatggttccgagacgatttgcgtttgctcgtacggctacttctctggattcagctataggagttgctattgtaactccatgggttacgcagggaatccattccttccaggtggatgtgtagacatagatgaatgtaaactagaaataggacgcaaaaggtgcaaagaccaaagttgtgtgaataagcccggttggtttacgtgtgagccaaagaaaccagggcagatcaagccagtgttccaaggtaaaagtcaatttgattttatcttgaatgttgtgttgaagatattattgttttgtgttcttataggttcggcactgttgcttttcgcctttggaattttcgggttgtacaagttcatcaagaagcagaggaggagcagtcgaatgagagtgttcttcaggcgtaatggagggatgctgttaaaacaacagttagctagaaaagaaggcaatgtagagatgtcaaagatatttagctcgaacgagttggagaaagctactgataactttaacacgaatagggttcttgggcaaggaggtcaaggtactgtttacaaaggtatgctcgttgatggtagaatcgtcgcagtgaaaaggtcgaaagccatggatgaagacaaggtagaagagtttatcaatgaagttgttgttctagcgcagatcaaccatagaaacattgttaaactcttgggatgttgccttgagacggaagttccagtcctggtttatgagtttgttccgaacggtgacttatgcaagcgtcttcgagatgaatgtgatgattacatcatgacatgggaagtgcgccttcacattgcaatagagattgcaggagcactttcgtacctacactcggctgcatcttttcctatataccacagagatatcaagactaccaacatactactggatgagaaatatcaggttaaggtgtctgatttcggaacttcaagatcggtgaccatagatcaaactcacttgacaactcaagttgcaggtacttttgggtacgtggatccagagtactttcaatcaagtaagtttacggataaaagtgatgtgtacagttttggagttgtcctcgtggagctcattaccggaaaaaacccgtcctcccgtgtccagtctgaagaaaacaggggatttgcagctcattttgttgcagccgtgaaagagaacagatttcttgacatagttgatgaacggatcaaagatgaatgcaacctggaccaagtgatggcagtggcaaaactcgctaaaagatgtttaaaccgaaaagggaagaagaggccaaacatgagagaagtttcagttgagctggagaggattcgttcatcatcttataagtcagagattcataatgatgatgatgatgatgatgatgatgatgatgaggatgatcaagccatggaactcaacattgaagagacttgggatgttggtatgactgctccagcctctatgtttaataacggatcccctgcgtctgatgttgagcctctggttcctctacgaacatgg

SEQ ID NO: 492 - protein, 779 aa, Arabidopsis thaliana
  AT1G16150.1, GUB_WAK_bind domain 51-144
MKKETQNLQCIPLVISVLSLFGVSSARKPPYLCNRVCGGISIPFPFGIGGKECYLNPWYEVVCNTTTSVPFLSRINRELVNIYLPDPTEYYSNGVVHIKGPVTSSGCSTGTSQPLTPQPLNVAGQGSPYFLTDKNLLMAVGCNVKAVMMDVKSQIIGCESSCDERNSSSQVVRNKICSGNKCCQTRIPEGQPQVIGVNIEIPENKNTTEGGCKVAFLTSNKYSSLNVTEPEEFHSDGYAVVELGWYFDTSDSRVLSPIGCMNVSDASQDGGYGSETICVCSYGYFSGFSYRSCYCNSMGYAGNPFLPGGCVDIDECKLEIGRKRCKDQSCVNKPGWFTCEPKKPGQIKPVFQGKSQFDFILNVVLKILLFCVLIGSALLLFAFGIFGLYKFIKKQRRSSRMRVFFRRNGGMLLKQQLARKEGNVEMSKIFSSNELEKATDNFNTNRVLGQGGQGTVYKGMLVDGRIVAVKRSKAMDEDKVEEFINEVVVLAQINHRNIVKLLGCCLETEVPVLVYEFVPNGDLCKRLRDECDDYIMTWEVRLHIAIEIAGALSYLHSAASFPIYHRDIKTTNILLDEKYQVKVSDFGTSRSVTIDQTHLTTQVAGTFGYVDPEYFQSSKFTDKSDVYSFGVVLVELITGKNPSSRVQSEENRGFAAHFVAAVKENRFLDIVDERIKDECNLDQVMAVAKLAKRCLNRKGKKRPNMREVSVELERIRSSSYKSEIHNDDDDDDDDDDEDDQAMELNIEETWDVGMTAPASMFNNGSPASDVEPLVPLRTW

SEQ ID NO: 493 - DNA, 1926 bp, Arabidopsis thaliana
  AT1G16110.1
atgaagaagactaagacttaccaagtcttctgtattgctgcactctctgtcctaactctgcagcttatcaatggttcatcagcagcaacacctccacctccaaatagtaattcttcaacttcttgtaacagagcctgtggaggagtctcaattccgttcccgttcggaatcgggaaggattgttatctcaatggctggtatgaggttatctgcaacacttccacttccgggtcgtctggcacaacggttccgttcctctcacggatcaatagcgaagtggtgaacatctctcttccagatggtaagaaactatatggagtagttcacatcaaaggtccagtgacatcgttgggttgctctagtagtagtagtagcagtcaagtatccgaaatgtcattgccgaatttgaacgtcacaggcaggggaagtccatatttcctcactgatgagaactgcctcgtgatggttggttgtggtacaaaggctttgatgaaggatatagaatcagagatcttgggttgtgaatcgagctgtgaagatagcaagagtagtgaagaagtaacaaactcgaaatgtgacggttacaaatgctgccaggcgagaataccgttggagcgtcctcaggttattggtatcaatatagaaaacactagtgccacaagagggaaagaagggtgtagtgttgcgttcttgactaacaaaaggtatgcgccgatgaatgttaccgagccagaacaattccatgctggtggctacgcagtggttgagctaggttggtactttgatacatcggattcacgctataggaaccccttaggttgtagaaacatgacgcggtacagttcttacagctcctttgataaatgtagttgtgagtatgattacttttctgggatgagttataggatttgctattgcaactatggctacacagggaacccataccttcgacatggctgcatagacatagacgaatgtgaaggacaccacaattgtggagaagggacttgtgtgaacatgcctggaacacatagctgcgagcccaagataacgaaaccggaaaaagcctctgtgcttcaaggtgttcttataagtctaggagtgctgcttttcgtccttggaatcttggggttgtacaaattcattaagaagcgaacgaggatcatccgcaacaaaaactttttcaaacgtaatggtggcttgctgttgaaacaacaactaattacaaagaacggaaatgttgatatgtcaaggatatttagctcaaaagagttgaagaaagctactgataacttcagcatgaacagggtgcttgggcaagggggtcaaggaactgtgtacaagggaatgttggcggaagggagaatcgttgcggttaaaagatcgaaagttgtgggtgaaggcaagatggaagagttcatcaatgaagtcgtacttctctcacaaattaaccataggaacattgtgaaactcttgggatgttgtctagagactgaagttcctgtcttggtttacgaatatattcctaatggagatctgttcaagcgtcttcatgaaaaatctgaatccaatgattacacgatgacttgggaagtacgtcttcgtatagctatagagatagcgggagctctttcatacatgcactcagctgcatcgattccaatataccacagagatatcaagactaccaatatactattagatgaaaaatatagagccaaagtatctgatttcggaacttcaagatccataaccattgctcaaactcatctaacaacgttagttgcaggcacttttgggtatatggatccggagtactttttatcaagccaatatactgacaagagcgatgtttacagtttcggggtggtcttggtggagctcataaccggagaaaaaccactgtcaaggaagaggattggcaac

SEQ ID NO: 494 - protein, 642 aa, Arabidopsis thaliana
  AT1G16110.1
MKKTKTYQVFCIAALSVLTLQLINGSSAATPPPPNSNSSTSCNRACGGVSIPFPFGIGKDCYLNGWYEVICNTSTSGSSGTTVPFLSRINSEVVNISLPDGKKLYGVVHIKGPVTSLGCSSSSSSSQVSEMSLPNLNVTGRGSPYFLTDENCLVMVGCGTKALMKDIESEILGCESSCEDSKSSEEVTNSKCDGYKCCQARIPLERPQVIGINIENTSATRGKEGCSVAFLTNKRYAPMNVTEPEQFHAGGYAVVELGWYFDTSDSRYRNPLGCRNMTRYSSYSSFDKCSCEYDYFSGMSYRICYCNYGYTGNPYLRHGCIDIDECEGHHNCGEGTCVNMPGTHSCEPKITKPEKASVLQGVLISLGVLLFVLGILGLYKFIKKRTRIIRNKNFFKRNGGLLLKQQLITKNGNVDMSRIFSSKELKKATDNFSMNRVLGQGGQGTVYKGMLAEGRIVAVKRSKVVGEGKMEEFINEVVLLSQINHRNIVKLLGCCLETEVPVLVYEYIPNGDLFKRLHEKSESNDYTMTWEVRLRIAIEIAGALSYMHSAASIPIYHRDIKTTNILLDEKYRAKVSDFGTSRSITIAQTHLTTLVAGTFGYMDPEYFLSSQYTDKSDVYSFGVVLVELITGEKPLSRKRIGN

SEQ ID NO: 495 - DNA, 2190 bp, Arabidopsis thaliana
  AT1G16120.1
atgaagacaaagactagcatcttccaatttattgtagcatctgtccttactctgctcatcaatgactcatcagcagcaacacctccacctccaattagcaattcttcaacgtcttgtaacaaaacctgtggaggaatctcgatcccgttcccattcggaattggcgggaaagattgttatctcaacggttggtacgaggttatctgcaacacaaccacttccgattctaacacaactgttcctttactctctatgatcaatcgggaagtggtgaatatctctctcccagacagtaacgaaccatacggacttgttcaaatcaaaggtcctgtgacatcgttgggttgttctagtaatactagtgaaggaccccaaaactcgctcccggttttgaatgtcacaggtaagggcagcccatatttcctgaccgacgagaaccgtcttgtggcggttggttgtggtataaaggcattgatgacagatacagaatcagagatcttgggttgtgaatcgagctgcgaacacagaaagagtggtgaagaagtaacaaatttgatctgtactggttacagatgctgccaggcgaggctaccggtggggcgtcctcaggctataaccgtaaatatagagaactctagtggaggagaagaaacgtgcaaagttgcgttcttgacggacaagaggtattcgccgtctaatgttacagagccagaacagtttcataacaatggatatgtggtgctagagttaggatggtactttgccacttcgaactctcgctttaagagcctcttgggttgtacaaatatgagccgaaaaggttctgggttctcggatgataattgcagttgcgagtatgattacttctccgggatgagttataggaattgttattgcgactatggctacacagggaacccataccttcgaggtggctgcgtagatactgattcatgcgaaggaaatcacaactgtggggaagatgctcattgtgttaacatgcctggaccaatgtccatgtgcaggcctaaccccaagataaccaaacctaccaaacccccggtgcttcaaggcattcttataggtttgtcaggattagtattttttgttgggctattctggctatttaaactcataaagaagcgaaggaacatcaaccgcagcaagaagtttttcaaacggaacggaggcttgctgttgaaacaacaattaactacaaaggacggaaatgtagaaatgtctaagattttcagttcaaaggagttaagaaaagccactgataacttcagcatagatagagtgcttgggcaaggcggtcaaggcactgtgtacaaaggaatgttggtagatgggagcatcgttgcggttaaaagatccaaagttgtggatgaagacaaaatggaagagtttatcaatgagattgttcttctgtcacaaatcaatcaccgcaacattgtgaaactcttgggatgttgcttggagacagaagttccaatcttggtgtacgaatatattcccaatggagatctgttcaagcggcttcatgatgaatctgatgattacaccatgacttgggaagtgcggcttcgcatagccatagagatagcaggagctcttacatacatgcactcagctgcaagttttccaatattccatagagatattaagactaccaatatcctactggacgagaaataccgagccaaagtgtctgactttggaacttcaagatcagtaaccttagatcaaactcacttgacaacattagttgcaggaacttttggttacatggatccagagtacttcttgtcaagccaatacactcacaagagcgatgtttatagtttcggggtcgtcttggtggagctcataaccggagaaaaaccattgtcccgtgtccggtctgaagaaggtagaggcttggcaactcatttcctcgaggccatgaaagagaacagagtgattgacataattgatattcggatcaaagacgaaagcaaactggagcaagtaatggcggtagcaaaactcgccagaaaatgtcttaaccggaaagggaagaaccggccaaacatgaaagaggtttcaaatgagctagagaggatccgttcatcacccgaagatttagatgtccgtaccgaaaacgaagacgaagaagaggatcaaccaatggcaatcaacaacaaaaga

SEQ ID NO: 496 - protein, 730 aa, Arabidopsis thaliana
  AT1G16120.1
MKTKTSIFQFIVASVLTLLINDSSAATPPPPISNSSTSCNKTCGGISIPFPFGIGGKDCYLNGWYEVICNTTTSDSNTTVPLLSMINREVVNISLPDSNEPYGLVQIKGPVTSLGCSSNTSEGPQNSLPVLNVTGKGSPYFLTDENRLVAVGCGIKALMTDTESEILGCESSCEHRKSGEEVTNLICTGYRCCQARLPVGRPQAITVNIENSSGGEETCKVAFLTDKRYSPSNVTEPEQFHNNGYVVLELGWYFATSNSRFKSLLGCTNMSRKGSGFSDDNCSCEYDYFSGMSYRNCYCDYGYTGNPYLRGGCVDTDSCEGNHNCGEDAHCVNMPGPMSMCRPNPKITKPTKPPVLQGILIGLSGLVFFVGLFWLFKLIKKRRNINRSKKFFKRNGGLLLKQQLTTKDGNVEMSKIFSSKELRKATDNFSIDRVLGQGGQGTVYKGMLVDGSIVAVKRSKVVDEDKMEEFINEIVLLSQINHRNIVKLLGCCLETEVPILVYEYIPNGDLFKRLHDESDDYTMTWEVRLRIAIEIAGALTYMHSAASFPIFHRDIKTTNILLDEKYRAKVSDFGTSRSVTLDQTHLTTLVAGTFGYMDPEYFLSSQYTHKSDVYSFGVVLVELITGEKPLSRVRSEEGRGLATHFLEAMKENRVIDIIDIRIKDESKLEQVMAVAKLARKCLNRKGKNRPNMKEVSNELERIRSSPEDLDVRTENEDEEEDQPMAINNKR

SEQ ID NO: 497 - DNA, 2133 bp, Arabidopsis thaliana
  AT1G16160.1
atgaatggctcatcagcagcaacaccaccgccacctccaaacagtaagaattcttcaacttcgtgtaacagaacctgtggaggaatctcgattccgttcccatttggaatcggtgggaaggattgttatctcaacggttggtacgaggttgtctgcaacgccaccacttccgggtcgtccggcacaactgttccattcctgtcgagaatcaacagggaagtggtgaacatctctcttccagaaggtaataatgaacaatacggagtggttcacatcaaaggtcctgtgacttcgttaggttgttcaagtaatactagtcaagtaccccaaaagtcgctaccggatttaaacgtcacgggcaagggcagcccatatttcatcaccgacgagaaccgcctcgtggctgtgggttgcggtactaaggcgttgatgacggatatagaatcagagatcttgggttgtgaatctagctgcaaagatagcaagagtagtcaagaagtaacaaacttgttatgtgacggttacaaatgttgccaggcgaggataccggtggaacgtccacaagcagtaggtgtcaatatagagagctcaggaggagatggatgcaaggttgccttcttgtctagcaagaggtattccccgtcaaatgttactataccagaacagttccatgctggtggctacgtggtggtagagctaggttggtactttgctactacggattcacgctttaggaaccccttgggttgtataaatctgacatattcgggatcttacttatccggtgatagttgcctttgcgagtatggttacttttccgaaatgagttataggaactgctattgctcccttggcttcacagggaatccataccttagaggaggttgcattgacaatgatgattgcaaaggacctaatatctgtgaagaaggcacttgtgtgaacgtgcctggaggctatagatgcgatcccaagcccaagataatcaagccggccaaacccctcgtgctacaaggggttcttttaggtttaatgggactattgttcttagttgttgggacgcttgggttgattatatttataaaaaagagaaggaggatcatcagtagcaggaagttcttcaaacgtaatggaggcttgttgttaaaacaacaactaactactacaaatgacggtaatgtagacatgtcaaggctatttagctcagaagagttgaagaaagccaccgataactttagcgtgaagagggtgcttgggaaaggcagtcaaggaactgtgtataaggggatgatggtggatggcaagatcattgcggttaaaagatcaaaagttgtcgatgaagataagctcgaaaagttcatcaatgagatcatccttctttcacagattaaccataggaatattgtgaaactaataggatgttgcttggaaacagaggttccgatcttggtttacgaatatattcccaatggagatatgttcaagcgccttcatgatgaatccgacgattatgcgatgacttgggaagtgcgtcttcgcatagccatagagatcgcgggagctctaacatacatgcactcagctgcatcatttccaatataccacagagatatcaagactaccaatatcctattggatgaaaaatacggagctaaggtttctgatttcggaacatcaagatcggtaaccattgatcaaactcacctgacaacaatggttgcaggaacttttgggtacatggatccagagtacttcctatcaagccaatatactgacaagagcgatgtttatagtttcggggttgtcctggtagagctcataactggagaaaaaccgttgtcccgaattcgttctgaggaaggaagggggttggcaactcatttcctcgaggccatgaaagaaaacagagtgattgacatcattgatattcggatcaaagaagaaagcaagcttgaccaactgatggcagtggcgaaactcgctcgaaagtgtcttagccggaaagggattaaaagaccaaacatgagagaggcttcactcgagctggagaggatccgttcatcacctgaagatttagaggcccatattgaaaatgatgatgaagaggaccaagtcatggagatcagcagagaa

SEQ ID NO: 498 - protein, 711 aa, Arabidopsis thaliana
  AT1G16160.1
MNGSSAATPPPPPNSKNSSTSCNRTCGGISIPFPFGIGGKDCYLNGWYEVVCNATTSGSSGTTVPFLSRINREVVNISLPEGNNEQYGVVHIKGPVTSLGCSSNTSQVPQKSLPDLNVTGKGSPYFITDENRLVAVGCGTKALMTDIESEILGCESSCKDSKSSQEVTNLLCDGYKCCQARIPVERPQAVGVNIESSGGDGCKVAFLSSKRYSPSNVTIPEQFHAGGYVVVELGWYFATTDSRFRNPLGCINLTYSGSYLSGDSCLCEYGYFSEMSYRNCYCSLGFTGNPYLRGGCIDNDDCKGPNICEEGTCVNVPGGYRCDPKPKIIKPAKPLVLQGVLLGLMGLLFLVVGTLGLIIFIKKRRRIISSRKFFKRNGGLLLKQQLTTTNDGNVDMSRLFSSEELKKATDNFSVKRVLGKGSQGTVYKGMMVDGKIIAVKRSKVVDEDKLEKFINEIILLSQINHRNIVKLIGCCLETEVPILVYEYIPNGDMFKRLHDESDDYAMTWEVRLRIAIEIAGALTYMHSAASFPIYHRDIKTTNILLDEKYGAKVSDFGTSRSVTIDQTHLTTMVAGTFGYMDPEYFLSSQYTDKSDVYSFGVVLVELITGEKPLSRIRSEEGRGLATHFLEAMKENRVIDIIDIRIKEESKLDQLMAVAKLARKCLSRKGIKRPNMREASLELERIRSSPEDLEAHIENDDEEDQVMEISRE

SEQ ID NO: 499 - DNA, 2244 bp, Arabidopsis thaliana
  AT1G16130.1
atgaagacagagactcacaaccgtcaatgcattccactagcgatctctgtcctatctctgttcatcaatggcgtctcatcagcaagacaacctccagatcggtgtaacagagtctgcggagaaatatcaattcctttcccgtttggcatcggtgggaaagattgctatctaaacccgtggtacgaggttgtctgtaacagcacaaactctgttccgttcctctcaaggatcaacagagaattggtgaacatctctctcaatggagttgtccacatcaaagctcccgtaacttcctccggctgttctacaggaacatctcagccacttacaccgccgcctttaaacgttgctggccaaggcagcccctatttcctcacggacaagaacctactcgtggcggttggttgcaaattcaaggctgttatggcgggtattacatcgcagatcaccagttgtgagtcgagttgtaacgagagaaacagtagcagccaagaaggaagaaacaaaatctgcaatggttataaatgttgccagacgaggataccagaagggcagccgcaagtaatcagtgtggatatagagatccctcaaggtaacaacacaacaggagaaggaggatgcagagttgcgtttttgacgagcgacaagtattcaagtttaaatgttacagagccagaaaagtttcatggtcatggatacgcggcggtcgagcttggatggttctttgatacttccgattctcgtgatacacaacccataagttgtaaaaatgcgtcagatacaacaccgtacacttccgatacgaggtgtagttgctcatacggctacttttctggattcagctatagggactgctactgtaactccccaggttataaagggaatccgttccttccaggtggttgtgtagacgtggatgaatgtaaactagatataggacgcaaccagtgtaaagatcaaagctgtgtgaatctgcccggttggtttgactgccagcccaagaaaccagagcagctcaagcgggtgattcaaggtgttcttataggttcagcactgttgcttttcgccttcggaatcttcgggttgtacaagttcgtacagaagcggaggaaactaatccgaatgaggaagttcttcagacgtaatggaggtatgttgttaaaacaacagttagctagaaaagaaggcaatgtagagatgtcaagaatattcagctcacatgagttggagaaagctactgataacttcaacaagaatagggttcttgggcaaggaggtcaaggtacagtgtataagggaatgctcgttgatggtagaatcgtcgcagtaaaaaggtcgaaagctgtggatgaagatagggtagaagagttcatcaatgaagttgttgttcttgcgcagatcaatcatagaaatattgttaaacttttggggtgttgtcttgaaacggaagttccagtcttagtttatgagtttgttccaaatggagacttatgcaagcgtcttcatgatgaatctgatgattacacaatgacatgggaggtgcgtcttcacattgctatagagattgcaggagcactttcttatttgcattctgctgcatctttccccatatatcatagagatatcaagactactaatatactcttagatgagagaaaccgagctaaggtgtcggatttcggaacttcaagatcagtaactatagatcaaactcacttgacaactcaagttgcaggcacttttggatatgtggatccagagtactttcaatcaagcaagtttacggaaaaaagtgatgtttatagttttggagttgtccttgtggagctcttaaccggagaaaaaccttcctcccgtgtccggtctgaagaaaacaggggccttgcagctcactttgtcgaagccgtgaaagagaacagagtgcttgacatagttgatgatcggatcaaagatgaatgcaacatggaccaagtaatgtcagtggcaaatctagctagaaggtgtttaaaccgaaaagggaagaagaggccaaacatgagagaggtttcaattgagctggagatgattcgttcatcacattatgattcaggaattcatatagaggacgacgatgaggaagatgatcaagccatggaactcaactttaacgacacttgggaggttggtgcgactgctccagcctccatgtttaacaatgcatcccccacgtctgatgctgagcctctggtgcctttacgaacatgg

SEQ ID NO: 500 - protein, 748 aa, Arabidopsis thaliana
  AT1G16130.1
MKTETHNRQCIPLAISVLSLFINGVSSARQPPDRCNRVCGEISIPFPFGIGGKDCYLNPWYEVVCNSTNSVPFLSRINRELVNISLNGVVHIKAPVTSSGCSTGTSQPLTPPPLNVAGQGSPYFLTDKNLLVAVGCKFKAVMAGITSQITSCESSCNERNSSSQEGRNKICNGYKCCQTRIPEGQPQVISVDIEIPQGNNTTGEGGCRVAFLTSDKYSSLNVTEPEKFHGHGYAAVELGWFFDTSDSRDTQPISCKNASDTTPYTSDTRCSCSYGYFSGFSYRDCYCNSPGYKGNPFLPGGCVDVDECKLDIGRNQCKDQSCVNLPGWFDCQPKKPEQLKRVIQGVLIGSALLLFAFGIFGLYKFVQKRRKLIRMRKFFRRNGGMLLKQQLARKEGNVEMSRIFSSHELEKATDNFNKNRVLGQGGQGTVYKGMLVDGRIVAVKRSKAVDEDRVEEFINEVVVLAQINHRNIVKLLGCCLETEVPVLVYEFVPNGDLCKRLHDESDDYTMTWEVRLHIAIEIAGALSYLHSAASFPIYHRDIKTTNILLDERNRAKVSDFGTSRSVTIDQTHLTTQVAGTFGYVDPEYFQSSKFTEKSDVYSFGVVLVELLTGEKPSSRVRSEENRGLAAHFVEAVKENRVLDIVDDRIKDECNMDQVMSVANLARRCLNRKGKKRPNMREVSIELEMIRSSHYDSGIHIEDDDEEDDQAMELNFNDTWEVGATAPASMFNNASPTSDAEPLVPLRTW

SEQ ID NO: 501 - DNA, 2253 bp, Arabidopsis thaliana
  AT1G79670.1
atgaagagaaggagactttttttctctgttctactctctatcctaactctgttcatcaatggtcctttgataacgacagctcaatctccaccttcttcttcaacttcatgtaaccgtatctgtggaggaatcgagattccttttccttttggaatcggacgaagagactgttttctcaacgactggtacgaggttgtctgtaacagcaccacctccggtaaatccttagctccgttcctctataagatcaacagagaattagttagcatcactcttcgaagcagcatcgacagttcctacggagttgttcacattaaatctccggtgacttcctccggctgttctcaacgacccgtaaagcctcttcctttaaacctcaccggtaaaggaagtccctttttcatcaccgactcgaatcgtctcgtctcagttggttgtgacaacagagcattgattacagacatcgaatctcagatcacaggatgcgaatcgagctgcgacggagataagagtcgtttagacaagatctgcggtggttacacatgttgtcaggcgaagattccggcggatagaccgcaagtaatcggcgttgaccttgaaagctccggtggtaacacaactcaaggaggaaactgtaaagttgctttcttgacgaatgagacttactctccggcgaatgttacagagccggaacaattttatactaatgggtttacggtgattgagcttggttggtactttgatacatcagattctcggttaacgaatcctgtgggttgtgtgaatttgacggaaacagggatttacacgagcgcaccgagctgtgtttgtgagtatggtaacttctctggctttggttacagtaactgttactgcaatcagattggttacagagggaatccttatcttcctggtggatgcattgacattgacgaatgtgaggaaggaaaaggactaagcagctgtggagaactaacttgtgtgaatgttcctggatcgtggaggtgcgagctgaatggagtagggaagatcaagcctctgtttccaggtcttgttctaggttttccactgttgttcttggtacttgggatatggggattgatcaagttcgttaagaagagaaggaagattatccgaaagagaatgttctttaaacgtaatggaggcttgttgttgaaacaacagttaactacaagaggaggtaatgtgcagtcatcgaagatattcagttcgaaagagctggagaaagcgacggataacttcaatatgaacagggttcttgggcaaggaggtcaaggcactgtctacaaaggaatgttggtagatgggcgaattgttgctgtgaaaagatctaaagttttagatgaagataaagttgaggagtttatcaatgaagttggtgttctctcgcagattaaccatagaaatattgtcaaactcatggggtgttgtctcgagacagaggttcctatcttggtttatgaacatattccaaatggagacctattcaagcggcttcaccatgattctgatgattacactatgacttgggatgtgcgattgcgcatctctgttgagattgcaggagcacttgcttacttgcactcggctgcatcaactccggtctatcatagagatgtcaagaccacaaacatacttttggatgagaagtatagagccaaggtatcggatttcgggacctcgagatccataaacgtagatcaaactcacttgactactctagttgcaggtacttttggatacttggatccagagtactttcaaactagccagtttacggataaaagtgatgtttatagttttggggtcgtcttggttgagctcataactggagaaaagccgttttctgtaatgcggcccgaagaaaacagaggacttgtgtctcatttcaatgaggctatgaaacagaacagagttcttgatattgttgattctcggatcaaagaaggttgcacgttggaacaagtgttggctgtggcgaaacttgccagaaggtgtttaagtctaaaagggaagaaacgaccaaatatgagagaggtttcagttgagcttgagaggatccgttcatcacccgaagatttggagttacatattgaagaggaggacgaagaagaatgcgccatggaaatcaacatggatgattcttggagcgtcgacatgactgctccagcttccctctttgatttatcgcccaagttagacgttgaaccgctggttcctcaacgaacatgg

SEQ ID NO: 502 - protein, 751 aa, Arabidopsis thaliana
  AT1G79670.1
MKRRRLFFSVLLSILTLFINGPLITTAQSPPSSSTSCNRICGGIEIPFPFGIGRRDCFLNDWYEVVCNSTTSGKSLAPFLYKINRELVSITLRSSIDSSYGVVHIKSPVTSSGCSQRPVKPLPLNLTGKGSPFFITDSNRLVSVGCDNRALITDIESQITGCESSCDGDKSRLDKICGGYTCCQAKIPADRPQVIGVDLESSGGNTTQGGNCKVAFLTNETYSPANVTEPEQFYTNGFTVIELGWYFDTSDSRLTNPVGCVNLTETGIYTSAPSCVCEYGNFSGFGYSNCYCNQIGYRGNPYLPGGCIDIDECEEGKGLSSCGELTCVNVPGSWRCELNGVGKIKPLFPGLVLGFPLLFLVLGIWGLIKFVKKRRKIIRKRMFFKRNGGLLLKQQLTTRGGNVQSSKIFSSKELEKATDNFNMNRVLGQGGQGTVYKGMLVDGRIVAVKRSKVLDEDKVEEFINEVGVLSQINHRNIVKLMGCCLETEVPILVYEHIPNGDLFKRLHHDSDDYTMTWDVRLRISVEIAGALAYLHSAASTPVYHRDVKTTNILLDEKYRAKVSDFGTSRSINVDQTHLTTLVAGTFGYLDPEYFQTSQFTDKSDVYSFGVVLVELITGEKPFSVMRPEENRGLVSHFNEAMKQNRVLDIVDSRIKEGCTLEQVLAVAKLARRCLSLKGKKRPNMREVSVELERIRSSPEDLELHIEEEDEEECAMEINMDDSWSVDMTAPASLFDLSPKLDVEPLVPQRTW

SEQ ID NO: 503 - DNA, 2376 bp, Arabidopsis thaliana
  AT1G69730.1
atgagttcttataatagtttttctctttggattctcttctctttgcaactctgttttattctagattctgcggatcgcacagtttccttatgtcaacccgactgtggaggaatcaagatcccgtacccctttggaatgggaaagggttgttatctggagaagtggtacgaaattacttgtaatacctctacttctggaaagctcgtcccttatctttccgtgatcaacaaggaagttgtgggtatctctcttccgactgaaggcaggggttctagatataacaatccataccagtccgttaacattaaaaacccaatagcctcaaaggagtgctcaagcaatggagaagagcttggatcacttttgaatttgacgggtacccctttttatgttagccagcacaatgaactggtagcggttggttgcaacaacacggcatcgctgacaaatgtgaagccaagcatagtgcaatgcacatcaagctgcagcacaaaaccccatacgcatatcaaagattatcttgcagtactaaattgtcagaattacaatggctacgagaagaattgtaatgaggacagcagtatggatgaaagcattatggatgaaacaagctgcaatggtattggatgctgcaatgcatacatgcgcggcggtagtattcaacagattgttggtgtcacaatagaaaacaccataacgagagggtgcaaagttgccttcttgacaaacaaggcagaatatttgtctaataaatctgatccgcaaaagcttcatgctagaggatacagtacggtcgagctaggatggtttatccatacgacgaatcattcgtttataaagtctctgggatgctatagtgtaaaagagtacaacaatgaaagatacactagtacccagagaagaattaacataacaagttgtatatgcgatgacaatgcttatctaagctatgcaagatgctcatgcactaggggtttccaaggcaacccataccgtttaggcggatgcaaagatatcaatgaatgtaaagaagaagagggcatgacttactgtgggaccaacaaatgtgtcaatttgcaaggacactttaaatgtgtgtacaacaatcatcggccacttgctatagggcttggtgctagttttggctcattgatctttgttgttggaatatacttgttatacaaatttattaaaaagcaaaggaagttaaaccaaaagaagaagttcttcaagcgtaatggtggtctattgttgcaacaacaattgatttcaacagtaggcatggtcgaaaagacaatagtgttcagttcgcgagagttggagaaagctactgaaaacttcagttcaaacagaatacttggccagggtggtcaaggtacagtgtacaagggaatgcttgtcgatggaagaatcgttgcagtaaaaaagtccaaagtcgtggacgaagacaagctagaagagttcatcaatgaggttgtcattctttcacagatcaaccacaggaacatcgtgaaactcttgggatgttgccttgagacaaaagtccctgttctcgtctacgagtttattcctaatggtaaccttttcgaacatcttcatgatgagtttgatgaaaacattatggctacttggaatatacgtctccgcattgctatagatattgcaggagctctctcatacttgcactcgtctgcatcgtctccaatctatcacagagacgtcaagtctacaaacataatgttggatgagaaatatcgagccaaggtgtctgattttggaacgtcaagaacggtgacagtggatcatacccacttgacaacggtagtttcaggtacggtgggatatatggatccagagtactttcagtctagccaattcacagacaaaagtgatgtctatagcttcggggtcgtgctagtggagctaataactggagaaaagtcgatttctttcttgaggtctcaagaaaacaggacattggcaacttatttcattcttgcaatgaaagaaaacaaactcttcgatattatcgatgctcgaataagagatggttgcatgttgagtcaagtgactgcaacggcaaaagttgcaaggaagtgtctcaatctgaaagggagaaaacgaccaagcatgagagaagtgtcgatggagcttgatagtattcgtatgccttgtggagatatgcaactgcaagaatgtgttagcgaaaacgaggaaggggaagaacaaaacaaaggacttgtggaagatatcatgagggcagaatcaaggagcaaagagtttgttaccgctccagcttctcactacaataatattgctgctgcctcatcttcttcgtggtcagatgttgaaccattgtttcctcttcaaacacgg

SEQ ID NO: 504 - protein, 792 aa, Arabidopsis thaliana
  AT1G69730.1
MSSYNSFSLWILFSLQLCFILDSADRTVSLCQPDCGGIKIPYPFGMGKGCYLEKWYEITCNTSTSGKLVPYLSVINKEVVGISLPTEGRGSRYNNPYQSVNIKNPIASKECSSNGEELGSLLNLTGTPFYVSQHNELVAVGCNNTASLTNVKPSIVQCTSSCSTKPHTHIKDYLAVLNCQNYNGYEKNCNEDSSMDESIMDETSCNGIGCCNAYMRGGSIQQIVGVTIENTITRGCKVAFLTNKAEYLSNKSDPQKLHARGYSTVELGWFIHTTNHSFIKSLGCYSVKEYNNERYTSTQRRINITSCICDDNAYLSYARCSCTRGFQGNPYRLGGCKDINECKEEEGMTYCGTNKCVNLQGHFKCVYNNHRPLAIGLGASFGSLIFVVGIYLLYKFIKKQRKLNQKKKFFKRNGGLLLQQQLISTVGMVEKTIVFSSRELEKATENFSSNRILGQGGQGTVYKGMLVDGRIVAVKKSKVVDEDKLEEFINEVVILSQINHRNIVKLLGCCLETKVPVLVYEFIPNGNLFEHLHDEFDENIMATWNIRLRIAIDIAGALSYLHSSASSPIYHRDVKSTNIMLDEKYRAKVSDFGTSRTVTVDHTHLTTVVSGTVGYMDPEYFQSSQFTDKSDVYSFGVVLVELITGEKSISFLRSQENRTLATYFILAMKENKLFDIIDARIRDGCMLSQVTATAKVARKCLNLKGRKRPSMREVSMELDSIRMPCGDMQLQECVSENEEGEEQNKGLVEDIMRAESRSKEFVTAPASHYNNIAAASSSSWSDVEPLFPLQTR

SEQ ID NO: 505 - DNA, 2307 bp, Arabidopsis thaliana
  AT1G79680.1
atgagctctaattgtagttgttctcttttgagtctcttctctctccttctgatcattgatctcaccgttgctagctcttgtcctaagacatgtggaggaatcgacatcccgtacccgtttggaatcggaacgggttgctatctcgagaaatggtacgagattatttgtgtcaacaactctgttccttttctttccatcattaacagggaagttgtgagtatctctttttcggatatgtatcgccggttctttaacgtaggctacgggtcaattcgcataagaaacccaatagcttcaaagggatgctcaagtggcggacaagagtttggatcacttttaaatatgacaggttaccctttttaccttggcgacaacaatatgctcatagcggttggctgcaacaacacggcgtcgttgacaaatgtcgagccaagtattgtgggatgcgagtctacttgcagcacaaatcaagatatacctataaatgattatctcggggtactctactgtaatgctaggtatggcgattccgagtattgtaaaaatatttccattatgaatgatacaagctgcaacggtattggatgctgcaaggcaagtttgcccgctaggtatcaacagattattggtgtggaaatagatgatagtaacacagaatccaagggatgcaaagttgccttcataacagacgaggaatactttttgtcaaatggatctgacccggagaggcttcatgctaatggatatgatacggttgacctaagatggttcatccatacggcgaatcattccttcataggctctctaggatgcaaaagtatagacgagtacacaattctaagaagagacaatcgtgaatacggaataggttgcctttgcgactataactctacaactacaggctatgcaacatgttcatgcgctagtggtttcgaaggcaacccatatattcctggcgaatgcaaagatattaatgaatgcgtaagaggcattgatggaaacccagtctgtacggcaggcaagtgtgtcaatttgctgggcggttatacgtgtgagtacacaaatcatcgaccacttgttatagggcttagcactagtttcagcacattggtattcattggtggaatatactggttatacaaatttattagaagacaaaggaggttaaaccaaaagaagaaattctttaagcgtaatgggggtttattgttgcaacaacaattgactacaactgaaggcaacgtggacagtacaagagtgttcaactcaagagagttggagaaagccaccgaaaactttagcttaaccagaatactaggcgaaggaggtcaaggtacagtgtacaagggaatgcttgtagacggtagaatagtagcagtaaagaagtccaaagtcgtagacgaagacaagctagaagagttcatcaacgaagtcgtcattctctcacaaatcaaccataggaacatcgtaaaactcttggggtgttgcctagagacagatgtccctattctagtctacgaattcattcctaatggtaacctttttgagcatcttcatgatgattccgatgattatacgatgactacttgggaagtgcgtcttcgtattgctgtagatattgcaggagcgctttcatatttgcactcggctgcatcatctccaatctatcacagagacatcaagtctacaaacataatgttagatgagaaacatcgagccaaagtgtccgattttggtacttcaagaacggtgaccgtggatcatacccacctcactacagtagtttcaggcacggtgggatatatggatccagagtatttccagtcgagccaattcacagacaaaagtgatgtttatagctttggagtcgtgctagcggagctaatcactggagaaaaatcagtctcttttctgcgatctcaggaatataggacattggcaacttatttcactcttgcaatgaaagagaacagactctccgacattattgatgctcgaataagagatggttgtaagttgaatcaagtgacagcagccgcaaaaattgcaaggaaatgtttgaatatgaagggaaggaaacgaccaagtatgagacaagtatcgatggaattggagaagattcgttcatattctgaagatatgcagccgtatgagtatgctagcgaaaacgaagaagaaaaaaaagaaacattagtggacgttaacgtagagtcgagaaactacgtgagtgttaccgccgcatcatctcaatacagcattgctacaacatcttcgtcgcggtcagatgttgaaccattgtttcctcgg

SEQ ID NO: 506 - protein, 769 aa, Arabidopsis thaliana
  AT1G79680.1
MSSNCSCSLLSLFSLLLIIDLTVASSCPKTCGGIDIPYPFGIGTGCYLEKWYEIICVNNSVPFLSIINREVVSISFSDMYRRFFNVGYGSIRIRNPIASKGCSSGGQEFGSLLNMTGYPFYLGDNNMLIAVGCNNTASLTNVEPSIVGCESTCSTNQDIPINDYLGVLYCNARYGDSEYCKNISIMNDTSCNGIGCCKASLPARYQQIIGVEIDDSNTESKGCKVAFITDEEYFLSNGSDPERLHANGYDTVDLRWFIHTANHSFIGSLGCKSIDEYTILRRDNREYGIGCLCDYNSTTTGYATCSCASGFEGNPYIPGECKDINECVRGIDGNPVCTAGKCVNLLGGYTCEYTNHRPLVIGLSTSFSTLVFIGGIYWLYKFIRRQRRLNQKKKFFKRNGGLLLQQQLTTTEGNVDSTRVFNSRELEKATENFSLTRILGEGGQGTVYKGMLVDGRIVAVKKSKVVDEDKLEEFINEVVILSQINHRNIVKLLGCCLETDVPILVYEFIPNGNLFEHLHDDSDDYTMTTWEVRLRIAVDIAGALSYLHSAASSPIYHRDIKSTNIMLDEKHRAKVSDFGTSRTVTVDHTHLTTVVSGTVGYMDPEYFQSSQFTDKSDVYSFGVVLAELITGEKSVSFLRSQEYRTLATYFTLAMKENRLSDIIDARIRDGCKLNQVTAAAKIARKCLNMKGRKRPSMRQVSMELEKIRSYSEDMQPYEYASENEEEKKETLVDVNVESRNYVSVTAASSQYSIATTSSSRSDVEPLFPR

SEQ ID NO: 507 - DNA, 2133 bp, Populus trichocarpa
  POPTR_0001s03190.1
atgattcctcgtcgtgtctctctaatttttttcctgctatttctagttcctgaaatagcaactgtatcagcactaattatggcgaggcctaattgtacagagacttgtggaaacattaccatcccttttccatttggaataggaacaggttgttacatgaatgactggttctcagttcattgcaacgaaacaactgcggattctcccagcagggctttcttaagcagaatcaacatggaggtcttcaagatttcattagagagcagtgtggttcgagtaaacagtccaataatttcctccggctgttctggtagaggtgccaacttagccattaatatgactggaagtcctttctccttctcttcctcaaatatcttcaccgcaatgggctgcaacaatcgtgctttattgaacggaattgagccagaaattgttgggtgcacgtcaacttgcggtgctagtacagaaggtaaagaaaatagctactgttctggtaacaattgctgccagaccacaattccctcgagtctccaggtggtcaacgcgagtttggggaccccagagcaccctattaatgatcaaggcaggaatcaatgcaaggtagcttttatagtacaggaaaaatggttccggaacaatatatcaagtcccgaggtggtgcaagatatgcaatatgttccagtaatcctggattggaattctgatgcaatgtattgcgacccccctatgaacttaacttctggtaggtcgggtttgagaacagtaacattgtattccaattcaactatttgtagttgcaactggggctatgatggcaatccgtatcttcctgatggatgcactgatatcgatgagtgcaaaattcccaggggaaattcgtgttcggggatgacaaaatgtgtgaatgtgccgggtgggttcaagtgcgagcttgacaaagctaagatcactttcttgagtgcggccactggattgttgctgctgcttgttggtatctggcggttatataaacttgtaaaaaaaaggaagaacattgaactgaagaagaagttcttcaaacgaaatggtggtttattgctgcagcaacaattatcctcaagtgatggaagcattcagaaaacaaaaatatttacttccaaggagttggaaaaggcaaccgatcgttttaatgataatagaatacttggtcaaggtggccaaggaactgtttataaaggaatgcaagcagatggaatgatcgttgctgttaaaaaatccatattagtggatgaagaaaagttggaagaatttatcaatgaggtcgtcatcctttcacaagtcaatcatagaaatgtggtcaagttgctaggttgttgtttagagacggaggttcctctgctagtctatgaattcattcccaatggaaatctctttgagtatattcatgaccagaaggaggagttcgagttttcatgggaaatgcgactaaggattgctactgaagttgctagggcactttcttatcttcattccgcagcatccattccggtttatcaccgtgatatcaagtctacaaatataatgttagatgagaagttcagagcaaaagtatcagatttcggaacttcaaggtcaatcgccattgatcaaactcatctaaccactcatgttcaaggcacttttggatacttggacccagagtacttccagtctagccagtttaccggaaaaagtgacgtctacagttttggtgttgttcttgcagagctcttgagtgggcaaaaaccaatttcttatgaaaggtcagaagaaaggagaagtttagccactcattttattcttttgatggaagagaacaagatatttgatattcttgatgaacgacttatggggcaggaccgtgaagaagaagttatcgcagtcgccaatcttgcaagaagatgcttgaacttgaatggaaggaaacgcccaacaatgagagaagtcgcgttggagttggagcagattcggctgtcaaaaggagctcttcatgcacaacaaagtagcaaagagcttgaaaacatcagggatgaagttcccaatgtatgggaaattgctggacctactacttcagtaacaattggcgattttagaaatctttggatgtccaaacaa

SEQ ID NO: 508 - protein, 711 aa, Populus trichocarpa
  POPTR_0001s03190.1
MIPRRVSLIFFLLFLVPEIATVSALIMARPNCTETCGNITIPFPFGIGTGCYMNDWFSVHCNETTADSPSRAFLSRINMEVFKISLESSVVRVNSPIISSGCSGRGANLAINMTGSPFSFSSSNIFTAMGCNNRALLNGIEPEIVGCTSTCGASTEGKENSYCSGNNCCQTTIPSSLQVVNASLGTPEHPINDQGRNQCKVAFIVQEKWFRNNISSPEVVQDMQYVPVILDWNSDAMYCDPPMNLTSGRSGLRTVTLYSNSTICSCNWGYDGNPYLPDGCTDIDECKIPRGNSCSGMTKCVNVPGGFKCELDKAKITFLSAATGLLLLLVGIWRLYKLVKKRKNIELKKKFFKRNGGLLLQQQLSSSDGSIQKTKIFTSKELEKATDRFNDNRILGQGGQGTVYKGMQADGMIVAVKKSILVDEEKLEEFINEVVILSQVNHRNVVKLLGCCLETEVPLLVYEFIPNGNLFEYIHDQKEEFEFSWEMRLRIATEVARALSYLHSAASIPVYHRDIKSTNIMLDEKFRAKVSDFGTSRSIAIDQTHLTTHVQGTFGYLDPEYFQSSQFTGKSDVYSFGVVLAELLSGQKPISYERSEERRSLATHFILLMEENKIFDILDERLMGQDREEEVIAVANLARRCLNLNGRKRPTMREVALELEQIRLSKGALHAQQSSKELENIRDEVPNVWEIAGPTTSVTIGDFRNLWMSKQ

SEQ ID NO: 509 - DNA, 2223 bp, Populus trichocarpa
  POPTR_0001s03210.1
atgattcctcgcagtgtctctctaatttttttcctgctatttctagttcctgaaatagcacctgtatcagcacttatgacgaagcctaattgtacagagacttgtggaaacattagcatctcttttccatttggaataggaacaggttgttccatgaatgactggttctcagttgattgcaacaaaacaactgcggattctcccagcagggctttcttaagcagaatcaacatggaggtcttggagatttcattagggtacagtactattcctctggttagagtaaacagtccaataatttcctccggctgtgctggtagcggtgccaacttagccattaatatgactggaagtcctttcgccttctcttcctcaaatatcttcatcgcaatgggctgcaacaatcgtgctttattgagccgaattgagccagaaattgttgggtgcacgtcaacttgcggtgctaataatttgactagttctagtgcagaaggtaaagaaaatagttactgttctggtaacaattgctgccagaccacaattccctcgagtctccaggtgttcgacgcgagtttggggaccccagagcaccctattaatgatcaaggcagaaatcaatgcaagacagcttttatagtagaggaagaatggttccggaacaatatatcaagtcccgaggtggtgcgagatatgcaatatgttccagtaatcctggattgggaaatgtattatggtactgacatccctgaagatgtaacgaattctgatgcaaagaattgctggcggggtttgacaatgtggggtttgagaacagtaacattgtattccaattcaactacttgtagttgcaacccgggctatgatggcaatccgtatcttcctgatggatgcactgatatcgatgagtgcaaaattcccggggaaaattcgtgttcggggatgacaaaatgtgtgaataggccggggcggtacaagtgcgagcttgacaaagctaagatcactttcttgattctaggtgcggccactggattgttgctgctgcttgttggtatttggcggttatataaacttgtaaaaaaaaagaagaacattgaactgaagaagaagttcttcaaacgaaatggtggtttattgctgcagcaacaattatcctcaagtgatggaagcattcagaaaacaaaaatatttacttccaaggagttggaaaaggcaaccgatcgttttaatgataatagaatacttggtcaaggtggccaaggaactgtttataagggaatgctagcagatggaatgatcgttgctgttaaaaaatccaaaatagtggatgaagaaaagttggaagaatttatcaatgaggtcgtcatcctttcacaactcaatcatagaaatgtggtcaagttgctaggttgttgtttagagacggaggttcctctgctagtctatgaattcattcccaatggaaatctctttgagtatattcatgaccagaaggaggagttcgagttttcatgggaaatgcgactaaggattgctactgaagttgctagggcactttcttatcttcattccgcagcatccattccggtttatcaccgtgatatcaagtctacaaatataatgttagatgagaagttcagagcaaaagtatcagatttcggaacttcaagatcgatcgccattgatcaaactcatctaaccactcatgttcaaggcacttttggatacttggacccagagtacttccagtctagccagtttaccggaaaaagtgacgtctacagttttggtgttgttcttgcagagctcttgagtgggcaaaaaccaatttcttatgaaaggccggaggacaggagaagcttagccactcattttattcttttgatggaagagaacaagatatttgatattcttgatgaacgacttatggagcaggaccgtgaagaagaagttatcgcagtcgctaatcttgcaagaagatgcttgaacttgaatggaaggaaacgaccaacaataagagaagtcgcgatagagttagagcagattcggctgtcaaaaggagctcttcatgcacaacaaagtagtaaagagcttgaaaacatcagggatgaagttcccaacgtatgggaaattgctggacctactacttcagtaacaattggcgattttagaaatggcacggctccatctttggatgtccaaccattgatttctcacgaaacatgg

SEQ ID NO: 510 - protein, 741 aa, Populus trichocarpa
  POPTR_0001s03210.1
MIPRSVSLIFFLLFLVPEIAPVSALMTKPNCTETCGNISISFPFGIGTGCSMNDWFSVDCNKTTADSPSRAFLSRINMEVLEISLGYSTIPLVRVNSPIISSGCAGSGANLAINMTGSPFAFSSSNIFIAMGCNNRALLSRIEPEIVGCTSTCGANNLTSSSAEGKENSYCSGNNCCQTTIPSSLQVFDASLGTPEHPINDQGRNQCKTAFIVEEEWFRNNISSPEVVRDMQYVPVILDWEMYYGTDIPEDVTNSDAKNCWRGLTMWGLRTVTLYSNSTTCSCNPGYDGNPYLPDGCTDIDECKIPGENSCSGMTKCVNRPGRYKCELDKAKITFLILGAATGLLLLLVGIWRLYKLVKKKKNIELKKKFFKRNGGLLLQQQLSSSDGSIQKTKIFTSKELEKATDRFNDNRILGQGGQGTVYKGMLADGMIVAVKKSKIVDEEKLEEFINEVVILSQLNHRNVVKLLGCCLETEVPLLVYEFIPNGNLFEYIHDQKEEFEFSWEMRLRIATEVARALSYLHSAASIPVYHRDIKSTNIMLDEKFRAKVSDFGTSRSIAIDQTHLTTHVQGTFGYLDPEYFQSSQFTGKSDVYSFGVVLAELLSGQKPISYERPEDRRSLATHFILLMEENKIFDILDERLMEQDREEEVIAVANLARRCLNLNGRKRPTIREVAIELEQIRLSKGALHAQQSSKELENIRDEVPNVWEIAGPTTSVTIGDFRNGTAPSLDVQPLISHETW

SEQ ID NO: 511 - DNA, 2103 bp, Populus trichocarpa
  POPTR_0001s07550.1
atggcgaggcctaattgtacagagacttgtggaaacattagcatcccttttccatttggaataggagcaggttgttacatgaatgactggttctcagttgattgcaacaaaacaactgcggattctcccagcagggctttcttaagcaggatcaacatggaggtcttggagatttcaataagggacatgagtaatatggttcgagtaaacagtccaataatttcctccggctgttctggtagaggtgccaactcagccattaatatgactggaagtcctttcgccttctcttcctcaaatatcttcaccgcaatgggctgcaacaatcgtgctttattgaacggaattgagccagaaattgttgggtgcacgtcaacttgcggtgctaataatttgactagtaattctagtgcagaaggtaaagaaaatagttactgttctggtaacaattgctgccagaccacaattccctcgagtctccaggtgttcaacgcgagtttggggaccccagatcaccctattaatgatcaaggcaggaatgaatgcaaggtagcttttatagtagaggaagaatggttccggaacaatatatcaagtcccgaggtggtgaaagatatgcaatatgttccagtaatcctggattgggatatgtattatggtactgacatccctgaaggtgtaaagaattctgatgcaaatacagtaacatattccaattcaactacttgttggtgcttcccgggctatgatggcaatccgtatcttcctgatggatgcactgatatcgatcagtgcaaaattcccgggttaaatttgtgttcggggatgacaaaatgtgtgaatgtgccggggttgtacaagtgcgagcttgacaaagctaagatcacattcttgagtgcggccactggattgttactgctgcttgttggtatttggcggttatataaacttgtaaaaaaaaggaagaacattgaactgaagaagaagttcttcaaacgaaatggtggtttattgctgcagcaacaattatcatcaagtgatggaagcattcagaaaacaaaaatatttacttccaaggagttggaaaaggcaaccgatcgttttaatgataatagaatacttggtcaaggtggccaaggaactgtttataaaggaatgcaagcagatggaatgatcgttgctgttaaaaaatccaaaatggtggatgaagaaaagttggaagaatttatcaatgaggtcgtcatcctttcacaagtcaatcatagaaatgtggtgaagttgctaggttgttgtttagagacggaggttcctctgctagtctatgaattcattcccaatggaaatctctttgagtatattcatgaccagaaggaggagttcgagttttcatgggaaatgcgactaaggattgctactgaagttgctagggcactttcttaccttcattccgcagcatccattccgatttatcaccgtgatattaagtctacaaatatactgttagatgagaagttcaaagcaaaagtatcagatttcggaacttcaagatcgatcaccattgatcaaactcatctaaccactcatgttcaaggcacttttggatacttggacccagagtacttccagtctagccaatttaccggaaaaagtgacgtctacagttttggtgttgttcttgcagagctcttgagtgggcaaaaaccaatttcttatgaaaggccggaagagaggagaggtttagccactcattttattcttttgatggaagagaacaagatatttgatattcttgatgaacgacttatggggcaggaccgtgaagaagaagttatcgcagtcgctaatcttgcaagaagatgcttgaacttgaatggaaggaaacggccaacaatgagagaagtcgcgatagaattggagcagattcggctgtcaaaaggagctcttcatgcacaacaaagtagtaaagaacttgaaaacatctgggaggaagttcccaacgtatgggaaattgctgggcctactacttcagtaacaattggcgattttagaaatggcacggctccatctttggatgtccaaacattgatttctcacgaaacatgg

SEQ ID NO: 512 - protein, 701 aa, Populus trichocarpa
  POPTR_0001s07550.1
MARPNCTETCGNISIPFPFGIGAGCYMNDWFSVDCNKTTADSPSRAFLSRINMEVLEISIRDMSNMVRVNSPIISSGCSGRGANSAINMTGSPFAFSSSNIFTAMGCNNRALLNGIEPEIVGCTSTCGANNLTSNSSAEGKENSYCSGNNCCQTTIPSSLQVFNASLGTPDHPINDQGRNECKVAFIVEEEWFRNNISSPEVVKDMQYVPVILDWDMYYGTDIPEGVKNSDANTVTYSNSTTCWCFPGYDGNPYLPDGCTDIDQCKIPGLNLCSGMTKCVNVPGLYKCELDKAKITFLSAATGLLLLLVGIWRLYKLVKKRKNIELKKKFFKRNGGLLLQQQLSSSDGSIQKTKIFTSKELEKATDRFNDNRILGQGGQGTVYKGMQADGMIVAVKKSKMVDEEKLEEFINEVVILSQVNHRNVVKLLGCCLETEVPLLVYEFIPNGNLFEYIHDQKEEFEFSWEMRLRIATEVARALSYLHSAASIPIYHRDIKSTNILLDEKFKAKVSDFGTSRSITIDQTHLTTHVQGTFGYLDPEYFQSSQFTGKSDVYSFGVVLAELLSGQKPISYERPEERRGLATHFILLMEENKIFDILDERLMGQDREEEVIAVANLARRCLNLNGRKRPTMREVAIELEQIRLSKGALHAQQSSKELENIWEEVPNVWEIAGPTTSVTIGDFRNGTAPSLDVQTLISHETW

SEQ ID NO: 513 - DNA, 2217 bp, Populus trichocarpa
  POPTR_1809s00200.1
atgattcctcgtagtgtctctctaatttttttcctgctatttctagttcctgaaatagcaactgtatcagcactaattatagcgaagcctaattgtgcagacacttgtggaaacatcagcatcccttttccatttggaataggaacaggttgttccatgaatgactggttctcagttgattgcaacaaaacaactgcggattctcccagcagggctttcttaagcagaatcaacatggaggtcttgaagatttcattagggaacagtagggttcgagtaaacagtccaataatttcctccggctgttctggtagaggtgccaacttagcctttaatatgactggaagtcctttcgtcttctcttcgttaaatatcttcatcgcaatgggctgcaacaatcgtgctttattgaaccgaattgagccagaaattgttgggtgcacgtcaacttgcggtgctaataatttgactagttctagtacaacaggtgaagaaaagaggtactgttctggtaacaattgctgccagactagaattccctcgaatctccaggtgttcagcgcgagtttggggaccacagaggaccctaatgatcaaggaagaaatcaatgcaaggtagcttttatagtagaccgaggatggtccctggacaacataaaaagtcccgaggcggtgcaagatatgcagcatgtcccagtattcctggattggtttatgtatagtgatgacatcggtgtggagaattctgatgcaaagaattgcagcccccctgtacaattagtttctggtaggtggggtttgagtacattaacattgtattccaattcaactacttgtagttgcaacctgggctatgatggcaatccgtatcttcctgatggatgcactgatatcgatgagtgcaaaaatcccaatggaaattggtgttcggggatgacaaaatgtgtgaatgtaccgggtgggtacaagtgcgagctcgacaaagctaagatcactttcttgattctaggtgcggccactggattgttgttgctgcttgttggtatttggcggttatataaacttgtaaaaaaaaggaagaacattgaactgaagaagaagttcttcaaacaaaatggtggtttattgctgcagcaacaattatcctcaagtgatggaagcattcagaaaacaaaaatatttacttctaaggagttggaaaaggcaaccgatcgttttaatgataatagaatacttggtcaaggtggccaaggaactgtttataaaggaatgctagcagatggaatgatcgttgctgttaaaaaatccaaaatgatggatgaagaaaagtcggaagaatttatcaatgaggtcgtcatcctttcacaactcaatcacagaaatgtggtcaagttgctaggttgttgtttagagacggaggttcctctactagtctatgaattcattcccaatggaaatctctttgagtatattcatgaccagaaggaggagttccagttttcatgggaaatgcgactaaggattgctactgaagttgctagggcactttcttatcttcattccgcagcaaccattccggtttatcaccgtgatattaagtctacaaatatactgttagatgagaagttcagagcaaaagtatcagatttcggaacttcaagatcgatcgccattgatcaaactcatctaaccactcatgttcaaggcacttttggatactttgacccagagtacttccagtctagccaatttaccggaaaaagtgacgtctacagttttggtgttgttcttgcagagctcttgagtgggcaaaaaccaatttcttatgaaaggtcagaagaaaggggaagtttagccactcattttattcttttggtggaagagaacaagatatttgatattcttgatgaacgacttatggggcaggaccgtgaagaagaagttatcgcagtcgctaatcttgcaagaagatgcttgaacttgattggaaggaaacggccaacaatgagagaagtcgcgatagagttggagcagattcggctgtcaaaaggagctcttcatccacaacaatgtagtaaagaacttgaaaacatctgggatgaagttcccaacgtatgggaaattgctgggcctcctacttcagtaacaattggcgattttagaaatggcacggctccatctttggatgtccaaccattgatttctcacgaaacatgg

SEQ ID NO: 514 - protein, 739 aa, Populus trichocarpa
  POPTR_1809s00200.1
MIPRSVSLIFFLLFLVPEIATVSALIIAKPNCADTCGNISIPFPFGIGTGCSMNDWFSVDCNKTTADSPSRAFLSRINMEVLKISLGNSRVRVNSPIISSGCSGRGANLAFNMTGSPFVFSSLNIFIAMGCNNRALLNRIEPEIVGCTSTCGANNLTSSSTTGEEKRYCSGNNCCQTRIPSNLQVFSASLGTTEDPNDQGRNQCKVAFIVDRGWSLDNIKSPEAVQDMQHVPVFLDWFMYSDDIGVENSDAKNCSPPVQLVSGRWGLSTLTLYSNSTTCSCNLGYDGNPYLPDGCTDIDECKNPNGNWCSGMTKCVNVPGGYKCELDKAKITFLILGAATGLLLLLVGIWRLYKLVKKRKNIELKKKFFKQNGGLLLQQQLSSSDGSIQKTKIFTSKELEKATDRFNDNRILGQGGQGTVYKGMLADGMIVAVKKSKMMDEEKSEEFINEVVILSQLNHRNVVKLLGCCLETEVPLLVYEFIPNGNLFEYIHDQKEEFQFSWEMRLRIATEVARALSYLHSAATIPVYHRDIKSTNILLDEKFRAKVSDFGTSRSIAIDQTHLTTHVQGTFGYFDPEYFQSSQFTGKSDVYSFGVVLAELLSGQKPISYERSEERGSLATHFILLVEENKIFDILDERLMGQDREEEVIAVANLARRCLNLIGRKRPTMREVAIELEQIRLSKGALHPQQCSKELENIWDEVPNVWEIAGPPTSVTIGDFRNGTAPSLDVQPLISHETW

SEQ ID NO: 515 - DNA, 2058 bp, Populus trichocarpa
  POPTR_0001s07650.1
atggtttggaaattggtgtttcaattgatgctaatgtttcaagtagcagcagcagcagcaccgatcgcaaggtccggttgtccagatcgttgtggagacatcagcattccataccctttcggaatacgaaaagattgctacatgaacgaatggttcgccatagaatgcaaagcatctgtcaaccctgctagagcttttataagtcgaatcaacatggaggtgctgaatatttcagctgaaagagccactgctactgtcaaaagtccaataatatcctcgaattgtactggcagggaagatggtgtgcctctgaatttgactggaactccttttgtcttctccagaaacgataatgtattcatcgcagtaggttgtaatactcaagctttaatgaccggaatcacgccaaatctcatcggttgtgtgtctacctgcagtgacgtaaagagtaaaaatttctgtcaggcttcagccccatcattccttcaggttttcaatccaaaattagaagctacagatgataatcaagatagagaaggatgcaagctggccttcctggtgaaccagacatggttcgaatcgaatatcagcgatccattcacattgcaatatagagattatgttccagcagagcttggttggacaatgagttggaatgatgatgatcccgtgtattgcagaggatattacaatcgatcttttggatccgaatgtgagtgtgatgggggctatgagggcatcccttaccttggatgcatagatgtggatgaatgtaaagaatcgaagcattcgtgccgagggttacttaaatgtgtaaatacacgggggtatttcaattgcgagatcaataaactttatatagccttgatagttataggcgcagttgtcttagcattgtcattgctgatgggcatttggtggttgtataaacttgtaaagaaatggaaaaagattgaactcaaaaagaaattcttcaaacgaaatggtgggctattgttacagcaggaattacgtgctgctgaaggttgggttcaaaaaacaaaaatatacagttcaaaggagttggaagtagccactgatcgttttaatgtgaatagaatactcggtcaaggtggtcaaggcacagtttataaagggatgttagcagatggaaggattgttgctgttaagaagtccatggtcgttgatgaaggaaagcttgaagaatttatcaatgaggtcgtcgttctttcacaaattaaccatagaaatgtggttaagttgctcggttgttgcttggagactgaagttcctttgctagtctatgagttcattcccaatggaaatctttacaagtatatccatgatccaaacgaagatttcttgttatcttgggagatgcgattacggattgccattgaagttgctggagcactttcctatctacactcggcgacatccattccgatttatcaccgtgacatcaagtctacaaacatactgctagatgagaaatatagagcaaaagtatctgattttggatcttcaagatcaatatccatcgatcaaactcacttgaccactctcgtgcaaggtacctttggctacttagatcccgagtacttccagtccagtcaatttacagaaaagagtgatgtttatagctttggagtggttctggttgagctcataagtggacaaaaaccgatattttctgtaagccagacagaaactagaagtttagccacgcattttattatgttgatggaagacaatagactgtctgatgttcttgatgctagagttaaggagggttgtcagaatgaagaagttatctctgttgctaatcttgcgaaaagatgcttgaatttgaatgggaaaaatcgacctacaatgcgagaagtcacatcagagttggagaggataattggattgtctcaagaagagctaaatattcaagagaactgtaaaatatcaaaaaacaccatggatgatgcaagcaatgattgggatgcagtttcgacatccatcactggtgattttgatactggcaggactccatcatccgatggtgaacca

SEQ ID NO: 516 - protein, 686 aa, Populus trichocarpa
  POPTR_0001s07650.1
MVWKLVFQLMLMFQVAAAAAPIARSGCPDRCGDISIPYPFGIRKDCYMNEWFAIECKASVNPARAFISRINMEVLNISAERATATVKSPIISSNCTGREDGVPLNLTGTPFVFSRNDNVFIAVGCNTQALMTGITPNLIGCVSTCSDVKSKNFCQASAPSFLQVFNPKLEATDDNQDREGCKLAFLVNQTWFESNISDPFTLQYRDYVPAELGWTMSWNDDDPVYCRGYYNRSFGSECECDGGYEGIPYLGCIDVDECKESKHSCRGLLKCVNTRGYFNCEINKLYIALIVIGAVVLALSLLMGIWWLYKLVKKWKKIELKKKFFKRNGGLLLQQELRAAEGWVQKTKIYSSKELEVATDRFNVNRILGQGGQGTVYKGMLADGRIVAVKKSMVVDEGKLEEFINEVVVLSQINHRNVVKLLGCCLETEVPLLVYEFIPNGNLYKYIHDPNEDFLLSWEMRLRIAIEVAGALSYLHSATSIPIYHRDIKSTNILLDEKYRAKVSDFGSSRSISIDQTHLTTLVQGTFGYLDPEYFQSSQFTEKSDVYSFGVVLVELISGQKPIFSVSQTETRSLATHFIMLMEDNRLSDVLDARVKEGCQNEEVISVANLAKRCLNLNGKNRPTMREVTSELERIIGLSQEELNIQENCKISKNTMDDASNDWDAVSTSITGDFDTGRTPSSDGEP

SEQ ID NO: 517 - DNA, 1932 bp, Populus trichocarpa
  POPTR_0003s18440.1
atgactttgctgatgttaatgtttcagttagcaaaagcagcagcacctgtagcgaagttcggttgtccagatcgatgcggagacattaccattccttacccttttggaactggaaaagactgctacaaggacgaatggttcgcggttgaatgcaacaaaaccaccaatcctcctagagcttttataagtcgaatcaaaatggaggtgctgaatatttcagttgaaaaaggattggctaccgtcaaaagtccagtaatatccttcaattgtactggcagggaagatggtggatctctggatctcactggatctccctttgttttctccgattcctggaatgtgttcattgcaggaggttgtgatactcgagctttcatgagcgggattgagccgcaagtcctcggttgcgtgcctacatgcggtaaccagcggagtaacgttagcttgcaagaaaataatatgtgttcaggtcgaaattgctgtcaggcttcaatcccttcactccttcaggttttcaaaccaacattagtttctactaacgttgatcaaggtagagaagcatgcaagctagccgttttggtgaatgggacatggtttgcatcgaatataagtgatccattcgcactgctgcataaagattacgttccagcgaacttgggttgggtgatgaatataagtgattctgatatttccatttattgcaacacgtattacaatcaatccttaaaatctgaatgtgcgtgttggcgtggatttgagggtaacccttaccttgaacttggttgcatagatgttgatgaatgcaagacctcagagaaaaatacgtgccaaagaatgctcaaatgtgtgaatacacgtggagggtatagatgtgcgataaataaaatttatataattatcatagttgtaggatcagtcatctttatattggtactgctgtttggcctttggaggctttataaacttataaagaagaggcagaacaaggaactcaaaaagaaattcttcaaacgtaacggtgggctattgttacagcaacaattatccactagtgatggtagcgttcagaaaacaaaaatatacagttccaaggagttggaagtagccaccgatggttttaatgtgaacagaatacttggagaaggtggtcaaggcactgtttacaagggaatgttaacagatggaagaattattgctgttaaaaagtccaaagtcgttgatgaagaaaatctcgaagaatttattaacgaggtcgtcattctctcacaaatgaaccacagaaatgtggttaagctgctaggttgttgcttggagactcaagttcctatactagtatacgaattcatttccaatggaaatctttacaagtatatccatgttcaaaatgatgacttcttgttatcttgggaaatgcgattacggattgccattgaggttgcgggagccctttcttatctacactcggcagcatcaattccgatttatcaccgtgatatcaagtctacaaacatactcctagacgagaaatatagagccacaatatcagattttggatcttcaagatccattgccatcgatcaaactcacttgaccactcatgtgcagggtacttttggctacttggatccagagtacttccagtctagtcaatttacagaaaaaagtgatgtttatagctttggagtggttctggttgagcttttaagcggaaaaaaaccgatattttccgctagcccaacagaaagtagaagtttagccacacattttatcatgttgatggaagataacaggttgtttgatattcttgatgctagagtcaaagagcattgccataacgaagaagttgttgctgtcggcaatcttgcaagaaaatgcttgaatttgaatgggaaaaatcggccaacaatgaaagaagtaaccacagagttagag

SEQ ID NO: 518 - protein, 645 aa, Populus trichocarpa
  POPTR_0003s18440.1
MTLLMLMFQLAKAAAPVAKFGCPDRCGDITIPYPFGTGKDCYKDEWFAVECNKTTNPPRAFISRIKMEVLNISVEKGLATVKSPVISFNCTGREDGGSLDLTGSPFVFSDSWNVFIAGGCDTRAFMSGIEPQVLGCVPTCGNQRSNVSLQENNMCSGRNCCQASIPSLLQVFKPTLVSTNVDQGREACKLAVLVNGTWFASNISDPFALLHKDYVPANLGWVMNISDSDISIYCNTYYNQSLKSECACWRGFEGNPYLELGCIDVDECKTSEKNTCQRMLKCVNTRGGYRCAINKIYIIIIVVGSVIFILVLLFGLWRLYKLIKKRQNKELKKKFFKRNGGLLLQQQLSTSDGSVQKTKIYSSKELEVATDGFNVNRILGEGGQGTVYKGMLTDGRIIAVKKSKVVDEENLEEFINEVVILSQMNHRNVVKLLGCCLETQVPILVYEFISNGNLYKYIHVQNDDFLLSWEMRLRIAIEVAGALSYLHSAASIPIYHRDIKSTNILLDEKYRATISDFGSSRSIAIDQTHLTTHVQGTFGYLDPEYFQSSQFTEKSDVYSFGVVLVELLSGKKPIFSASPTESRSLATHFIMLMEDNRLFDILDARVKEHCHNEEVVAVGNLARKCLNLNGKNRPTMKEVTTELER

SEQ ID NO: 519 - DNA, 2079 bp, Populus trichocarpa
  POPTR_0112s00230.1
atggagaaaatggtttcgaaattggtgtttaaaatgactttgctgatgttaatgtttcagttagcaaaagcagcagcaccagtagcgaagtttggttgtccagatcgatgcggagacattaccattccttacccttttggaactggaaaagactgttacaaggacgaatggttcgcggttgaatgcaacaaaaccaccaaccctcctagagcttttataagtcaaatcaatgtggaggtgctgaatatttcagttgaaacaggattggctaccgtcaaaagtccagtaatatccttcaattgtactggcaggaaagatggtggatctctgaatctcactggatctccctttgttttctccgatttctggaatgtgttcattgcagtaggttgtgatactcgagctttcatgagcgggattgagccgcaagtcctcggttgcgtgcctacatgcggtaaccagcggaataacgttagcttgcaagaaaataatatgtgttcaggtcgaaattgctgtgaggcttcaatcccttcactccttcaggttttcaaaccgacattagtttctactaacgttgatcaaggtagagaagcatgcaagctagccgttttggtgaatgagacatggtttgcatcgaatataagtgatccattcgcactgcagcatatagattacgttccaacggacttgggttgggtgatgaacgtgaattattctcatgatatttccatttcttgcatgtattacaatgaatccctaaattctgaatgtgcgtgtcggcgtggatttgagggtaacccttaccttgaacttggttgcatagatgttgatgaatgtaagaccccagagaaaaatacgtgtcaagggatgctcaaatgcgtgaatacacgaggagggtttagatgcgggataaataaaatttatataattatcatagttgtaggatcaatcatctttatattggtactgctgtttggcctttggtggatatatagacttgtaaagaagaggcagaacaaggaactcaaaaagaaattcttcaaacgtaacggtgggctattgttacagcaacaattatccactagtgatggtagcgttcagaaaacaaaaatatacagttccaaggagttggaagtagccaccgatggttttaatgtgaacagaatacttggagaaggtggtcaaggcactgtttacaagggaatgttaacagatggaagaattattgctgttaaaaagtccaaagtcattgatgaagaaaatctcgaagaatttattaacgaggtcgtcattctctcacaaattaaccacagaaatgtggttaagttgctaggttgttgcttggagactgaagttcctatactagtatacgaattcatttccaatggaaatctttacaagtatatccatgttcaaagcgatgacttcttgttatcttgggaaatgcgattacgaattgccattgaagttgcgggagccctttcttatctacactcgacagcatcgattccaatttatcaccgtgatatcaagtctacaaacatactcctagatgagaaatatagagccacgatatcagattttggatcttcaagatccattgccatcgatcaaactcacttgaccactcatgtgcagggtacttttggctacttggatccagagtatttccagtctagtcaatttacagaaaaaagtgatgtttatagctttggagtggttctggttgagcttttaagtggacaaaaaccaatattttccgctagcccaacagaaagtagaagtttagccacgcattttatcatgatgatggaagataacaggttgtttgatattcttgatgctagagtcaaagagcattgccataatgaagaagttgttgctgtcggcaatcttgcaagaaaatgcttgaatttgaatgggaaaaatcggccaacaatgaaagaagtaaccacagagttggagaggataattaaaaagggatcaaatgttcaacaagacactcaagagaatgaaaatatcatggttgatctcagtatgcaatacatgggatgcatttccgacatcaataatgacctg

SEQ ID NO: 520 - protein, 693 aa, Populus trichocarpa
  POPTR_0112s00230.1
MEKMVSKLVFKMTLLMLMFQLAKAAAPVAKFGCPDRCGDITIPYPFGTGKDCYKDEWFAVECNKTTNPPRAFISQINVEVLNISVETGLATVKSPVISFNCTGRKDGGSLNLTGSPFVFSDFWNVFIAVGCDTRAFMSGIEPQVLGCVPTCGNQRNNVSLQENNMCSGRNCCEASIPSLLQVFKPTLVSTNVDQGREACKLAVLVNETWFASNISDPFALQHIDYVPTDLGWVMNVNYSHDISISCMYYNESLNSECACRRGFEGNPYLELGCIDVDECKTPEKNTCQGMLKCVNTRGGFRCGINKIYIIIIVVGSIIFILVLLFGLWWIYRLVKKRQNKELKKKFFKRNGGLLLQQQLSTSDGSVQKTKIYSSKELEVATDGFNVNRILGEGGQGTVYKGMLTDGRIIAVKKSKVIDEENLEEFINEVVILSQINHRNVVKLLGCCLETEVPILVYEFISNGNLYKYIHVQSDDFLLSWEMRLRIAIEVAGALSYLHSTASIPIYHRDIKSTNILLDEKYRATISDFGSSRSIAIDQTHLTTHVQGTFGYLDPEYFQSSQFTEKSDVYSFGVVLVELLSGQKPIFSASPTESRSLATHFIMMMEDNRLFDILDARVKEHCHNEEVVAVGNLARKCLNLNGKNRPTMKEVTTELERIIKKGSNVQQDTQENENIMVDLSMQYMGCISDINNDL

SEQ ID NO: 521 - DNA, 2187 bp, Populus trichocarpa
  POPTR_0003s18490.1
atgaaaatgagatccatatttcgaatcagcctcttactattgccaatattatttcagttagcaacagctgcaccacccgtgacaaagcctggatgtcaaaaccgttgtggaaacatcagcattccttacccctttggaactgcacaagattgctatgcaaatgaaatgttcaagattgtatgcagggaaactgccaatgagtcagctccaagagcttttattagcatgatcaatatggaggttctgaatattacagatggtgcagcaattgtcaacggtccaataatgtcctccaattgctctgacaggcaatccaatctacctgctctgaatttgacgggaagtcccttctttttctcctttggtaatgtgttcactgcagtgggttgcaacgtccgcgcgttgttgacagggataggccgccaagttgtcgggtgcgactcgacttgcagtgctgactctaatcagaaaactcttctttacgggcaagaaattaacagtctatgtgctgatggaaactgctgtgtggcaagagcaccttaccggatgcaggtttttcagccaagtttggatacaaaaaatggcagtgaagacagcagtggatgcaagttagctttcctaacagacgaaacaaatttttcgtttctcaatataaccaatccgcaagcgctgcagggttggagatctgttccactggtgcttgcctggatgatggattacagcatttggagatatgataaaagtaccatggattgcaagtacttcctttatgagtcatctgtgagtaacgtttcaggatatgaatgttcttgcagtaacggctatgaaggcaacccttaccttggatgcacagatattaatgaatgcaaagacccaaatcgacattcgtgcctggggataacaaaatgtgtgaatacactgggatcatacaaatgcgaggtcaataagtattggatcgtcccaatacttgtagttgttatcgctggaatattgtcattgcttgctggcatatcgtggttatacaaactagcgaagaaaagaaaaaacatagaacttaaaaggaaattcttcaaacgaaatggtggtttattattacagcagcagttatcctcaaatcatggcagtgttcaaaaaacaaagatatttacttcaaaagagttggagacagccactgatcgttttaatgaaaatagaatacttggtcaaggtggacaaggcacggtttacaaggggatgttagaagatggaagaatcgttgctgttaaaaggtccacaatagtgggtgaagaaaagctcgaggagtttattaatgaggttgtcattctttcacaaattaatcataggaatgtggttaagttattcggatgttgcttggagactgaagttcctctcctggtctatgaattcatttccaatggaaatcttttccagtatctgcataatttttaccagaacgaggacttcatattatcatgggaaatgcgattacagattgccattgaagttgctggagcactttcctatttacattcggcagcatccattccaatttatcaccgtgacattaagtctgcaaatatactcttggatgacaaatatagagcaaaggtttcagattttggatcttcaagatcaatggctattgatcaaactcatttgaccactaatgtgcagggcacttttggttatttagacccggaatacttccaatctagtcaatttacggacaagagtgatgtttatagctttggtgtagtcctcgtcgagctcttaagtgggaaaaaaccaattatatcatcaacttcacaagaaacgagaagtttggccacacattttattgttctgatggaagagaacagactctttgatattcttgatgtccaagttaaggaggattgccttgaggaggaaataatggctgtagcaaatcttgcaaaaagatgcttgaatgtgagcagaaaacatcgaccaacaatgaaagaggtctcagccgagttggagaggattgggttgttgcatagaaagtcaattgttcagcaaaatgaagaagacactaatgagaaaagtaccatggttgaacgtctctgcaactgggatgcagttcctatctcagctacctgtgattttgacaatgctagatcagttcaatcaacagttgccgaaccattgattacttacaacacctta

SEQ ID NO: 522 - protein, 729 aa, Populus trichocarpa
  POPTR_0003s18490.1
MKMRSIFRISLLLLPILFQLATAAPPVTKPGCQNRCGNISIPYPFGTAQDCYANEMFKIVCRETANESAPRAFISMINMEVLNITDGAAIVNGPIMSSNCSDRQSNLPALNLTGSPFFFSFGNVFTAVGCNVRALLTGIGRQVVGCDSTCSADSNQKTLLYGQEINSLCADGNCCVARAPYRMQVFQPSLDTKNGSEDSSGCKLAFLTDETNFSFLNITNPQALQGWRSVPLVLAWMMDYSIWRYDKSTMDCKYFLYESSVSNVSGYECSCSNGYEGNPYLGCTDINECKDPNRHSCLGITKCVNTLGSYKCEVNKYWIVPILVVVIAGILSLLAGISWLYKLAKKRKNIELKRKFFKRNGGLLLQQQLSSNHGSVQKTKIFTSKELETATDRFNENRILGQGGQGTVYKGMLEDGRIVAVKRSTIVGEEKLEEFINEVVILSQINHRNVVKLFGCCLETEVPLLVYEFISNGNLFQYLHNFYQNEDFILSWEMRLQIAIEVAGALSYLHSAASIPIYHRDIKSANILLDDKYRAKVSDFGSSRSMAIDQTHLTTNVQGTFGYLDPEYFQSSQFTDKSDVYSFGVVLVELLSGKKPIISSTSQETRSLATHFIVLMEENRLFDILDVQVKEDCLEEEIMAVANLAKRCLNVSRKHRPTMKEVSAELERIGLLHRKSIVQQNEEDTNEKSTMVERLCNWDAVPISATCDFDNARSVQSTVAEPLITYNTL

SEQ ID NO: 523 - DNA, 2091 bp, Citrus clementina
  clementine0.9_003894m
atgaatctgcagttgctgtttcaagttataatattgctgcttccaaggccaataaaatcaatagctaaagcaccaccgacaccacatttaacgaagccaaattgtccatccagttgtggaaacaatgttacaattccatttccattcggaattggagaaaattgttactttgatcaacgttatgcaatagactgcagatccaataagccaatcctgagaagcatcaacctggaagtgcttgaattcttacttgaaaagagcacaatgagagtaaatcaatcagtgatcagatcttgtcaggataaaactaaagaagcaagttttgtaaacctggagaagctccctttttacttctcatattatgacaatatattctccggcatcggctgcaacaaccttgcctcaatgtcatcagctgatcatgactttattcttggtggttgcttctctatttgtgatccaagaaacaagacagatgatgatagctgcaatggaattgcgtgttgcaaagcaggggtcccttgggctctcaaaagttttaatatttctataagcagcataaataatgcagcaagtagcaggagcagcagccaggaggaggggaaatgcaaatatgcatttatggtagaaaaagaatggtttgaaagcaatttgaagagtgctgaagctgttcaagattggaatcaagtacctgttatattggattggaggattcccaattcatcttttggcgagttagaaaaggataaatctccagaatttagatcaacatctcattgtagaagtgatgaaagtgggctttttggatgttcgtgcaaggaaaaataccatgggaatccctatttcctccatggatgtctagatattgatgagtgtagggatggtattgccaactgcagtgggaatctgcattgtgaaaactatgaaggaggctaccgttgcgttaatcccaaaagaccaaaggttcacacgatcatcttaggaattggcacaggccttggcggtttatttctttctattggagcattgtggctgtgcatcataataagaaaaagaatcaagcagaaagagaagaatttcaaaaaaaatggtggtttgcttttacaacaacagttgaattcaattgaccgtagcattgatagatgcagaatattcaactccaaggaattagacaaggccactgactatttcaatatgaatagaattattggccagggaggccaaggtactgtttacaaaggaatgttggcagatggaagaatcattgcagtgaagaaatccaaagtagttgatgaatcaaagcttgaagaattcattaacgaggttgtaattctttcgcaaattaaccacagaaacgtggttaagcttttgggatgttgcttagaggttgaggctcccttactcgtatacgagttcattcccaatggaaccctttttcagtatcttcatgatccatatgaagatctttcactgacgtgggaaatgcggttacggattgctacagaagttgctgaagctcttgcttacttgcattcatcagctcacttgcccatttaccatcgggacatcaagtcaaccaacatactcttggatgaaaaatatagagcgaagatagctgattttggaacttcaagatcaattgccattgatcaaactcatgtgagcaccaaagtacaaggaacttttggatatttagatcctgagtactttcgttcaagccgattcactgataaaagtgatgtctacagctttggagttgtgcttgttgagcttttaacaggacaaaaaccaatatcttctatttgggcaaatgagggtcgaaatttgacaacatattttgttgaatgtatagaggagaattgtttgtttgatattattgatgatcaagtaagaaaatcaggagaggcagaagagattatggccgtttctgacgttgcgaaaagatgcttaaattcatatgggaggaacagacctacaatgaaagaagttgcaatggaactagaaagaataagagcgaactcacgagatgatgagaacaatattcagagatgttatggaaaggttgaatatatatgtgagaaccgaagtaat

SEQ ID NO: 524 - protein, 697 aa, Citrus clementina
  clementine0.9_003894m
MNLQLLFQVIILLLPRPIKSIAKAPPTPHLTKPNCPSSCGNNVTIPFPFGIGENCYFDQRYAIDCRSNKPILRSINLEVLEFLLEKSTMRVNQSVIRSCQDKTKEASFVNLEKLPFYFSYYDNIFSGIGCNNLASMSSADHDFILGGCFSICDPRNKTDDDSCNGIACCKAGVPWALKSFNISISSINNAASSRSSSQEEGKCKYAFMVEKEWFESNLKSAEAVQDWNQVPVILDWRIPNSSFGELEKDKSPEFRSTSHCRSDESGLFGCSCKEKYHGNPYFLHGCLDIDECRDGIANCSGNLHCENYEGGYRCVNPKRPKVHTIILGIGTGLGGLFLSIGALWLCIIIRKRIKQKEKNFKKNGGLLLQQQLNSIDRSIDRCRIFNSKELDKATDYFNMNRIIGQGGQGTVYKGMLADGRIIAVKKSKVVDESKLEEFINEVVILSQINHRNVVKLLGCCLEVEAPLLVYEFIPNGTLFQYLHDPYEDLSLTWEMRLRIATEVAEALAYLHSSAHLPIYHRDIKSTNILLDEKYRAKIADFGTSRSIAIDQTHVSTKVQGTFGYLDPEYFRSSRFTDKSDVYSFGVVLVELLTGQKPISSIWANEGRNLTTYFVECIEENCLFDIIDDQVRKSGEAEEIMAVSDVAKRCLNSYGRNRPTMKEVAMELERIRANSRDDENNIQRCYGKVEYICENRSN

SEQ ID NO: 525 - DNA, 2328 bp, Eucalyptus grandis
  Eucgr.K01439.1
atgtcgaactcagtgttccgaattcttttgcttctggtttcccttgcagtacaggcatcaggagctgcgcctggacttgcaaggcctgaatgtaacgaaacatgcgggaatgtcaccattcccttccccttcggagtaggagccgggtgtttcttggacgagtggtacgagatcgactgccaacaaagcaacacagttcccgtgctaaataagactggattgcgagttctcaacatttctttcccctctgtctggggatacacgaacggcatgattagtgtccgtctgcctttaatttactcaaatgcaagctgtggggccgatggacttggtgagccggtgagcttcgaaggaggtccatttgtcttctctcaaacaagaaacgtctttacatcggtcggttgtgataccctggcaacagtcggtactacagaatcggccgttgtcggttgcaggtcaaaatgtgctgaaatcagcaccaacattagctggcattatagtacttgttccgggagggacgaatgctgccagagtacgctccccttcgaccttcaggtcttcagtgtggatttcaaagaagaaggtggacatcacgggtgcaagcatgctttcctggcagatagatcatggttcttgaagtctaatgaaacaggtttatatgacttaagaatgggtaatacggttccagtggtgctggaatgggggatcacagacaatacccactattcacgtgagcttatgcagcaaaattacagcacaatctacagcttgagctataatgaacctttcaactgtgacagcagcttctccggcattgaaatgccatttatgcagtgctattgtggatcggggtatcatggtaacccttatcttattaaaggatgcgaagatatcaacgaatgcgaagatccaaaaaactgtaacgggacttgtttgaacaagcagggctactatgactgcgttgatggtagaacaacaactaaattcattcttgttggtaataagaaaacactcgaactttttaaacgtcgctgcttcatatctatcaaaagatatccaagggttggagcaagccttggggcactacttctgtgtcttctcttatggaggttgtacgaatacatcaagaagagaaaagaaatcaagctcaaagagaagtacttcattcacaatggcggtcttttgttggaaagtgagctatcttcaccaaaatataatgtcgagaaaagcaaattgttcaactccaaggaattagagaaggccacggacaatttcaacaatgataggatactcgggcaaggtggacagggtactgtttacaagggaatgttaacagatggaaaaatagttgcgattaagaaatcgaaagtgatagacaagggacaagtcgaacaatttataaatgaagttctcattctctcacaaatcaatcataggaatgtggtcaagttattggggtgttgcttggagacggaagtcccacttttagtatatgagtttataccaaatgggactctatacgaatatctacatgatccaagtgcagagtttcctatatcatgggatacacggctacgaattgcaactgaaattgcaggagccttattctacttgcattcagcggcctctattcccatttatcatcgagacatcaagtctaccaatatcctcttagatgagaaatatcgagcaaaagtggcagattttggtacttccaagtctatttcactcgatcaaactcatataactacattagtgcaggggacttttggctacctagatccggagtatttccaatcaagtcagtttacagacaaaagtgatgtatatagctttggagttgtccttgttgaactcttaacgggacaaaagccaatctcatcgcaaagggaacaagtaggaagaagccttgtgacctatttcataaattcaatggaggagattcgcttgttcgacattgctgatgctcatgtgttgaaagaaggtaagaaggaagagattgcatcaatggctaaacttgcaaaaaggtgcttaaacttgaatggcaggaagcgacctacaatgaaagaagcggcaatagagttggagggaataaggaagcttcgaaatctttcaggtatgcagcacaatcaagagtaccgtgagcccactgaatctcatgatgctatctttgcatctagccagtcaagcatcgacatgaatatcattacattttcgggtcataccatcccaaagttatttgacgtcaactttgttcatttcttgagttatattagtcacacaggaacacaagcatctttgttgcaccagccttcacaaaggtactca

SEQ ID NO: 526 - protein, 776 aa, Eucalyptus grandis
  Eucgr.K01439.1
MSNSVFRILLLLVSLAVQASGAAPGLARPECNETCGNVTIPFPFGVGAGCFLDEWYEIDCQQSNTVPVLNKTGLRVLNISFPSVWGYTNGMISVRLPLIYSNASCGADGLGEPVSFEGGPFVFSQTRNVFTSVGCDTLATVGTTESAVVGCRSKCAEISTNISWHYSTCSGRDECCQSTLPFDLQVFSVDFKEEGGHHGCKHAFLADRSWFLKSNETGLYDLRMGNTVPVVLEWGITDNTHYSRELMQQNYSTIYSLSYNEPFNCDSSFSGIEMPFMQCYCGSGYHGNPYLIKGCEDINECEDPKNCNGTCLNKQGYYDCVDGRTTTKFILVGNKKTLELFKRRCFISIKRYPRVGASLGALLLCLLLWRLYEYIKKRKEIKLKEKYFIHNGGLLLESELSSPKYNVEKSKLFNSKELEKATDNFNNDRILGQGGQGTVYKGMLTDGKIVAIKKSKVIDKGQVEQFINEVLILSQINHRNVVKLLGCCLETEVPLLVYEFIPNGTLYEYLHDPSAEFPISWDTRLRIATEIAGALFYLHSAASIPIYHRDIKSTNILLDEKYRAKVADFGTSKSISLDQTHITTLVQGTFGYLDPEYFQSSQFTDKSDVYSFGVVLVELLTGQKPISSQREQVGRSLVTYFINSMEEIRLFDIADAHVLKEGKKEEIASMAKLAKRCLNLNGRKRPTMKEAAIELEGIRKLRNLSGMQHNQEYREPTESHDAIFASSQSSIDMNIITFSGHTIPKLFDVNFVHFLSYISHTGTQASLLHQPSQRYS

SEQ ID NO: 527 - DNA, 2097 bp, Eucalyptus grandis
  Eucgr.K01459.1
atgtccaactcagagtttcgaattcttgtgcttctggttttcctcacgatgcaagcatcaggaactgcagctggacttgcaaggcccaactgtgttgaaacatgtgggaacgtcagcattcccttccccttcggaataggtgccgggtgtttcttggatccctggtatgagatcgtctgcccatataggtcgtttccaatactaaataagattggattgcgagttctcagcatttcacttcccaattattatcaattcgtggatggcatgatcagtgtcagtcttccattaatatcctcaaatgcaagctgcgggggcgaaggacttggtgggccggtgaactttgaaggaagtcaatttatcttctcccagagatggaacgtctttacatcggtcggttgcaacaccctagcaacagttaatagtacagaatcagctgttgttggttgcaggtcaaaatgcactggaaccagtgccaacgttgtccgatatagtgcttgtttcgggagggaccaatgctgccagactacgctcccctttaaccttcaaagctttagtgtggattttaaagaagaaggtgaatctcagggatgcaagtacgctttcctggctgatagatcatggttcttgaggtccaacgttacaggttcatatgatttgaatttgagtaaaacagttccagtggtgttggaatgggggatttcaaacaaaaccgactatgaactcaagcttatccagcgatcctatcgcttggattatccattcataagtaacagagacagcctctatggatcgtatacgagtgaaatgccatttatacagtgccattgctcatgggggtataggggtaacccctatcttactgaaggatgccaagatattaatgaatgtgaagatcgagacttgtgccccgggatttgtgtgaacgaacagggaacatatgcctgcgtcgctggtagaaagacacctattattattggggttggggcagcctttggggcactagttttgtgtcttgtcttatggaggttgtacaaatacatcaagaagaaaaaagaaatcaaactcaaagagaagtacttcaaacgcaatggtggccttttgttgaaaagtgagctatcttcaccagaaggcaatgtcgaaaaaagcaaattgttcaattccaaggatttagagaaggccactgacaattttaatgatgataggatacttgggcaaggtggacaaggtactgtatacaagggaatgttaacacatggaaaaatagttgcgattaaaaaatcaaaagtgattgacgagggaaaagtcaaacatttcataaatgaagtcctcatcctctcacaaatcaaccataggaatgtggttaaattattggggtgttgcttagagacggaagtcccacttttagtgtatgagttcataccaaatgggactctataccaatatctacatgacccaaatcaagagtttcatgtatcgtgggacacgcggctacgaatcgcaactgaaattgcaagagccttattctacttgcattcagcagcctctattcccatttatcatcgagacatcaagtcgagcaatatccttttggatgagaaatatcgggcaaaagttgcggatttcggtacttccaagtcagtttcccttgatcaaactcatgtaaccacattggtacagggtactttcggctatctagatcccgaatatttccaatcaagtcagttcactgataaaagtgatgtgtacagctttggagtggtacttgttgaactcttaacagggcaaaagccaatttcttcactaagggaacaagaaggaagaagccttgcgacgtatttcataatctcgatggaagagaaccatttgttcgacattgttgatgctcaagttctgaaagaaggtaaaaaggaagagattgcatcagttgctaaccttgcaaaaaggtgcttaaacttgaacgggaggaaacgacctgcaatgaaagaagtggcaatggagttggaggggaaccacgaggcaactgaatcttataatgctgcttttccatctaacaagtcaaacattgacatggatgtcattacattttcggatgtt

SEQ ID NO: 528 - protein, 699 aa, Eucalyptus grandis
  Eucgr.K01459.1
MSNSEFRILVLLVFLTMQASGTAAGLARPNCVETCGNVSIPFPFGIGAGCFLDPWYEIVCPYRSFPILNKIGLRVLSISLPNYYQFVDGMISVSLPLISSNASCGGEGLGGPVNFEGSQFIFSQRWNVFTSVGCNTLATVNSTESAVVGCRSKCTGTSANVVRYSACFGRDQCCQTTLPFNLQSFSVDFKEEGESQGCKYAFLADRSWFLRSNVTGSYDLNLSKTVPVVLEWGISNKTDYELKLIQRSYRLDYPFISNRDSLYGSYTSEMPFIQCHCSWGYRGNPYLTEGCQDINECEDRDLCPGICVNEQGTYACVAGRKTPIIIGVGAAFGALVLCLVLWRLYKYIKKKKEIKLKEKYFKRNGGLLLKSELSSPEGNVEKSKLFNSKDLEKATDNFNDDRILGQGGQGTVYKGMLTHGKIVAIKKSKVIDEGKVKHFINEVLILSQINHRNVVKLLGCCLETEVPLLVYEFIPNGTLYQYLHDPNQEFHVSWDTRLRIATEIARALFYLHSAASIPIYHRDIKSSNILLDEKYRAKVADFGTSKSVSLDQTHVTTLVQGTFGYLDPEYFQSSQFTDKSDVYSFGVVLVELLTGQKPISSLREQEGRSLATYFIISMEENHLFDIVDAQVLKEGKKEEIASVANLAKRCLNLNGRKRPAMKEVAMELEGNHEATESYNAAFPSNKSNIDMDVITFSDV

SEQ ID NO: 529 - DNA, 2070 bp, Eucalyptus grandis
  Eucgr.K01462.1
atgtcaaactcagagtttcgaattcttgtgcttctggttttcctcacggtacaggcatcaggagctgcagctggacttgctaagcccaactgtgttgcaagatgtgggaacatcagtattcccttccccttcggaatagatgccgggtgtttcttggatccctggtatgagatcgtctgcccaaataggacggttccaatactaaaaaagattggattgcgagttctcaacatttcacttcccaattatggtggattcgtggacggcatgattagggtgagttttccatcatttatttactcaaatgcaagttgcaggggcgaaggacttggtgtgccaccgagcttagaaggaagtcaatttatcttctcccagacatggaacgtctttatatcggtcggttgcaacaccctggcaatagtgaatagtacagaatcagatgtggtcggttgcaggtcgagttgtgctggaaccaacaccagcgttagcatgtataatgcttgttccgggagggacggatgctgccagagtacgctcccctttaaccttcagttctttagtgtggttttcaaagatgagcgtggacctcaggagggatgcaagtacgctttcctggctgatagaacatggttcttgaggtctaacattacagatttgagtttcaatgatatggttccagtggtgttggaatggggtatttcaaacaaaaccgaatatggactcaagcttttccagcaagccaatggctcaggctatcttgatcccttcagatgtaccagatacaacctctatggatcgtatacgagtgaaatgccatttgtacagtgcttttgctcatcgggatataggggtaacccctatcttactgaaggatgccaaggggttggggcagcctctggtgcactagttttgtgtgttgtcttatggaggttgtacaaatacgtcaagaagagaagagaaatcaaactcaaggagaagcacttcaaacgcaatggtggccttttgttgaaaaatgagttatcttcaccagaaggcaatgttgaaaaaaacaaattgttcaattccaaggatttagagaaggccactgacaattttagtgacgataggatacttgggcaaggtggacaaggtactgtttacaagggaatgttaacagatggaaaaatagttgcgattaaaaaatcaaaagtgattgacgagggaaaagtcgaacagttcataaatgaagtcctcatcctttcacaaatcaaccataggaatgtggttaaattattggggtgttgcttagagacggaagtcccacttttagtgtatgagttcataccaaatgggactctataccaatatctgcatgacccaaatcaagagtttcatgtatcatgggacacgcggctacgaatcgcaactgaaattgcaggagccttattctacttgcattcagcagcctctattcccatttatcatcgagacatcaagtccaccaatatccttttggatgagaaatatcgggcaaaagtagcggatttcggtacttcgaagtcagtttcccttgatcaaactcatgtaaccacattggtacagggtactttcggctatctagatcctgaatatttccaatcaagtcaattcaccgataaaagtgatgtatatagctttggagtggtacttgttgaactcttaacagggcaaaagccaatttcttcactaagggaacaagaaggaagaagtctcgtgacctatttcattatttcgatggaagagaactgtttgttcaacattgttgatgctcaagttttgaaagaaggtaaaaaggaagagattgcatcagttgctaaccttgcgaaaagatgcttaaacttgaacgggaggaaacgacctacaatgaaagaagtggcaatggagttagagaggataaggaagctccaaaatcctttagttattttgcaaaatcaagagaaccacgagacaactgaatcgtctaatgctgcttttccatctaacaagtcaaacattgacatggatgtcattacattttcgaatgttcagccactcttgcctagtgagtcgtgg

SEQ ID NO: 530 - protein, 690 aa, Eucalyptus grandis
  Eucgr.K01462.1
MSNSEFRILVLLVFLTVQASGAAAGLAKPNCVARCGNISIPFPFGIDAGCFLDPWYEIVCPNRTVPILKKIGLRVLNISLPNYGGFVDGMIRVSFPSFIYSNASCRGEGLGVPPSLEGSQFIFSQTWNVFISVGCNTLAIVNSTESDVVGCRSSCAGTNTSVSMYNACSGRDGCCQSTLPFNLQFFSVVFKDERGPQEGCKYAFLADRTWFLRSNITDLSFNDMVPVVLEWGISNKTEYGLKLFQQANGSGYLDPFRCTRYNLYGSYTSEMPFVQCFCSSGYRGNPYLTEGCQGVGAASGALVLCVVLWRLYKYVKKRREIKLKEKHFKRNGGLLLKNELSSPEGNVEKNKLFNSKDLEKATDNFSDDRILGQGGQGTVYKGMLTDGKIVAIKKSKVIDEGKVEQFINEVLILSQINHRNVVKLLGCCLETEVPLLVYEFIPNGTLYQYLHDPNQEFHVSWDTRLRIATEIAGALFYLHSAASIPIYHRDIKSTNILLDEKYRAKVADFGTSKSVSLDQTHVTTLVQGTFGYLDPEYFQSSQFTDKSDVYSFGVVLVELLTGQKPISSLREQEGRSLVTYFIISMEENCLFNIVDAQVLKEGKKEEIASVANLAKRCLNLNGRKRPTMKEVAMELERIRKLQNPLVILQNQENHETTESSNAAFPSNKSNIDMDVITFSNVQPLLPSESW

SEQ ID NO: 531 - DNA, 2013 bp, Glycine max
  Glyma09g03230.1
tacgagaataagactatagcatcaccaccaggttgtgatagcaaatgtggaaatgtttccattcctttccctttcggaatgcacgatcccaaatgctatgcaagcaaccagtttgaaatagaatgcagacacaataacaatacttctcaaggtcatcagaaacccgtaccccacctaaagtatataaatttggaggtaatgtatattgatattcaatacggcataaatcttgaaggcagtcctttcgtgtattcccagaattacaactcatttgttggcgtaggttgccaaaacgccgccataatgttgtcaaacgacacgatacttacagcctgtatgtcggtgtgttacgagcacctcgaaaaaggcaatgacatcgacatttcgagttgtcgtggctcctactgctgcgagacttcactgccgccgtatctttcagcatacaacatctcaactgaaaccgtggaagtgaaaagtaatatcaaagcagaatgttcaaattacttgctgattagagcagaatatagtaacttcaagtacgagtacgatgagtacaattccagttactgggttcccactcttggagacctaaagaaacaaaaagatgttcctgcggtgcttgaatgggagattccgattcacacgcccaacaattccttccctgaattccgtacagatgcatatggccatggcagctacaactgcagttacactaatgttacatcttcactatatccacaatcgggttggagatgttcttgcagcgatggcttcgagggaaacccctacatacaagaaggctgtaaattaagtctcgatgttttttttaatgaattttctactacatatataactgttataagtatatttaaatgcgtaggagttttttcaagcatcgggaccatcattctactctttggtttgtggcggttgcgtaaagttgtaaggaaaaagatagcaaagaaacgcaaagaaaagttcttcaaacaaaatggaggattgttgttagaacaaagactatctactggtgaagttaatgttgacaaaactaaactctttagcttaaaggaattagggaaggccactgatcactttaatataaacagaatacttggaaaaggaggtcaaggtacagtttacaaaggtatgttagtagatggaaaaattgttgcagtgaaaaaatttaaggtcaacggaaatgttgaagaattcatcaacgaatttgtcattctttcacaaattaaccacagaaatgtggttaagttgttgggatgttgtttggagactgaaatccctttgcttgtttatgaattcattcccaatggtaacctttatgaatatttacatggacaaaatgatgagttaccaatgacatgggatatgcgtttgagaattgccactgaagtggctggagctctattttacttgcactcagctgcttctcaacccatttatcatagagatgtgaagtcaacaaatatattattggatgagaagtataaggcaaaagtagcagactttggggcatcaagaatggtttccattgaagccactcacctcactactgcagttcaaggaacttttggatacttagatcctgaatattttcatacaagtcaattgacagagaagagtgatgtctacagctttggagtggttcttgttgaacttttaacaggacaaaaaccaatatcctcagtgaacgaacaaggacttcaaagtttagcttcatattttcttctttgtatggaggaaaatcgtttttttgatattgttgatgcaagagtcatgcaggaagtggagaaagaacacataattgtagttgccaatcttgcaagaagatgcttacagttgaatgggagaaagcgaccaactatgaaagaagtcacattagaattggaaagtatccaaaaactggaaaaccaggcaaacttcagacagcaaaacatcaaccttggagattatgcctattcttatcaaataattaaccttgttccttgtaagctattcaag

SEQ ID NO: 532 - protein, 672 aa, Glycine max
  Glyma09g03230.1
YENKTIASPPGCDSKCGNVSIPFPFGMHDPKCYASNQFEIECRHNNNTSQGHQKPVPHLKYINLEVMYIDIQYGINLEGSPFVYSQNYNSFVGVGCQNAAIMLSNDTILTACMSVCYEHLEKGNDIDISSCRGSYCCETSLPPYLSAYNISTETVEVKSNIKAECSNYLLIRAEYSNFKYEYDEYNSSYWVPTLGDLKKQKDVPAVLEWEIPIHTPNNSFPEFRTDAYGHGSYNCSYTNVTSSLYPQSGWRCSCSDGFEGNPYIQEGCKLSLDVFFNEFSTTYITVISIFKCVGVFSSIGTIILLFGLWRLRKVVRKKIAKKRKEKFFKQNGGLLLEQRLSTGEVNVDKTKLFSLKELGKATDHFNINRILGKGGQGTVYKGMLVDGKIVAVKKFKVNGNVEEFINEFVILSQINHRNVVKLLGCCLETEIPLLVYEFIPNGNLYEYLHGQNDELPMTWDMRLRIATEVAGALFYLHSAASQPIYHRDVKSTNILLDEKYKAKVADFGASRMVSIEATHLTTAVQGTFGYLDPEYFHTSQLTEKSDVYSFGVVLVELLTGQKPISSVNEQGLQSLASYFLLCMEENRFFDIVDARVMQEVEKEHIIVVANLARRCLQLNGRKRPTMKEVTLELESIQKLENQANFRQQNINLGDYAYSYQIINLVPCKLFKE

SEQ ID NO: 533 - DNA, 3087 bp, Vitis vinifera
  GSVIVT01008212001
atggcaaagccaggctgtgagcaggatcattgcggagacatcctcattccgtacccgtttggcatggggaagagttgctataaggatgaatggttctcaatctcttgtagtcattcgttcgatcctccaaaacccattctaagtaaactcaatctggaggtgctgagtatagaaatggaccgcttccagaaaagtgtgatggttaacagtcccatatattccaactgtgaaaatggagaggtggaggtgaccagtagtccttggcaaagcagagatttgtggggaagcccattcctttactctcttcataacgatctcgtgggggtgggttgtcacaatgtgctgctgagagacaggaatgaggaaatcatggcaggttgcgcctccacttgcgacaagagtattactactaaagtgtgcaattataacttggatatacaattttacagtatcaacatttttctggttttagttgttagagaatgtgccaactgtcgctggggatgtgatggccgttacaatagcagcacttacaaatatgacttctattgcagcacaaagaacaaatcaaaagctttaattctaggctgcagtataagtgggggattattgttgctactcattttcagttttgggttatataaagtagtgagaaaacaattggatattagagtcaaaaagcgattctttaaacgaaatggtgggctgttgttgcaacaacaaatttcttctgataagattgcttttgagaaaacaaaaattttcacatctgacgagttagagaaggcgactgacaacttcaataagaatcgaattcttggtcaaggaggtcaaggaaccgtttataaaggtatgttaaatgatggaagaattgttgcagttaaaaagtcaaaaatagttgatgaaaaccaattagagcacttcattaatgagattgtgattctttcacaaatcaaccataggaatgtggttgggattttggggtgttgcttggagacagaagtgcctttgttggtttatgagtttatttctaatggaaccttatttcaacttatccatgatcaaaatagtgagtttccactttcatgggaaatgcgtttacgaattgctttagaggtatcgggtgcactttcttatttacactcagcatgttccatacccatttatcatagagacattaagtctaccaatatacttttagatgataaatataaagcaaaagtgtcagattttggaacatcaaggtctatttccattgatcaaactcatttgactactattgtacaagggacttttggctatttggacccagaatattttcaatcaagccaatttactgaaaagagtgatgtatatagttttggagtagttcttgttgagcttttaaccgggcaaaagccaatttcatctacaagatcaccagaagaaaaaagtttggcaacacatttcattttatccttacaagagtctcgtctatttgatattcttgatgctcgagttgtgaaggaaggtcggaaagaggacatcatgacatttgctaagcttgcaggtcgatgcttaaatttgaatggaaggaaaagacctacgatgaaagaagttaccacagaaatagataacattagagtgtctgccctacatttgaatgttgatcaaaatttccaagaaaatgcatgtgttgtaactgaaataacagagtttttggatatggatgatacttcaacttccaggggatcatgtttagatgacactaaagaatcttcatttgatatggactgcatttcttggactgtaggccagtggcttaaagatatcaacagattgactaaagctgcgttcgtccatgtccatggaggtcttgaaatactattcatttgtatgttcacgcataggacgctgacaaagaagagagtaagagcatggcggtcacaactgtactatgcagcccgagagttgctgctgctaccattgccacagcaagaccacggacagcctcaaaagtcgaacccttgccttcaatgtggctgcggcggccatcgaggtcatgatactgccgggctccatgcactgggcggcgacgagagtggaggcagaggtgaccgccgtgacgatcttcaccatctgcctgtcccttccggctccggaggaggcagctgtggcgactgctattgcggcgatggcagttgccactcttacgatagaaacagcggcgtggagctgggcattctgatgctcgagtgcttccattctttcctcattcctcttatacatatcattgatcatcttctgtattccaaaacacccaaaatcagagaaaaaatgattatgaagttgggtcttctgctgatcatctcctttctatgcctaacagctaaagcatcatcaccaccagatgaatatatggtaaagccaaattgtcggtatcgatgcggaaacgttaccattcccttcccatttgggatcggggacagctgttatctgaacgtgtggtactcagtaaactgcagcgttaatatgtcttctggtgctgaaaagccctttctaaaccatactaaactcaacctggagctgctgaatgtatcactggaacaccgaacggtggaagttaatagtcccatagcttcctatgatcagcggcagggggagagcaacacgtctcagccaagtattgatctggacaaaagcccttatcctgctcaaggccgcaatggcttcaacttttgccaaaccccaattctatccacagatagctactatcgcaataactaccttgtgggttttacccgaggctgtgaaggaaacaactactctaactccactacccatgccttcttggtggatagacactggttttctcacaactccacaaaacctgaggatattacaagagtgaagtatgctccgttatcattgttgtggaagacaaaaagtggggacaacgccagctctgactgtaaccgcatcgcgtactacaacccgatgatgggattatatgttcattattcttgcagctgcccattgcgtcacgaaggcaacccttatcttcccaagggatgtgatcatggtatgcacttctttcttgatcggctg

SEQ ID NO: 534 - protein, 1029 aa, Vitis vinifera
  GSVIVT01008212001
MAKPGCEQDHCGDILIPYPFGMGKSCYKDEWFSISCSHSFDPPKPILSKLNLEVLSIEMDRFQKSVMVNSPIYSNCENGEVEVTSSPWQSRDLWGSPFLYSLHNDLVGVGCHNVLLRDRNEEIMAGCASTCDKSITTKVCNYNLDIQFYSINIFLVLVVRECANCRWGCDGRYNSSTYKYDFYCSTKNKSKALILGCSISGGLLLLLIFSFGLYKVVRKQLDIRVKKRFFKRNGGLLLQQQISSDKIAFEKTKIFTSDELEKATDNFNKNRILGQGGQGTVYKGMLNDGRIVAVKKSKIVDENQLEHFINEIVILSQINHRNVVGILGCCLETEVPLLVYEFISNGTLFQLIHDQNSEFPLSWEMRLRIALEVSGALSYLHSACSIPIYHRDIKSTNILLDDKYKAKVSDFGTSRSISIDQTHLTTIVQGTFGYLDPEYFQSSQFTEKSDVYSFGVVLVELLTGQKPISSTRSPEEKSLATHFILSLQESRLFDILDARVVKEGRKEDIMTFAKLAGRCLNLNGRKRPTMKEVTTEIDNIRVSALHLNVDQNFQENACVVTEITEFLDMDDTSTSRGSCLDDTKESSFDMDCISWTVGQWLKDINRLTKAAFVHVHGGLEILFICMFTHRTLTKKRVRAWRSQLYYAARELLLLPLPQQDHGQPQKSNPCLQCGCGGHRGHDTAGLHALGGDESGGRGDRRDDLHHLPVPSGSGGGSCGDCYCGDGSCHSYDRNSGVELGILMLECFHSFLIPLIHIIDHLLYSKTPKIREKMIMKLGLLLIISFLCLTAKASSPPDEYMVKPNCRYRCGNVTIPFPFGIGDSCYLNVWYSVNCSVNMSSGAEKPFLNHTKLNLELLNVSLEHRTVEVNSPIASYDQRQGESNTSQPSIDLDKSPYPAQGRNGFNFCQTPILSTDSYYRNNYLVGFTRGCEGNNYSNSTTHAFLVDRHWFSHNSTKPEDITRVKYAPLSLLWKTKSGDNASSDCNRIAYYNPMMGLYVHYSCSCPLRHEGNPYLPKGCDHGMHFFLDRL

SEQ ID NO: 535 - DNA, 2724 bp, Vitis vinifera
  GSVIVT01008432001
atgattgggcggttgttgcttcagctgatcatcttcatactatgcttgacacgagcatcatcagctgctccatctctagcacagcctggttgtaacgatgcctgtggaagtgtttccattccatacccgtttggtgtagggaaggactgctaccttaatgaatggttctctataaattgcaaacattccacacccttctttacccatcctaacctcaatggttcgcaggtgagctccattatcactggaggacgagactgtggtggttcaaactcccatacaggtttaagcgttgttggaggatccttgtttctactcctagggagcttttggttgtataaagtacttaagaaaaggagggaaatcaaactgaaaaaacaattctttaaacaaaatggtggtttgttattacaacaacaaatatcttctaataaagttgttgaaaaaacaaagattttcactacagaagagttggagaaggcaatagacaatttcaatacaaacagaattcttgatcaaggaggtcaagggacggtttataaagaaatgaatgtgaagtctgtgcttctgctcatctccttactatggctaacaactgcgtcaacagctactccctccatggcaaagcaaaactgccaagaacgatgcggagatgttaccattccatacccatttggaatagggaaagattgctaccttaatgagtggtttgcagtcaactgcaacgattcttttaatcctccaacgccatatttgagtcatcctgagctcaatctgaagctgacgtttgtatcactggcttaccaactggtcactgttatcagccccatggctgtctactgtcaagaccatgacaggaatagatcgacatggaagggcattgatttgagtaaaaccccatttttttactcagaaggtaacgcactgagggtggtgggttgtgccaattcggtcctgatcacgcgtcaaggtaccatcttagcaggctgctcttccatttgcgataacagctctagtgttctgagcaatggttgctacgggatcaactgttgcaaaaccacagttccatccaatcttgatttctatattctgaacaccacatggagtacaaatatgggcacagaattgaattgtacgtatgctgccttcggtagaaatttcattttgagggggaagtcttcaggttcaggtatggaatatgaggcttcatcggagggagaaatgatctggatgataaaagaatcggtggagggcagtgattgtcacaaaaacacagtccctgacggggcactgggaaatcattcttattattcttgctcctgtccggcttaccaagaagggaacccttatctacccaatggatgccaagttgttgaagtatgtgcaaactgcaaaggaagatgtctaaccagaattgacggtcgtttcttctgcgatgaaagatctttggcttcaaaattttggattctaggtattagcctaggtgggggattgttgtttctacttcttggagggttctggttatataaagttttaaggagaaggcgaaagatcaaactcagagaacagttcttccagcaacagttattacaacaccaaatgtcttctaatgaaatcagcattgagaatacaaaaatattcactttcaatgaattgaagaaggcaagtgacaacttcaatgagaatcgtattcttggtcgtggaggtcaaggaacggtttataaaggtatgttgactgatggaagaatcgtagccattaagaagtcaaaaatagttgatgagagtcaatatgagcaattcatcaatgagattgtgattctttcccaacttaatcatagaaatatagtaaagctattgggatgttgcttggagatagaagttcccttattagtttacgagtttatctcgcacggaactctatttcagcttattcatgatgaaaacaatgagttgccattttcttgggaaaggcgcttggagattgccacagaggtagcaggagcacttgcttacttacattctgcctctagtacacctatttttcatagagatatcaagtctaaaaatatactcttagatgagaaatatagagcaaaagtggcagattttgggacatcgaggtctgtttccattgaccaaactcacttgactactcttgtgcgagggactttcggctacttagatccagaatattttcgaacaggacaattcactgaaaaaagtgatgtatatagttttggaattgttttggttgagcttttaacgggccaaaagccgatttcttcaacaagaaccgaagaagagagaagcttagcaagttattttattttgtcaatagaggagacaaacttatttgatattcttgatgctcaagttgtgaaggagggtggagaagaggagataatggctgttgttaacgttgcaacacaatgtttgaatttgaatgggaagaaaaggcctacaatgaaggaagtagccttagagctagagagggtcaaatctcatctgcctctacattatcttataccccataataacttctatagaatcctagaaaacaggaatggactaatttctattgccaaaggagttctaacttctgactactataccggagccaaagtcctaaccaacccaaccccaccacaccaccggacttggcttgaactggggtggccaggtggtctgctagttagaattgggcttggggtggcgtcaccttcc

SEQ ID NO: 536 - protein, 908 aa, Vitis vinifera
  GSVIVT01008432001
MIGRLLLQLIIFILCLTRASSAAPSLAQPGCNDACGSVSIPYPFGVGKDCYLNEWFSINCKHSTPFFTHPNLNGSQVSSIITGGRDCGGSNSHTGLSVVGGSLFLLLGSFWLYKVLKKRREIKLKKQFFKQNGGLLLQQQISSNKVVEKTKIFTTEELEKAIDNFNTNRILDQGGQGTVYKEMNVKSVLLLISLLWLTTASTATPSMAKQNCQERCGDVTIPYPFGIGKDCYLNEWFAVNCNDSFNPPTPYLSHPELNLKLTFVSLAYQLVTVISPMAVYCQDHDRNRSTWKGIDLSKTPFFYSEGNALRVVGCANSVLITRQGTILAGCSSICDNSSSVLSNGCYGINCCKTTVPSNLDFYILNTTWSTNMGTELNCTYAAFGRNFILRGKSSGSGMEYEASSEGEMIWMIKESVEGSDCHKNTVPDGALGNHSYYSCSCPAYQEGNPYLPNGCQVVEVCANCKGRCLTRIDGRFFCDERSLASKFWILGISLGGGLLFLLLGGFWLYKVLRRRRKIKLREQFFQQQLLQHQMSSNEISIENTKIFTFNELKKASDNFNENRILGRGGQGTVYKGMLTDGRIVAIKKSKIVDESQYEQFINEIVILSQLNHRNIVKLLGCCLEIEVPLLVYEFISHGTLFQLIHDENNELPFSWERRLEIATEVAGALAYLHSASSTPIFHRDIKSKNILLDEKYRAKVADFGTSRSVSIDQTHLTTLVRGTFGYLDPEYFRTGQFTEKSDVYSFGIVLVELLTGQKPISSTRTEEERSLASYFILSIEETNLFDILDAQVVKEGGEEEIMAVVNVATQCLNLNGKKRPTMKEVALELERVKSHLPLHYLIPHNNFYRILENRNGLISIAKGVLTSDYYTGAKVLTNPTPPHHRTWLELGWPGGLLVRIGLGVASPS

SEQ ID NO: 537 - DNA, 2103 bp, Solanum lycopersicum
  Solyc02g068660.1.1
atgaatcttgaatttgtatgtttgttgttgcttctttcatggcttaaggttttagatcattcaatagcagctacatctcttgcaaagcctggctgtgaagagagatgtggtaaccttacaattccttatccatttggattgagtgctagttgctctcttaactcgtggtacgtgatcaagtgtgatcgaagttctgatcctcctaagccttttatgaattcatttctgcaagttgaacttcaaagtgaggtgatatctgtgtcaattgaaaaccaaacgattactacttcagtttccatagtgaatttttgcaacaaatcgagtgaaggtagtagaatcatcacaacggggacagatttgtctggaagtcctttttattacgcaaaggataggaataagttgatgcttgttggttgtggaaatggtcttgtgacacagaaacaaaatgttctctcagggtgtacatcgatttgtagtgaaggtgctacgttgacaggatgctatggcatcaactgttgtcaatctcttttcccttttgatctaagttcatacaaagcaaacttcaccaactcggggattcagcaagaggcttacccgagatgcagtgcagttttcttggtagaccaaacttgggttccagatgaagttgcacagccctttgtttttcttggttatgctcctgttgtttggctctggactctccaagccaaagagttagaagcaggattgctctgcgacaagtctgaggctgttgttaagttggaagatggtacttctgtggcaaactggcagtgtcgttgtggaaatggaacacaaggaaatccatacttctctaacggatgccaagccaatcaacgatgcaccaattgcacagaaattgtaatctatatgaagcaatctccgaaaatcgttctcctcagtgtatgcataagtatcggagtactgcttctactgttagggagctatttattgtacaaaacagtcaagaagagagagaacaaaagacaaagacaaaggttttttaagcgaaatggcggcctcttactacaacagcagctatcatccaataatgaaggtactattgacaaaggaaaacttttcactgctagagagctggagaaggcaacagatcacttcaatgaaaatcgcatacttggtcgtggaggtcaaggtacggtatataagggcatgttacctgatggaaagattgtagcagtgaaaaagtccaagctggtagacgaaaaccagttggatcagtttatcaacgaggtggctgttctttcacaaatcaatcacaggaacgtggtgaagctactcggctgttgtttggaaacagaagttcctctactagtatacgagttcataataaatggcacactctacagcctcatacataatgagaacaatgagtttccctttacttggagcacgcgtttgagaattgccacagaggtagctggagcattagcttatctacactcagcaacttctgttccagtctatcatagggacatcaaatcaagcaatatacttttagatgaaaaataccgtgccaaggtatcagatttcggcacttcaaggtctattgcaattgatcaaactcacttaacgaccggagtccaagggacatttggctatttagatcctgagtacttccaatccagccaatatactgaaaaaagtgatgtctatagcttcggagttgttcttgctgaactcttaacaggaaagaaagcaatttcaaccacaacaaaccaagacagaagtttagcaacaaacttccttttggcaacagagagaaatctccttgatacgattatctatgcaaaaatttcacaagaaggtaaaagggaggatataatggcagctgctaacatagcgtatcgttgcatgaacttgaatggaaagaaaagaccaactatgaaggaagtaactacagcattggaagccattagatcacaaatgccagctgcagcagtaacaaattttcaactggataagggtgatacagcagaaagaactgtgatatcagaagttaactacacatggactaacacaagtaccacatcatcagatgtccatccattgttgtttgaaactagt

SEQ ID NO: 538 - protein, 701 aa, Solanum lycopersicum
  Solyc02g068660.1.1
MNLEFVCLLLLLSWLKVLDHSIAATSLAKPGCEERCGNLTIPYPFGLSASCSLNSWYVIKCDRSSDPPKPFMNSFLQVELQSEVISVSIENQTITTSVSIVNFCNKSSEGSRIITTGTDLSGSPFYYAKDRNKLMLVGCGNGLVTQKQNVLSGCTSICSEGATLTGCYGINCCQSLFPFDLSSYKANFTNSGIQQEAYPRCSAVFLVDQTWVPDEVAQPFVFLGYAPVVWLWTLQAKELEAGLLCDKSEAVVKLEDGTSVANWQCRCGNGTQGNPYFSNGCQANQRCTNCTEIVIYMKQSPKIVLLSVCISIGVLLLLLGSYLLYKTVKKRENKRQRQRFFKRNGGLLLQQQLSSNNEGTIDKGKLFTARELEKATDHFNENRILGRGGQGTVYKGMLPDGKIVAVKKSKLVDENQLDQFINEVAVLSQINHRNVVKLLGCCLETEVPLLVYEFIINGTLYSLIHNENNEFPFTWSTRLRIATEVAGALAYLHSATSVPVYHRDIKSSNILLDEKYRAKVSDFGTSRSIAIDQTHLTTGVQGTFGYLDPEYFQSSQYTEKSDVYSFGVVLAELLTGKKAISTTTNQDRSLATNFLLATERNLLDTIIYAKISQEGKREDIMAAANIAYRCMNLNGKKRPTMKEVTTALEAIRSQMPAAAVTNFQLDKGDTAERTVISEVNYTWTNTSTTSSDVHPLLFETS

SEQ ID NO: 539 - DNA, 2682 bp, Arabidopsis thaliana
  AT1G51800.1
atggcgttttcttcttgttttctcttagttcttctgcaaatcttctcagctttacttctttgtcttgctcaagatcagtcaggattcatcagtttggattgcggttcgcctagagaaactagctttcgtgagaaaacaacaaacattacttacatttccgatgcgaatttcatcaataccggtgttggtggaagcatcaaacaaggataccggactcagtttcagcaacaaacatggaacctacggagttttccacaaggcataagaaactgctataccttaaacctaaccataggcgacgaatatctaatcagagccaatttccttcacggcggttatgacgacaaaccctcaacgcaattcgagctctacctcggacctaatctttggtctacagttacaaccacgaacgagaccgaagcatcaatctttgagatgattcatatcttgaccactgatcgtttacaaatctgtctggtcaagacaggaaacgcaacgccttttatctccgctttagagcttcgtaaactcatgaacacaacttacttgactcgacaaggttccttgcagaccttcatcagagcagacgttggcgcgactgttaaccaaggctacaggtacggaatcgatgtgtttgatcgtgtctggactccgtataatttcggaaactggtcacagattagtaccaatcagtcagtgaatataaacaatgactatcaaccaccagagattgctatggtcacagcctctgttccaacagacccggacgcagctatgaacatttcgctagtcggggtggaacgtactgtgcagttctacgtttttatgcattttgcagagattcaagagctcaaatccaatgatacaagagagttcaacatcatgtacaataacaagcatatctatggaccttttagaccacttaatttcaccacgtcttccgtatttacacctaccgaagttgtcgccgatgcaaatgggcagtacatattttcgcttcaaagaacaggaaattcgactttacctcctctgctcaacgctatggagatttattcggttaacttgttgccgcaacaggaaactgatagaaaagaagttgatgcaatgatgaacatcaagtcggcttacggcgtgaacaagattgactgggaaggagatccttgcgtgccgctggattacaagtggtctggtgttaattgcacttatgttgacaatgagaccccaaagatcatttctttggatctgtctacaagtggcttgaccggagagatcttagaatttatatcagaccttaccagtttagaagttcttgacttgtctaacaattctttaactggttcagtcccagagtttctagctaatatggaaaccttaaaactcataaatctatctggaaatgagctaaatggctctatccctgcaactctccttgataaagaacgacgaggatctattacgttaagtatcgaaggaaataccgggctttgttcatctacatcatgcgctaccacgaaaaagaagaagaaaaacactgttattgcacctgttgcagcatcacttgtttcagtattcctcattggagctggaatcgttactttccttatcctcaagaggaagaagagaaccaagcttggtttgaatcctaattcaggaactggtacaacaccgttacattcgaggtctcaccacggttttgaacctcccgttatagcgaaaaaccggaaattgacttacattgatgttgttaagatcacaaacaactttgagagggttcttggtaggggtggttttggtgtggtttattacggcgtcttgaataatgaaccagttgcggtaaagatgctcactgagtccactgcacttggttacaaacagtttaaagccgaggttgagttgcttcttagagttcatcacaaagatctcacatgtcttgttggatattgtgaagaaggagataaaatgtctctaatctatgagttcatggcgaatggtgacttgaaagagcacttatcagggaagcgtggaccgtcgatactaacttgggaaggaaggcttcgtatagcagcggaatcagcgcaaggattggaatatttgcacaatggatgcaaaccgcaaatagttcaccgcgacattaagactactaacatcttattaaacgagaaatttcaagctaagcttgcggatttcgggctttcacggtcttttccacttggaactgaaactcacgtctcaaccatagttgctggaactcccggatatcttgatcctgaatactacagaactaattggttgaccgagaaaagtgatgtgttcagctttggtgttgttctactagagctagtaacaaaccaacccgtgatagacatgaaaagagaaaaatcacacatagctgaatgggtaggtttgatgctatcaagaggagacattaacagcattgtagatcctaagcttcaaggagactttgatccaaacacgatatggaaagttgttgagaccgcaatgacttgcctgaatccgtcttcttcacggagaccgacaatgactcaagtcgtaatggatctgaaagaatgtctgaacatggagatggcaagaaacatgggaagccgtatgacggattcaactaatgattcttcaattgagctgtccatgaatttcacaacagagcttaatccaggagctaga

SEQ ID NO: 540 - protein, 894 aa, Arabidopsis thaliana
  AT1G51800.1
MAFSSCFLLVLLQIFSALLLCLAQDQSGFISLDCGSPRETSFREKTTNITYISDANFINTGVGGSIKQGYRTQFQQQTWNLRSFPQGIRNCYTLNLTIGDEYLIRANFLHGGYDDKPSTQFELYLGPNLWSTVTTTNETEASIFEMIHILTTDRLQICLVKTGNATPFISALELRKLMNTTYLTRQGSLQTFIRADVGATVNQGYRYGIDVFDRVWTPYNFGNWSQISTNQSVNINNDYQPPEIAMVTASVPTDPDAAMNISLVGVERTVQFYVFMHFAEIQELKSNDTREFNIMYNNKHIYGPFRPLNFTTSSVFTPTEVVADANGQYIFSLQRTGNSTLPPLLNAMEIYSVNLLPQQETDRKEVDAMMNIKSAYGVNKIDWEGDPCVPLDYKWSGVNCTYVDNETPKIISLDLSTSGLTGEILEFISDLTSLEVLDLSNNSLTGSVPEFLANMETLKLINLSGNELNGSIPATLLDKERRGSITLSIEGNTGLCSSTSCATTKKKKKNTVIAPVAASLVSVFLIGAGIVTFLILKRKKRTKLGLNPNSGTGTTPLHSRSHHGFEPPVIAKNRKLTYIDVVKITNNFERVLGRGGFGVVYYGVLNNEPVAVKMLTESTALGYKQFKAEVELLLRVHHKDLTCLVGYCEEGDKMSLIYEFMANGDLKEHLSGKRGPSILTWEGRLRIAAESAQGLEYLHNGCKPQIVHRDIKTTNILLNEKFQAKLADFGLSRSFPLGTETHVSTIVAGTPGYLDPEYYRTNWLTEKSDVFSFGVVLLELVTNQPVIDMKREKSHIAEWVGLMLSRGDINSIVDPKLQGDFDPNTIWKVVETAMTCLNPSSSRRPTMTQVVMDLKECLNMEMARNMGSRMTDSTNDSSIELSMNFTTELNPGAR

SEQ ID NO: 541 - DNA, 2592 bp, Arabidopsis thaliana
  AT1G07550.1
atggacacttgcaccaggcttctgtttgctgcgtgtgccactttatccatcttacatcttgttcaatctcagaatcaacaaggattcatcagtttggattgtggattagcttctaacgagtctccttacaacgaagcaaatagcaatctgacgtacatatccgatgctgatttcattcaaggaggaaaaactggtaatgtccaaaaagacttgcttatgaaactcaggaagccatatacggttttgagatactttccggatggaatccgaaattgttacagtctaaatgtcaagcaagacacaaattatctaatcagggttatgtttcgatatggaaactatgacgggcttaacaattctccaagattcgacctctatcttggtcctaatatttggacaaccatagatatggggaagtcaggtgatggagttctggaggagatcattcacatcacaaggtctaacatcttggacatatgtctcgtcaagacagggacgagtacaccaatgatatcatccatagagttgagacccttgctatatgatacttatattgctcaaaccggttccttgaggaattataaccggttctatttcaccgattcaaacaactatatacgttatccccaagatgtgcatgatagaatttgggtgccgttgatattaccagaatggacgcatataaacacaagtcaccacgttattgattctatagatggctatgacccaccacaagatgtacttaggaccggcgccatgcccgctaatgccagtgatccaatgaccattacctggaatttgaagacggctactgaccaggtttacggttatatttacatcgccgagatcatggaagtccaggccaatgaaactagagaattcgaagttgtggtaaataataaagttcatttcgatcctttccgtcctaccagatttgaagcacaagttatgttcaacaatgtaccactgacatgcgagggaggattttgtcgtctgcaacttataaaaactccgaaatcgactcttccacccttgatgaatgctttcgaaattttcacgggcattgagtttcctcaatcagaaacaaatcaaaatgatgtcattgctgtaaagaatattcaagctagttatggactgaacagaatcagctggcagggcgatccatgtgtccctaaacagtttttgtggactggcttaagctgcaacgtaattgatgtgtccacaccaccaagaatcgtgaaattagatttgtcttcaagtggattaaatggagttataccacctagcatacaaaatctaactcaacttcaagaactggacctgtcccaaaacaacttgactggtaaagtgcctgaatttctagccaagatgaaatatttgttggtcataaacttaagtggaaacaaacttagcggtttggttcctcaagcccttcttgatagaaaaaaggaaggattaaagctattggttgacgaaaatatgatttgtgtgtcttgcggtacaagattcccaacagctgcggttgcggcatctgtttctgcagtggccattatcatacttgtgttagttctcatatttgttttaagaaggagaaagccatctgctgggaaagttacacgctcatccttcaaatcggaaaatagaagatttacttactctgacgttaacaaaatgacaaataactttcaagttgttattggtaaaggagggttcggtgttgtctatcaaggttgtttaaataatgaacaagcagctattaaagtgctttctcattcatcagctcagggctataaagaattcaaaacagaggtcgaactacttttaagagttcaccatgaaaagttagtaagcctcattggatattgtgatgatgataatggcttagctctcatctacgagttaatgggaaagggaaacttaaaagagcatctctcaggaaaacctggttgttctgttttgagctggccgataagacttaaaatagctcttgaatccgccataggaattgagtatttgcatactggatgcaagccaaaaatcgttcatagagatgtcaaaagtactaatatattgttgagtgaagaatttgaggccaaaattgctgatttcggactctcaagatccttcctaataggaaatgaagctcaacctacggttgttgctggaacatttggatatcttgatccggagtaccacaaaaccagcttgttaagcatgaagagtgatgtatatagctttggggttgtcttactggaaatcatcagcggccaagatgtgattgatttatcccgtgaaaattgtaacatagtggaatggaccagttttatactcgaaaatggtgatattgaaagtatagtggatccaaacctccatcaagattatgacacaagttctgcatggaaagttgttgaattggcaatgtcatgtgtgaaccgtacttccaaagagagaccaaacatgtctcaggtcgttcatgtgctaaacgaatgtttggaaacatgtgaaaagtggagaaaaagccaagaggtggacttaagcagtcctctggaactgagcatagttgtagacaccgaaataaacccaaaggcacgt

SEQ ID NO: 542 - protein, 864 aa, Arabidopsis thaliana
  AT1G07550.1
MDTCTRLLFAACATLSILHLVQSQNQQGFISLDCGLASNESPYNEANSNLTYISDADFIQGGKTGNVQKDLLMKLRKPYTVLRYFPDGIRNCYSLNVKQDTNYLIRVMFRYGNYDGLNNSPRFDLYLGPNIWTTIDMGKSGDGVLEEIIHITRSNILDICLVKTGTSTPMISSIELRPLLYDTYIAQTGSLRNYNRFYFTDSNNYIRYPQDVHDRIWVPLILPEWTHINTSHHVIDSIDGYDPPQDVLRTGAMPANASDPMTITWNLKTATDQVYGYIYIAEIMEVQANETREFEVVVNNKVHFDPFRPTRFEAQVMFNNVPLTCEGGFCRLQLIKTPKSTLPPLMNAFEIFTGIEFPQSETNQNDVIAVKNIQASYGLNRISWQGDPCVPKQFLWTGLSCNVIDVSTPPRIVKLDLSSSGLNGVIPPSIQNLTQLQELDLSQNNLTGKVPEFLAKMKYLLVINLSGNKLSGLVPQALLDRKKEGLKLLVDENMICVSCGTRFPTAAVAASVSAVAIIILVLVLIFVLRRRKPSAGKVTRSSFKSENRRFTYSDVNKMTNNFQVVIGKGGFGVVYQGCLNNEQAAIKVLSHSSAQGYKEFKTEVELLLRVHHEKLVSLIGYCDDDNGLALIYELMGKGNLKEHLSGKPGCSVLSWPIRLKIALESAIGIEYLHTGCKPKIVHRDVKSTNILLSEEFEAKIADFGLSRSFLIGNEAQPTVVAGTFGYLDPEYHKTSLLSMKSDVYSFGVVLLEIISGQDVIDLSRENCNIVEWTSFILENGDIESIVDPNLHQDYDTSSAWKVVELAMSCVNRTSKERPNMSQVVHVLNECLETCEKWRKSQEVDLSSPLELSIVVDTEINPKAR

SEQ ID NO: 543 - DNA, 2658 bp, Arabidopsis thaliana
  AT2G14440.1
atggagactcgtagcaagcttatgctactcgcttgtgccactttctccattatatctcttgttaagtctcaaaatcaacaaggattcatcagtctgtattgcggattaccttccaacgaatctccttatatcgaaccattgaccaatttaacatacatatcagatgttaatttcgtcagaggaggaaaaactggtaatatcaaaaataactcagacatagactttacttcgaggccatacaaggttttgagatactttccagaaggaattagaaactgctacagtttgagtgtaaagcaaggcacaaagtatctaatcagaactcttttcttttatggaaactatgacggtcttaatacttctccaagatttgacctctttctcggtccaaatatttggacaagcgtagatgtgcaaaaagtggatggaggtgatggagttatcgaggagatcattcacgtcacaaggtgtaatatcttggacatatgtctcgtcaaaacagggacgactacaccaatgatatcagccatagaattaagacctttgcgatatgatacttatactgctcgaacaggttccttaaagaaaattttgcacttctacttcaccaattcaggcaaggaagtacgttatcccgaagatgtctatgatcgtgtttggattccacattcacaaccggaatggactcaaataaacacaacccggaatgtaagtggcttttctgatggctacaacccaccacaagatgtaattaagacagcctccatacccactaatgtcagtgagccattgacctttacctggatgtcggaatcctctgatgacgaaacttatgcttacctttacttcgctgagattcaacaattaaaggccaatgaaactaggcaattcaaaatcctggtcaatggtgtttattacattgattatattccaaggaagtttgaagcggaaaccttaatcacccctgcagcactaaaatgcgggggaggggtatgtcgtgtgcagctttcaaaaacaccgaagtcgactctaccaccccaaatgaatgctatagagatttttagcgtcatacaatttccacaatcggacacaaatacggatgaagtcattgctatcaagaacattcaatctacttataaagtgagtagaatcagctggcagggcgatccatgtgtacctatacagttttcatggatgggtgtaagctgcaacgttatagacatctccacaccaccaagaatcatctcattagatttgtcttcgagtggattaactggagttataacgcctagcatacagaatctaactatgcttcgagaattggatttatcaaataacaacttgactggagttataccgcctagcctacagaatctaactatgcttcgagaattggatttatcaaataacaacttgactggagaagtgcctgaatttctagccacgatcaaaccgttgttggtcatacacttaagaggaaataatcttaggggttctgttcctcaagcccttcaagatagagaaaataatgatggtttaaaactattgcgcgggaaacaccaaccaaaatcctggctggtggcgattgttgcatctatatcttgtgtggccgttactataatcgtgttggttctcatcttcattttcagaaggaggaagtcatcaacacgcaaagttatacgtccatcattggaaatgaaaaatagaagatttaagtattcagaggttaaagaaatgactaataactttgaagttgttctcggtaaaggaggctttggtgttgtttatcatggttttctcaataatgaacaagtagccgtcaaagttctctctcaatcatcaactcaaggctacaaggaattcaaaacagaagtcgaactacttctaagagttcaccacgtgaatttagtaagccttgttggatactgtgataaaggaaatgacttggctctcatctacgagttcatggaaaatggaaacttaaaggaacatctctcgggaaaacgtggtggccctgtcttgaattggcctggtagactgaaaatagctattgagtctgcactaggaattgagtacttgcatattggatgtaagccgccaatggttcacagagatgtaaaaagtaccaatatactgttaggtctacggtttgaagccaaacttgccgatttcggactttcaagatctttcctagtgggaagtcaaactcatgtatcaacaaatgttgctggaactcttggatatcttgatcccgaatattatcaaaagaattggttaacagagaagagtgatgtttatagctttgggattgtgttacttgaaatcatcactggccaacctgtgattgaacaatcgcgtgataagtcttacatagtagaatgggccaagtctatgcttgcaaatggtgatattgaaagtattatggatcgaaatctccatcaagattacgacacaagttcatcttggaaagctcttgaattagcgatgttgtgcattaacccttcttccacactgagaccaaacatgactcgggttgctcatgagctaaatgagtgtttggaaatatataaccttactaaaagaaggagccaagatcaaaattcaagtaagtcctcgggacataccgtaacattcatcagtgatatcccttcagctcgt

SEQ ID NO: 544 - protein, 886 aa, Arabidopsis thaliana
  AT2G14440.1
METRSKLMLLACATFSIISLVKSQNQQGFISLYCGLPSNESPYIEPLTNLTYISDVNFVRGGKTGNIKNNSDIDFTSRPYKVLRYFPEGIRNCYSLSVKQGTKYLIRTLFFYGNYDGLNTSPRFDLFLGPNIWTSVDVQKVDGGDGVIEEIIHVTRCNILDICLVKTGTTTPMISAIELRPLRYDTYTARTGSLKKILHFYFTNSGKEVRYPEDVYDRVWIPHSQPEWTQINTTRNVSGFSDGYNPPQDVIKTASIPTNVSEPLTFTWMSESSDDETYAYLYFAEIQQLKANETRQFKILVNGVYYIDYIPRKFEAETLITPAALKCGGGVCRVQLSKTPKSTLPPQMNAIEIFSVIQFPQSDTNTDEVIAIKNIQSTYKVSRISWQGDPCVPIQFSWMGVSCNVIDISTPPRIISLDLSSSGLTGVITPSIQNLTMLRELDLSNNNLTGVIPPSLQNLTMLRELDLSNNNLTGEVPEFLATIKPLLVIHLRGNNLRGSVPQALQDRENNDGLKLLRGKHQPKSWLVAIVASISCVAVTIIVLVLIFIFRRRKSSTRKVIRPSLEMKNRRFKYSEVKEMTNNFEVVLGKGGFGVVYHGFLNNEQVAVKVLSQSSTQGYKEFKTEVELLLRVHHVNLVSLVGYCDKGNDLALIYEFMENGNLKEHLSGKRGGPVLNWPGRLKIAIESALGIEYLHIGCKPPMVHRDVKSTNILLGLRFEAKLADFGLSRSFLVGSQTHVSTNVAGTLGYLDPEYYQKNWLTEKSDVYSFGIVLLEIITGQPVIEQSRDKSYIVEWAKSMLANGDIESIMDRNLHQDYDTSSSWKALELAMLCINPSSTLRPNMTRVAHELNECLEIYNLTKRRSQDQNSSKSSGHTVTFISDIPSAR

SEQ ID NO: 545 - DNA, 2604 bp, Arabidopsis thaliana
  AT2G14510.1
atggagactcgtaacaagtttatgctactcgcttgtgccactttctccattatgtctcttgttaagtctcaaaatcaacaaggattcatcagtttggattgcggattaccgtctaaagaatcttatatcgaaccatcgagtaatttaacattcatatcagatgtcaatttcatccgaggaggaaaaactggtaatatccaaaataactcacgtacaaactttatctttaagccattcaaggttttgagatactttccggatggaattagaaactgctacagtttgagtgtgaagcaaggcacaaagtatctaatcaggactcttttctattatggaaactatgacggtcttaatacttctccgcgatttgacctctttctcggtccaaatatttggacaagcgtagatgtgctaatagcggatgtaggtgatggagttgtcgaggagatcgttcacgtcacaaggtctaacatcttggacatatgtctcgtcaaaacagggacaagtacaccaatgatatcagccatagaactaagacctttgcgatatgatacttatactgctcgaaccggttccttaaagagtatggcgcacttctacttcaccaattcagacgaggcaatacgttatcccgaagatgtctatgatcgtgtttggatgccatattcacaaccggaatggactcaaataaacacaacccggaatgtaagtggcttttcggatggctacaatccgccacaaggtgtaattcagaccgcctccatacccactaatggcagcgagccattgacctttacatggaatttggaatcctctgatgacgaaacttatgcttaccttttctttgctgagatccaacaattaaaggtcaatgaaactagggaattcaaaattttggcgaatggtgttgattacattgattatactccatggaagtttgaagcaagaaccttatccaaccctgcaccactaaaatgcgagggaggggtatgtcgtgtgcagctgtcaaaaacaccgaagtcgactctaccaccactaatgaatgctatagagatttttagcgtcatacaatttccacaatcggacacaaatacggatgaagtcattgctatcaagaaaattcaatcaacttatcaattgagtagaatcagctggcagggcgatccatgtgtacctaaacagttttcatggatgggtgtaagctgcaacgttatagatatctccacaccaccaagaatcatctcattagatttgtctttgagtggattaactggagttatatcgcctagcatacagaacctaactatgcttcgagaattggatttatcaaataacaacttgactggagaagtgcctgaatttctagccactatcaaaccgttgttggtcatacacttaagaggaaacaatcttagaggttctgttcctcaagcccttcaagatagagaaaagaatgatggtttaaaactatttgttgatccaaatataacgcggcgcgggaaacaccaaccaaaatcctggctggtggcgattgttgcatctatatcttgtgtggccgttactataatcgtgttggttctcatcttcattttcagaaggaggaagtcatcaacacgcaaagttatacgtccatcattggaaatgaaaaatagaagatttaagtattcagaggtcaaagaaatgactaacaactttgaagttgttctcggtaaaggaggctttggtgttgtttatcatggttttctcaataatgaacaagtagccgtcaaagttctctctcaatcatcaactcaaggctacaaggaattcaaaacagaagtcgaactacttctaagagttcaccatgtgaatttagtaagccttgtcggatactgtgatgaaggaattgacttggctctcatctacgagttcatggaaaatggaaacttaaaggagcatctttcgggaaaacgtggtggctctgtcttgaattggtcgagtagacttaaaatagctattgagtctgcactaggaattgagtacttgcatattggatgtcagccgccaatggtacatagagatgtaaaaagtaccaatatactgttaggtctacggtttgaagccaaacttgccgatttcggactttcaagatcttttctagtgggaagtcaagctcatgtatcaacaaatgttgctggaactcttggatatcttgatcccgaatattatctaaagaattggttaacagagaagagtgatgtttatagctttggaattgtgttacttgaaagtatcactggtcaacctgtgattgaacaatcgcgtgataagtcttacatagtagaatgggccaagtctatgcttgcaaatggtgatattgaaagtattatggatccgaatctccatcaagattacgactcaagttcatcttggaaagctcttgaattagcgatgttgtgcattaacccttcttccacacagagaccaaacatgactcgggttgctcatgagcttaatgaatgtttggaaatatataaccttactaaaataaggagccaagatcaaaattcaagcaagtccttgggacataccgtaactttcatcagtgatatcccttcagctcgt

SEQ ID NO: 546 - protein, 868 aa, Arabidopsis thaliana
  AT2G14510.1
METRNKFMLLACATFSIMSLVKSQNQQGFISLDCGLPSKESYIEPSSNLTFISDVNFIRGGKTGNIQNNSRTNFIFKPFKVLRYFPDGIRNCYSLSVKQGTKYLIRTLFYYGNYDGLNTSPRFDLFLGPNIWTSVDVLIADVGDGVVEEIVHVTRSNILDICLVKTGTSTPMISAIELRPLRYDTYTARTGSLKSMAHFYFTNSDEAIRYPEDVYDRVWMPYSQPEWTQINTTRNVSGFSDGYNPPQGVIQTASIPTNGSEPLTFTWNLESSDDETYAYLFFAEIQQLKVNETREFKILANGVDYIDYTPWKFEARTLSNPAPLKCEGGVCRVQLSKTPKSTLPPLMNAIEIFSVIQFPQSDTNTDEVIAIKKIQSTYQLSRISWQGDPCVPKQFSWMGVSCNVIDISTPPRIISLDLSLSGLTGVISPSIQNLTMLRELDLSNNNLTGEVPEFLATIKPLLVIHLRGNNLRGSVPQALQDREKNDGLKLFVDPNITRRGKHQPKSWLVAIVASISCVAVTIIVLVLIFIFRRRKSSTRKVIRPSLEMKNRRFKYSEVKEMTNNFEVVLGKGGFGVVYHGFLNNEQVAVKVLSQSSTQGYKEFKTEVELLLRVHHVNLVSLVGYCDEGIDLALIYEFMENGNLKEHLSGKRGGSVLNWSSRLKIAIESALGIEYLHIGCQPPMVHRDVKSTNILLGLRFEAKLADFGLSRSFLVGSQAHVSTNVAGTLGYLDPEYYLKNWLTEKSDVYSFGIVLLESITGQPVIEQSRDKSYIVEWAKSMLANGDIESIMDPNLHQDYDSSSSWKALELAMLCINPSSTQRPNMTRVAHELNECLEIYNLTKIRSQDQNSSKSLGHTVTFISDIPSAR

SEQ ID NO: 547 - DNA, 2613 bp, Arabidopsis thaliana
  AT1G07560.1
atgaaaaacctccgtggacttctattggccttcctagttttgtctttaggcatttccgattttcttcgagcacaagatcaacaaggattcatcagtttggattgcgggttgcaagccgatgagtctccttataccgaaccattaacaaagttaacattcacatcagacgccgatttcatcaaaagtggaaaaagcggcaagattcaaaatgttccggggatggagtatataaagccatacacggttttgagatattttccagatggagtacgaaactgttatactcttatcgtcatacaaggcacaaactatctgatcgtagccatgtttacttatggaaactacgataatcttaacacacacccaaagttcgacctttatcttggtccaaatatatggaccacggtcgatttgcaaagaaatgtaaacggaacaagggcggaaatcattcacataccaaggtcaacttctttgcagatttgtcttgttaagacgggaacaactacgccgctaatatcagctttagaactacgaccattgagaaataatacttatattcctcaatctggttccctcaagacattgttccgcgtccatttgactgattccaaagaaactgttcggtatccagaagatgtccatgatcgtctttggagtccatttttcatgccggaatggagactgttaagaacaagtctcacggtcaacacttctgatgataacggctatgacataccggaagacgtagtggttacggcagccacacctgcaaatgtgagttcaccattaaccatttcttggaatttggaaacacctgacgacttagtttatgcatacctccacgtcgctgagatccaatccttaagggaaaatgataccagggaattcaacattagcgcaggccaagatgttaactatggacctgttagtcctgacgagtttctagtgggtactctattcaatacatcaccagttaaatgtgaaggagggacatgccatttgcaactaataaaaactccaaaatcaactctccctcccctcctcaatgctattgaggcttttataacagtggagtttccgcagtctgaaactaatgcaaatgacgtccttgctatcaagagcatagaaacaagctatggattaagtagaattagttggcaaggagatccatgtgttcctcaacaattattgtgggatggtcttacctgcgagtacaccaatatgtctacaccaccaagaatccattccttagacttgtcctcaagtgaactaactggaattatagttcctgagatccaaaatcttacggagcttaaaaaattggacttttcaaataataatctaacaggtggagtacctgaatttctagccaaaatgaaatcattgttagtcataaacttaagcggaaacaaccttagtggatcagtccctcaagctcttctcaacaaagtgaaaaatgggttgaagttgaacattcagggaaatccaaacctatgtttttccagttcatgcaacaaaaagaaaaatagcatcatgttaccagttgttgcatcacttgcttctttggctgctataatagcaatgatcgctctgctttttgtttgtattaaaagacgctcatcaagcagaaaaggtccatcaccaagccaacaatcaatagaaacaataaagaaaagatatacatatgccgaagttcttgccatgacaaagaaatttgaaagggttttgggtaaaggaggatttggaatggtctatcatggttatataaatggtactgaagaagtagcggtcaagctactctctccatcatcagctcaaggctataaagagttcaaaacagaggtagaacttcttctaagggtttaccacacaaatctggtaagtcttgttggatactgtgatgaaaaagatcatctggccctcatctaccagtacatggtcaatggcgatttgaaaaaacatttttcaggtagctccatcattagctgggttgatagactaaacatagctgttgatgcagcgtcaggtttggagtacttgcatattggttgcaaaccgctgatagttcatagagatgtaaaaagttctaacatactattggacgatcaattacaagctaagcttgcagattttgggctttctagatcttttcccattggggatgaatctcatgtgtctacacttgttgctggaacatttggataccttgatcatgaatactaccaaactaataggttgtctgagaagagtgatgtctacagttttggtgttgtactgctagaaattattacaaacaaaccggtgatcgatcataaccgcgacatgcctcacatagcagaatgggtgaaacttatgcttactagaggagacattagcaatattatggatcctaaacttcaaggggtctatgactctggttctgcatggaaagctcttgaattagcaatgacatgtgtgaatccttcttccttgaaaagacccaacatgtcccatgttgttcatgagctgaaggagtgtctggtatctgaaaacaacaggacaagagacatagacacatcgagatccatggacattaacttaagctttggcacagatgtgaaccccaaggcacgt

SEQ ID NO: 548 - protein, 871 aa, Arabidopsis thaliana
  AT1G07560.1
MKNLRGLLLAFLVLSLGISDFLRAQDQQGFISLDCGLQADESPYTEPLTKLTFTSDADFIKSGKSGKIQNVPGMEYIKPYTVLRYFPDGVRNCYTLIVIQGTNYLIVAMFTYGNYDNLNTHPKFDLYLGPNIWTTVDLQRNVNGTRAEIIHIPRSTSLQICLVKTGTTTPLISALELRPLRNNTYIPQSGSLKTLFRVHLTDSKETVRYPEDVHDRLWSPFFMPEWRLLRTSLTVNTSDDNGYDIPEDVVVTAATPANVSSPLTISWNLETPDDLVYAYLHVAEIQSLRENDTREFNISAGQDVNYGPVSPDEFLVGTLFNTSPVKCEGGTCHLQLIKTPKSTLPPLLNAIEAFITVEFPQSETNANDVLAIKSIETSYGLSRISWQGDPCVPQQLLWDGLTCEYTNMSTPPRIHSLDLSSSELTGIIVPEIQNLTELKKLDFSNNNLTGGVPEFLAKMKSLLVINLSGNNLSGSVPQALLNKVKNGLKLNIQGNPNLCFSSSCNKKKNSIMLPVVASLASLAAIIAMIALLFVCIKRRSSSRKGPSPSQQSIETIKKRYTYAEVLAMTKKFERVLGKGGFGMVYHGYINGTEEVAVKLLSPSSAQGYKEFKTEVELLLRVYHTNLVSLVGYCDEKDHLALIYQYMVNGDLKKHFSGSSIISWVDRLNIAVDAASGLEYLHIGCKPLIVHRDVKSSNILLDDQLQAKLADFGLSRSFPIGDESHVSTLVAGTFGYLDHEYYQTNRLSEKSDVYSFGVVLLEIITNKPVIDHNRDMPHIAEWVKLMLTRGDISNIMDPKLQGVYDSGSAWKALELAMTCVNPSSLKRPNMSHVVHELKECLVSENNRTRDIDTSRSMDINLSFGTDVNPKAR

SEQ ID NO: 549 - DNA, 2640 bp, Arabidopsis thaliana
  AT2G28960.1
atggaaggtcgtcgtcaacgtttactggtgttcatctttggggctttggccattacacatcttgttcaagctcagccgcctgatcaacgaggattcatcagtttggattgcggtttacccgttaatgagtctccttataccgacccacgaaccggattaacattctcatctgatgctgattttattttaagtggtttacgtggtgaagctggggatgataacacatatatctacaggcagtacaaggatttgagatattttcccgatggaatacgaaactgctataatctgaaagtagagcaaggcatcaactatttgataagagcagggttcggatatggaaattatgatggtcttaatgtatatcccaaatttgatttacatgttgggcctaacatgtggattgcggttgatttggaattcggaaaagatcgtgagatcatttacatgacaacgtcgaacttattgcagatttgtcttgtcaaaacaggatcaactataccaatgatatcaaccttggaactacggccactaagaaatgattcatatttgactcaattcggtcccttagacctcatctaccggcgggcctatagtagcaattctaccggttttatacggtatcctgatgatatttttgatcgcaaatgggaccgatataatgaatttgaaacggatgtgaacaccaccctcaacgtgagatcctcgagtccctttcaagtaccagaagctgtaagtaggatgggaatcacgcccgaaaatgccagcttgccattgagattttacgtgtctctagatgacgacagtgacaaggttaacgtgtactttcactttgccgaaatccaagctttgaggggcaatgagactagagaattcgacattgaattggaagaagatattattcagtcagcatatagtcctacgatgttacaatcagataccaaatataacctatcacctcacaaatgtagctccgggttgtgctacttgaaactcgttagaactccaaggtcaactcttccaccgctgattagtgctattgaggctttcaaggttgtggactttccatacgctgaaacaaatccaaatgacgtcgctgctatgaaggatatcgaagcattttatggattgaagatgattagttggcaaggagatccttgtgtccctgaactattaaagtgggaagatctaaaatgcagctacacaaataagtctactcctccaagaattatttctttagatttgtcatcacgagggttaaaaggggtcattgcgcctgccttccaaaatttgaccgagcttcgaaaactagacttgtcaaataatagttttactggaggagtgcccgagtttctagccagcatgaagtcattatcgatcataaatttaaattggaatgaccttacgggtcctcttcctaaattgcttcttgatagagaaaagaatgggcttaagctaacgatccaaggaaacccaaagttgtgtaacgatgcgtcatgcaaaaataataacaatcaaacgtacattgtaccagttgttgcgtcagtagcttctgtgctcatcattatagccgtactgattctcattcttgttttcaaaaagagaaggccaacgcaagttgattcattacctacagtgcaacatgggttaccaaatagaccgtctatatttactcaaacgaaaaggttcacttattcagaggtagaagcattaacagataattttgaaagagttcttggagaaggagggtttggggtagtgtatcatggtattttaaatggtacgcaaccaatagctgttaaactactctctcaatcatcagtacaaggctataaggaattcaaagctgaggttgaacttcttttgagagtgcaccacgtcaatttggttagtttggttggatattgtgatgaagaaagcaacttggccctgctttatgagtatgcaccgaacggagacttaaaacaacatctatcaggagaacggggtggctctccattgaagtggtcaagtagactaaaaattgtcgtcgaaactgcgcaaggattagaatacttgcatacgggttgcaaacctccaatggtacatcgtgatgtaaaaacaacaaatatacttttagacgaacacttccaagcaaaactcgccgattttggcctttcaagatcatttccagttggaggtgaaactcatgtttcaacagctgttgctggaactcctggatatttggatcccgaatattatcgaacaaataggttgaacgaaaagagtgatgtatatagctttgggattgtattattggagatcatcacaagtcgacctgtgattcagcaaacccgagagaagccgcacatagcagcatgggtgggatacatgcttactaagggagatattgagaacgttgtggatccaagactcaatagagattatgagcctacttctgtttggaaggctcttgagatagcaatgtcttgcgtgaatccttcttcggagaaaagaccaaccatgtctcaagttactaatgaactaaagcaatgtctaacattagaaaactcaaagcgaggagtgagagaagacatgggatcaagaagttctgttgaaatgagcacaagctttacaaccgaaattaacccaaaagcacga

SEQ ID NO: 550 - protein, 880 aa, Arabidopsis thaliana
  AT2G28960.1
MEGRRQRLLVFIFGALAITHLVQAQPPDQRGFISLDCGLPVNESPYTDPRTGLTFSSDADFILSGLRGEAGDDNTYIYRQYKDLRYFPDGIRNCYNLKVEQGINYLIRAGFGYGNYDGLNVYPKFDLHVGPNMWIAVDLEFGKDREIIYMTTSNLLQICLVKTGSTIPMISTLELRPLRNDSYLTQFGPLDLIYRRAYSSNSTGFIRYPDDIFDRKWDRYNEFETDVNTTLNVRSSSPFQVPEAVSRMGITPENASLPLRFYVSLDDDSDKVNVYFHFAEIQALRGNETREFDIELEEDIIQSAYSPTMLQSDTKYNLSPHKCSSGLCYLKLVRTPRSTLPPLISAIEAFKVVDFPYAETNPNDVAAMKDIEAFYGLKMISWQGDPCVPELLKWEDLKCSYTNKSTPPRIISLDLSSRGLKGVIAPAFQNLTELRKLDLSNNSFTGGVPEFLASMKSLSIINLNWNDLTGPLPKLLLDREKNGLKLTIQGNPKLCNDASCKNNNNQTYIVPVVASVASVLIIIAVLILILVFKKRRPTQVDSLPTVQHGLPNRPSIFTQTKRFTYSEVEALTDNFERVLGEGGFGVVYHGILNGTQPIAVKLLSQSSVQGYKEFKAEVELLLRVHHVNLVSLVGYCDEESNLALLYEYAPNGDLKQHLSGERGGSPLKWSSRLKIVVETAQGLEYLHTGCKPPMVHRDVKTTNILLDEHFQAKLADFGLSRSFPVGGETHVSTAVAGTPGYLDPEYYRTNRLNEKSDVYSFGIVLLEIITSRPVIQQTREKPHIAAWVGYMLTKGDIENVVDPRLNRDYEPTSVWKALEIAMSCVNPSSEKRPTMSQVTNELKQCLTLENSKRGVREDMGSRSSVEMSTSFTTEINPKAR

SEQ ID NO: 551 - DNA, 2616 bp, Arabidopsis thaliana
  AT2G29000.1
atggagggtcatcgaggattattgttggcactgatagtcaacattttttccattgtacaccttgttcatgctcagaatccggaaggatttatcagcttggattgtggtttacccgccaaagagtctccttataccgaaagcacaacaagcttggtattcacctctgatgcaaattttatctcaagtgggattagtactaaactcccaaaacatgatgactacaagccatataatttcttaagatattttcctgacggaacacgacattgctatgatttaagtgtaaagcagggtactaattatctgatcagagctagcttcgtatatgggaattatgacggtcgtaatattatgcccagatttgatctgtatatagggcctaatatatgggcagtagtgtcggagttggacctatacagcccagaggaagagatcattcacatgacaaagtcaacttctttacagatttgtcttgtcaaaacaggaccaactacacctttcatatcaactttggagctacggcctttgagaaatgataattatattactcaatctggttctttgaagctcatgcagcggatgtgtatgaccgagactgttagcacactacggtatcctgatgatgtctatgatcgtctctggtatacagatggtatatacgaaacaaaagcagtaaagacagctctgagtgtcaattctactaatccatttgaactaccccaagtcataattaggtcagcagctacgcccgtaaatagcagtgagccaataaccgttgaatacggtggatattcctccggtgatcaagtctatttgtatctacattttgccgagatccaaaccctaaaagccagcgataacagggaatttgatattgtgtgggctaataatattaaaaagctggcttataaacctaaggtatcacaaatagataccttactcaacacatcaccgaataaatgtgataatacattttgcaaagcgttcctagtgaggactcaaaggtcaactctaccaccactacttaacgcctatgaggtctacattcttgtggagtttccatactcagagacacatcccgacgatgtcgttgctatcaagaaaatcaaagccgcttatggattgaagataatcagttggcaaggagatccttgcctccctagagaatataagtgggagtatatagaatgcagctacaccaataactctattcccccaagaatcatttccttagacttatcaaaccgtgggttaaaagggatcatagagcccgtcttacaaaacttaacccagcttgaaaaactggacttatcaattaaccgtttatccggcgaagtgcctgagtttctggccaacatgaaatcattgtcgaacataaacttaagttggaataatctaaaaggtctgattcctccagcccttgaggagaaaagaaagaatggacttaaactaaatactcaaggaaatcaaaatctatgtcctggggatgaatgcaaaagaagcatcccaaaatttcctgtaacaactgttgtgtcgatttctgcaattctgcttactgtagttgtgctacttattgttttcatttacaaaaagaaaaagacgtcaaaagttcgtcacagattaccaattactaaatctgaaatcttaaccaaaaagagaaggtttacatattcagaagtcgaagcagtgacaaataagtttgaaagagttataggagaaggagggtttggaattgtgtatcatggtcatttgaatgatactgaacaagtagctgttaaacttctctctcattcatcaactcaaggctataagcaatttaaggcagaggtagaactgcttttaagagtccaccatacaaacttggtaaatcttgttggatattgtaatgaagaagaccacttggcccttgtctatgagtatgcagctaacggggacttaaagcaacatctttcaggagagtctagttccgctgctttaaattgggcaagcagacttggaatcgctaccgagactgcacaaggattagagtacttacacattggatgtgaacctccaatgattcatagagatgtcaaaacgacgaatatacttttggacgagcatttccatgctaaacttgctgattttggactttccagatcatttccagtaggagttgaatcccatgtatcaacaaatgttgctggcactcctggatatcttgatcctgaatattatcgaacaaattggttaactgaaaaaagtgatgtatatagtatgggcattgtcctgttagagattatcacaaaccagcctgtgatacaacaagtccgtgaaaagcctcatatagctgaatgggtggggttgatgcttactaaaggagatattaaaagtataatggatccaaaactgaatggggaatatgactcaagttccgtttggaaggctcttgagctagctatgtcatgtgtgaacccctcttcagggggaagaccaaccatgtctcaggttataagtgaacttaaagaatgtctcatttatgagaactcaagaaaagaaggacgatcagaagtagactcaaaaagttccattgaactgtccaccagtttcaccgctgaagtgacccctgatgcacgg

SEQ ID NO: 552 - protein, 872 aa, Arabidopsis thaliana
  AT2G29000.1
MEGHRGLLLALIVNIFSIVHLVHAQNPEGFISLDCGLPAKESPYTESTTSLVFTSDANFISSGISTKLPKHDDYKPYNFLRYFPDGTRHCYDLSVKQGTNYLIRASFVYGNYDGRNIMPRFDLYIGPNIWAVVSELDLYSPEEEIIHMTKSTSLQICLVKTGPTTPFISTLELRPLRNDNYITQSGSLKLMQRMCMTETVSTLRYPDDVYDRLWYTDGIYETKAVKTALSVNSTNPFELPQVIIRSAATPVNSSEPITVEYGGYSSGDQVYLYLHFAEIQTLKASDNREFDIVWANNIKKLAYKPKVSQIDTLLNTSPNKCDNTFCKAFLVRTQRSTLPPLLNAYEVYILVEFPYSETHPDDVVAIKKIKAAYGLKIISWQGDPCLPREYKWEYIECSYTNNSIPPRIISLDLSNRGLKGIIEPVLQNLTQLEKLDLSINRLSGEVPEFLANMKSLSNINLSWNNLKGLIPPALEEKRKNGLKLNTQGNQNLCPGDECKRSIPKFPVTTVVSISAILLTVVVLLIVFIYKKKKTSKVRHRLPITKSEILTKKRRFTYSEVEAVTNKFERVIGEGGFGIVYHGHLNDTEQVAVKLLSHSSTQGYKQFKAEVELLLRVHHTNLVNLVGYCNEEDHLALVYEYAANGDLKQHLSGESSSAALNWASRLGIATETAQGLEYLHIGCEPPMIHRDVKTTNILLDEHFHAKLADFGLSRSFPVGVESHVSTNVAGTPGYLDPEYYRTNWLTEKSDVYSMGIVLLEIITNQPVIQQVREKPHIAEWVGLMLTKGDIKSIMDPKLNGEYDSSSVWKALELAMSCVNPSSGGRPTMSQVISELKECLIYENSRKEGRSEVDSKSSIELSTSFTAEVTPDAR

SEQ ID NO: 553 - DNA, 2694 bp, Arabidopsis thaliana
  AT4G20450.1
atggaaggtattcacaagcttattttcttggccctaatatggatttttttgataactaatatcgttgatgctcaagatcaacaaggattcatcagcttagattgcggaatgccccgtaacgagtctagttataccgacgagtccaccggtttgaatttctcatccgacgctgattttattagcagcggaaaaagtggtaccatcaagaccgaagactctgattctggcgtgaaatacataaagccatataagcagcttaggtattttcctgaaggagcacgaaactgctataatctgactgtcatgcagggcacacattatcttatcagagccgtgttcgtatatggaaattatgacctcaaacaaagaccaaaatttgatctatatcttggccccaatttctggacaactataaatttgcaagatccttcgggtggtttctattatcggatttggttgcaagatggtaccgtagaggaggtaatccacatgccaaagtcaaacaatttggatatttgtttggttaagacaggaacaacgacgccattcatatcatccttggaactacgtcccttgagagatgacacctatactactacaaccggctctctaaagctaatctcccgctggtatttcaggaagcctttccccactcttgaatccatcatacgacatccagatgatgtccatgaccgtctatgggacgtataccatgcggatgaagaatggacagatataaacaccaccacccctgtaaatacaactgttaatgcctttgatctgccacaagctataatttcaaaggcttccataccccaagttgcaagtgatacatggagcacaacctggtcgatacaaaacccggacgacgacgttcacgtgtaccttcactttgccgagatccaagccttgaagcccagtgataccagagagtttagtatcttgtggaataaaaacacaatcattagggattactacagtcctctagagttcatggctgacactgtacctataagaacctcgagtaaatgcggtgacgatggtttctgctccctagatctcacaagaactaagtcgtcaactcttccaccatattgtaatgcgatggaggttttcgggttactccagcttcttcagaccgaaacagatgaaaacgacgtcactacattgaagaacattcaagccacttatagaatacaaaaaacgaactggcaaggagatccatgtgtacctatacagtttatatggactggcctaaactgtagcaacatgtttccgtctattccaccaagaatcacttccatagacttttctaactttggattaaatgggaccataacaagtgatatacaatatcttaaccagctacagaaattggacctgtcaaataacaacttgacgggaaaggtgcctgaatttctcgccaaaatgaagttgttgacattcataaacttgagtgggaacaatcttagcggctcaattcctcaaagccttctcaacatggaaaagaatgggctaataacgttgctgtataatggaaataacctctgtttggatccatcatgcgaaagtgaaactggtcctgggaataacaaaaagaaattgctagtacctattcttgcatcagctgcttctgtgggaattattatagctgtgcttcttctcgtcaacattctcttacttagaaagaagaagccatccaaagcttcacgctcatcaatggtggcgaacaagagaagctatacttatgaagaggttgcggtaattacaaacaattttgagagacctcttggcgaaggaggatttggagtcgtgtaccacggtaatgtaaatgataacgaacaagtggctgtaaaggtgctctctgaatcctcagctcaaggatataagcaatttaaagctgaggtagaccttcttctcagagtacaccacataaatttagtaactcttgttggttattgtgacgaaggacaacacttggtcctcatctacgagtacatgtccaatggaaacttaaaacaacatctatctggagaaaattctaggtcccctttgagttgggaaaataggctaagaattgctgcagagacagcacaaggactggagtacttgcatatcggctgcaaaccaccaatgattcatagagatatcaaatctatgaatatacttcttgataataatttccaggccaaacttggtgatttcgggctttcaagatcttttccggtgggaagtgaaactcatgtgtcaacaaatgttgctggatctccaggttatcttgaccctgaatattaccgaacaaactggttgacagagaagagtgatgtcttcagttttggagtcgtattactggaaatcatcacaagtcagccagtgattgaccaaactcgtgagaagtctcacataggagaatgggtgggatttaagttaaccaatggagatatcaaaaatattgtggatccaagtatgaacggtgattatgactctagttcattgtggaaggctcttgagttagcaatgtcatgcgtcagtccatcttcatccggaagaccaaatatgtcccaggttgctaatgaactacaagagtgtctcttaactgagaactcaaggaaaggagggagacatgacgtggactccaagagttctcttgaacagagcacaagctttggtcctgaacatatccctgatgcacgc

SEQ ID NO: 554 - protein, 898 aa, Arabidopsis thaliana
  AT4G20450.1
MEGIHKLIFLALIWIFLITNIVDAQDQQGFISLDCGMPRNESSYTDESTGLNFSSDADFISSGKSGTIKTEDSDSGVKYIKPYKQLRYFPEGARNCYNLTVMQGTHYLIRAVFVYGNYDLKQRPKFDLYLGPNFWTTINLQDPSGGFYYRIWLQDGTVEEVIHMPKSNNLDICLVKTGTTTPFISSLELRPLRDDTYTTTTGSLKLISRWYFRKPFPTLESIIRHPDDVHDRLWDVYHADEEWTDINTTTPVNTTVNAFDLPQAIISKASIPQVASDTWSTTWSIQNPDDDVHVYLHFAEIQALKPSDTREFSILWNKNTIIRDYYSPLEFMADTVPIRTSSKCGDDGFCSLDLTRTKSSTLPPYCNAMEVFGLLQLLQTETDENDVTTLKNIQATYRIQKTNWQGDPCVPIQFIWTGLNCSNMFPSIPPRITSIDFSNFGLNGTITSDIQYLNQLQKLDLSNNNLTGKVPEFLAKMKLLTFINLSGNNLSGSIPQSLLNMEKNGLITLLYNGNNLCLDPSCESETGPGNNKKKLLVPILASAASVGIIIAVLLLVNILLLRKKKPSKASRSSMVANKRSYTYEEVAVITNNFERPLGEGGFGVVYHGNVNDNEQVAVKVLSESSAQGYKQFKAEVDLLLRVHHINLVTLVGYCDEGQHLVLIYEYMSNGNLKQHLSGENSRSPLSWENRLRIAAETAQGLEYLHIGCKPPMIHRDIKSMNILLDNNFQAKLGDFGLSRSFPVGSETHVSTNVAGSPGYLDPEYYRTNWLTEKSDVFSFGVVLLEIITSQPVIDQTREKSHIGEWVGFKLTNGDIKNIVDPSMNGDYDSSSLWKALELAMSCVSPSSSGRPNMSQVANELQECLLTENSRKGGRHDVDSKSSLEQSTSFGPEHIPDAR

SEQ ID NO: 555 - DNA, 2598 bp, Arabidopsis thaliana
  AT5G16900.1
atggaggatcgtcatcgttatctttttttcatatttgccattatacattatgttcaggctcaacaaggattcatcagtttggattgcgggttgccgagtaacgagcctccatatattgaaccggtaaccggattagtattctcatcggatgcggatcacatccctagtggaataagcggtagaatccagaagaatctggaagcagtacacataaagccgtatttgtttctgagatactttccagatgggctacgaaattgctatactctagatgtccttcagaaccgaagatacatgatcaaagctgtgtttgtgtatggaaattacgatggttataatgattatccgagttttgatctgtatctaggtcctaataagtgggtaagagttgacttggaaggaaaggtcaatggcagtgttgaagagattattcacataccaagttcaaactctctgcagatttgtcttgtcaagacaggtaattctttgccgttcatatccgccctggaactgaggcttttgagaaacgatacttatgttgtccaagacgtttccttgaagcatttatttcggaggtactatagacagtcagatcggttaatccggtatcctgacgatgtctatgatcgtgtttggtccccattcttcttaccggaatggacgcagataactaccagtttagatgtgaataactctaacaactacgagccaccaaaagcagcattaacatcagctgccacacctggagacaatggaacgcgattgaccattatttggactttggataaccctgatgagcaaattcacctgtatgttcactttgccgagcttgaacctgttggggaaaacactgacgaggccttgagaactttatttacaaggaccttttactttgtggtgaatggaaagattagttatgatgagagtattactcctttagacttggctgtaagtactgtagagactgtggtgaacaaatgcgatggcggtaactgcagtttgcagctggtacgcagcgaagcgtctccgggagtacgtgtacctctggttaatgctatggaggcattcactgcaatcaagtttccacattctgaaacaaatcctgatgatgttatatctatcaaggttatccaagctacctatgaactgagcagagtcgactggcaaggagatccgtgtcttccccagcagtttttgtggactggcctaaactgcagctacatgaacatgtctacgtcaccaagaatcatttccttagacctgtcctcacataaattaactgggaaaatagtgccagatatacaaaatctgacccagctacagaaactggacttgtcgaataacaagttgaccggaggtgtgcctgagtttctagccaacatgaagtcactgttgttcataaacctaagcaataacaatcttgttggttccattcctcaagcgcttcttgaccgaaaaaatctgaagttggagtttgaaggaaatccaaagctttgcgccacaggtccgtgtaacagttcaagtggaaataaagaaaccacagtcatagcacctgttgctgctgcaatagccatttttatagctgttttggttctcattattgttttcataaagaaaaggccatcaagtataagagctctacatccgtcacgggctaatttatctctggaaaataaaaaacgaaggatcacatattcagagatattgttgatgacaaataactttgaaagagttattggtgaaggagggtttggggtcgtctatcatggttatttgaatgatagtgagcaagtggctgttaaagtgctctctccgtcctcatctcaaggctataaagaattcaaagcagaggttgaacttctccttagagttcaccacataaatttggtaagccttgttggatattgtgatgaacaagcacacttagccctcatctacgagtacatggctaatggagacttaaaatcgcatctttcaggaaaacatggggactgtgttttaaaatgggaaaacagattaagcatagctgttgaaaccgcactaggattggagtacttgcatagtggatgcaaaccactaatggttcacagagatgtcaaaagcatgaatatactgttggatgagcacttccaagctaaactagcggatttcggactgtctagatctttttctgttggagaggaaagccatgtgtcgactggtgttgtaggcactcctggatacttagatcctgagtattacagaacatatcgcttgaccgaaaagagtgatgtctatagttttgggatcgtgttattggagataatcacaaatcaacccgtacttgagcaagctaacgaaaatcgacacatcgcagaacgtgtaaggactatgcttacaagaagtgatattagcaccattgttgatcctaacctcattggcgagtatgattctggttctgtgcggaaagctcttaaactagcgatgtcgtgtgtggatccatctccggttgcaagaccagacatgtcacatgttgttcaggagcttaaacagtgtatcaaatctgaaaacctgagactgaggacaggattgaaccaagtcatagactcgaaaagttcc

SEQ ID NO: 556 - protein, 866 aa, Arabidopsis thaliana
  AT5G16900.1
MEDRHRYLFFIFAIIHYVQAQQGFISLDCGLPSNEPPYIEPVTGLVFSSDADHIPSGISGRIQKNLEAVHIKPYLFLRYFPDGLRNCYTLDVLQNRRYMIKAVFVYGNYDGYNDYPSFDLYLGPNKWVRVDLEGKVNGSVEEIIHIPSSNSLQICLVKTGNSLPFISALELRLLRNDTYVVQDVSLKHLFRRYYRQSDRLIRYPDDVYDRVWSPFFLPEWTQITTSLDVNNSNNYEPPKAALTSAATPGDNGTRLTIIWTLDNPDEQIHLYVHFAELEPVGENTDEALRTLFTRTFYFVVNGKISYDESITPLDLAVSTVETVVNKCDGGNCSLQLVRSEASPGVRVPLVNAMEAFTAIKFPHSETNPDDVISIKVIQATYELSRVDWQGDPCLPQQFLWTGLNCSYMNMSTSPRIISLDLSSHKLTGKIVPDIQNLTQLQKLDLSNNKLTGGVPEFLANMKSLLFINLSNNNLVGSIPQALLDRKNLKLEFEGNPKLCATGPCNSSSGNKETTVIAPVAAAIAIFIAVLVLIIVFIKKRPSSIRALHPSRANLSLENKKRRITYSEILLMTNNFERVIGEGGFGVVYHGYLNDSEQVAVKVLSPSSSQGYKEFKAEVELLLRVHHINLVSLVGYCDEQAHLALIYEYMANGDLKSHLSGKHGDCVLKWENRLSIAVETALGLEYLHSGCKPLMVHRDVKSMNILLDEHFQAKLADFGLSRSFSVGEESHVSTGVVGTPGYLDPEYYRTYRLTEKSDVYSFGIVLLEIITNQPVLEQANENRHIAERVRTMLTRSDISTIVDPNLIGEYDSGSVRKALKLAMSCVDPSPVARPDMSHVVQELKQCIKSENLRLRTGLNQVIDSKSS

SEQ ID NO: 557 - DNA, 2358 bp, Arabidopsis thaliana
  AT2G28970.1
atgatgagccatcttttgttggccataattggaacctttgccgttatagttggcgcccaaaaacaagaaggtttcatcagtttggattgcggatttcctattgaggaatctccttatagtgatccatctactggattaacattcacatcagattcaacatttatccagactggagaaagtggtagagtcgataaagagctcaacaaaatattccgaaaaccatatttgactctaagatactttccggaaggaaagcgtaattgctcactgaggaactctttccgggttcattgcagcacttctgatagcgaaataaggtatgatgatgactcctatgatcgtgtctggtatccattcttcagctcttcgtttagctatataacgactagtctcaatataaacaattcagatacatttgagataccaaaagctgcactcaaaagtgctgccacgcctaaaaacgctagtgcaccgctaatcataacttggaaaccaagaccctctaacgctgaagtttacttctatcttcatttcgctgagatacaaacccttgcagccaacgagacgagggaattcgacattgttttcaaaggaaactttaattattcagcttttagtcctaccaagttagagctacttacatttttcacaagtggaccagtgcaatgtgattcagatggttgcaatttacagctcgtaagaactccgaattcaacccttccacctttgatcaacgctcttgaggcttacactattatcgaattcccacagttggaaacaagcctaagtgatgttaatgctatcaaaaacattaaagctacgtaccggctaagtaaaactagttggcaaggagatccatgtctccctcaagaattatcctgggaaaatcttagatgcagttacacaaatagttctaccccaccaaaaatcatttcattaaacttgtcagcaagtggattaactgggagtctaccctcagtttttcaaaatctaacgcagatacaagagctggacttatctaacaacagtttgactggacttgtgccttcttttctggccaacattaaatcattatctttgttagacttgagtgggaacaattttaccggttcagttccacaaactcttcttgatagagaaaaggaaggacttgtcttgaaacttgaaggaaatccagagctatgcaagtttagctcatgcaatccaaaaaagaaaaagggattattggtaccggttattgcatcaatttcctctgtgcttattgtaatagtggttgtggctctcttttttgttctccgaaagaagaagatgccttcagatgcacaggctccaccaagtttgcccgtagaagatgttggacaagctaaacattcagaatcatcattcgtctcgaaaaagataaggtttgcttatttcgaggttcaagagatgacaaataactttcagagagttcttggtgaaggaggctttggagtcgtttatcatggttgtgttaatggtacccaacaagtagctgttaaattgctctctcaatcatcttcccaaggctataaacatttcaaggcagaggtggaacttcttatgagagtacaccataaaaatttggtgagtcttgttggttattgtgatgaaggagaccatttggccctcatctacgagtacatgcctaatggagacttaaaacaacatttatcaggaaagcgtggtggatttgtcttaagctgggaaagtagactaagagtagctgtcgatgcagcactaggtttggagtacttacacactggatgcaaaccaccaatggttcacagagatataaaaagtacaaacatacttttggatgaacgtttccaagccaaattagccgattttgggctttcgagatcttttcctaccgaaaacgaaacacatgtttcaactgttgtggctggaactcctggttatcttgatcccgagtattatcaaacaaattggttgacagagaaaagtgatgtttacagtttcggaattgtactattggagatcatcacaaaccggcctataattcagcaatctcgtgaaaagcctcacctagtagaatgggttggatttattgtaagaacgggagatattggaaatattgttgatccaaaccttcacggagcttacgacgtcggttctgtctggaaggctattgaactagctatgtcatgtgtgaatatttcttcggcaagaagaccaagcatgtctcaagttgttagcgatcttaaagagtgtgtgatatctgaaaattcaaggacaggagagagtcgagaaatgaactcaatgagttccatcgaattcagcatgggaattgacaccgaggtgatccctaaagcacgc

SEQ ID NO: 558 - protein, 786 aa, Arabidopsis thaliana
  AT2G28970.1
MMSHLLLAIIGTFAVIVGAQKQEGFISLDCGFPIEESPYSDPSTGLTFTSDSTFIQTGESGRVDKELNKIFRKPYLTLRYFPEGKRNCSLRNSFRVHCSTSDSEIRYDDDSYDRVWYPFFSSSFSYITTSLNINNSDTFEIPKAALKSAATPKNASAPLIITWKPRPSNAEVYFYLHFAEIQTLAANETREFDIVFKGNFNYSAFSPTKLELLTFFTSGPVQCDSDGCNLQLVRTPNSTLPPLINALEAYTIIEFPQLETSLSDVNAIKNIKATYRLSKTSWQGDPCLPQELSWENLRCSYTNSSTPPKIISLNLSASGLTGSLPSVFQNLTQIQELDLSNNSLTGLVPSFLANIKSLSLLDLSGNNFTGSVPQTLLDREKEGLVLKLEGNPELCKFSSCNPKKKKGLLVPVIASISSVLIVIVVVALFFVLRKKKMPSDAQAPPSLPVEDVGQAKHSESSFVSKKIRFAYFEVQEMTNNFQRVLGEGGFGVVYHGCVNGTQQVAVKLLSQSSSQGYKHFKAEVELLMRVHHKNLVSLVGYCDEGDHLALIYEYMPNGDLKQHLSGKRGGFVLSWESRLRVAVDAALGLEYLHTGCKPPMVHRDIKSTNILLDERFQAKLADFGLSRSFPTENETHVSTVVAGTPGYLDPEYYQTNWLTEKSDVYSFGIVLLEIITNRPIIQQSREKPHLVEWVGFIVRTGDIGNIVDPNLHGAYDVGSVWKAIELAMSCVNISSARRPSMSQVVSDLKECVISENSRTGESREMNSMSSIEFSMGIDTEVIPKAR

SEQ ID NO: 559 - DNA, 2652 bp, Arabidopsis thaliana
  AT2G28990.1
atgaagattcaccttttgttggccatgattggaacctttgtcgttataattggagcccaggatcaagaaggtttcatcagtttagattgtggattacctagtgacgaatctccttacgatgattcgtttaacggattaacattcacatcggattccactttcatccaaacaggaaaaattgatagtgtcgataaagatcttaacataaacttatcaaaacaatatttgactcttagatacttcccagaaggaaaacgtaattgttatagtcttgatgtcaagcgtggcacaacttatctcatcgtggttagctttgtatatggaaattatgatggtcttaaccgtgatccaaacttcgatatccatcttggtcccaataagtggaaaagaatagatttggatggagagaaagaaggtacaagagaagagatcatacacaaagccaggtcaaactctttggatatttgtcttgttaagacaggagaaactttgccaataatttcagccatagaaatacggccactaaggaataatacgtatgttacacaatctggttcgctgatgatgtctttccgggtttatcttagcaattcagatgcatctataaggtatgctgatgacgtccatgatcgtatttggtctccattcaacggatcttcacatacacatataacaactgatctcaatataaacaactcaaatgcatatgagattccaaaaaatatactccaaactgctgccataccaagaaacgccagtgcgccgctgattattacgtgggatccactacccattaatgcggaggtatacttgtacatgcactttgcggagattcaaacccttgaagccaacgagacgaggcagtttgacgttatcttgagaggaaactttaatcattcaggatttagtccaaccaagttaaaggtatttacattatacacagaagaaccaatgaaatgtggttcagaaggttgttatttacagctagtaaaaacaccgaactcaactctgccacctctgatcaacgctattgaggcatacagtgttatcgagttctcacaattggaaacaagtcttagtgatgtggacgctatcaagaacatcaaaaatacttataagctgaataaaatcacttggcaaggagatccatgtctccctcaagatttgtcgtgggaaagtattagatgcacctacgtagatggctccacttcaccaacaatcatttccttagatttgtcgaaaagtggattaaatgggagtataccccaaattttacaaaatttcacgcaattacaagaactggacttatcaaataatagcttgactggaccggtgcctatcttccttgccaacatgaaaacgttatctttaataaacttaagtgggaacaatctcagtggttcagttcctcaagctcttcttgacaaagaaaaagaaggacttgtgttaaaacttgaaggaaatccagatttgtgcaaatccagtttttgcaataccgaaaagaaaaataaattcttgctcccggttattgcatcagctgcctctttggttattgtagttgtggttgtggctcttttttttgtcttccgaaagaagaaggccagcccttcaaatctacatgctccaccaagtatgcctgtatcgaatcccgggcacaatagtcaatcagaatcatcattcacatcgaaaaaaattaggtttacttactctgaggttcaagaaatgacaaataacttcgataaagctctcggtgaaggaggatttggagtcgtgtatcatggttttgttaatgttattgaacaagtagcagttaaattgctatcacaatcatcttctcaaggctataagcatttcaaggcagaggtggaactccttatgagagttcaccatataaatttggtgagtcttgttgggtattgtgatgaaggagaacacttggctcttatttatgaatacatgccaaatggagacttaaagcaacatttgtcaggaaagcatggcggattcgtcctgagctgggaaagtagactaaaaatagttttggatgcagcactaggattggagtatttacatactggatgtgtaccaccaatggttcacagagatatcaaaactacgaatatacttctagatcaacatctccaagctaaattagctgattttgggctttcaagatcttttcccatcggaaatgagaaaaatgtgtcaactgttgttgctggtactcctggatatcttgatcctgagtattatcaaacaaattggttgacagaaaagagtgatatatacagtttcggaattgtactgttagagataatttcaaaccgtcctataatccagcaatcccgtgaaaagcctcacatagtggaatgggtcagttttatgataacaaaaggagatcttagaagtattatggatccaaacctccaccaagattatgatattggttctgtctggaaggccattgaattagcaatgtcatgtgtgagtctttcttctgcaagacgaccaaacatgtctcgagttgtgaatgaattaaaagaatgtcttatatccgaaacctctaggataggtgagggacgagacatggaatcaaaaggttcaatggaattcagcagagacatttataatgaggtaatacctcaagctcgc

SEQ ID NO: 560 - protein, 884 aa, Arabidopsis thaliana
  AT2G28990.1
MKIHLLLAMIGTFVVIIGAQDQEGFISLDCGLPSDESPYDDSFNGLTFTSDSTFIQTGKIDSVDKDLNINLSKQYLTLRYFPEGKRNCYSLDVKRGTTYLIVVSFVYGNYDGLNRDPNFDIHLGPNKWKRIDLDGEKEGTREEIIHKARSNSLDICLVKTGETLPIISAIEIRPLRNNTYVTQSGSLMMSFRVYLSNSDASIRYADDVHDRIWSPFNGSSHTHITTDLNINNSNAYEIPKNILQTAAIPRNASAPLIITWDPLPINAEVYLYMHFAEIQTLEANETRQFDVILRGNFNHSGFSPTKLKVFTLYTEEPMKCGSEGCYLQLVKTPNSTLPPLINAIEAYSVIEFSQLETSLSDVDAIKNIKNTYKLNKITWQGDPCLPQDLSWESIRCTYVDGSTSPTIISLDLSKSGLNGSIPQILQNFTQLQELDLSNNSLTGPVPIFLANMKTLSLINLSGNNLSGSVPQALLDKEKEGLVLKLEGNPDLCKSSFCNTEKKNKFLLPVIASAASLVIVVVVVALFFVFRKKKASPSNLHAPPSMPVSNPGHNSQSESSFTSKKIRFTYSEVQEMTNNFDKALGEGGFGVVYHGFVNVIEQVAVKLLSQSSSQGYKHFKAEVELLMRVHHINLVSLVGYCDEGEHLALIYEYMPNGDLKQHLSGKHGGFVLSWESRLKIVLDAALGLEYLHTGCVPPMVHRDIKTTNILLDQHLQAKLADFGLSRSFPIGNEKNVSTVVAGTPGYLDPEYYQTNWLTEKSDIYSFGIVLLEIISNRPIIQQSREKPHIVEWVSFMITKGDLRSIMDPNLHQDYDIGSVWKAIELAMSCVSLSSARRPNMSRVVNELKECLISETSRIGEGRDMESKGSMEFSRDIYNEVIPQAR

SEQ ID NO: 561 - DNA, 2634 bp, Arabidopsis thaliana
  AT3G46330.1
atgaagaatctttgttgggtttttctgtcgctgttttggtttggagttttcctcatcattcgttttgctgaaggacaaaatcaagaaggttttatcagtttagattgtggcttacctctaaatgagccaccttacatagaatcggaaaccggaatacagttctcatcagacgagaatttcatccaaagtggaaagaccggtagaatcccgaaaaatcttgaatcggaaaatttaaaacagtatgcaaccctacgatactttccagatggaatacgaaactgctatgatctaagggtggaagaagggaggaactaccttattagagctacatttttctatggaaattttgacgggcttaatgttagccctgaattcgatatgcatatcggtcctaataagtggacaacaatagatttgcaaatagtgccagatggtacagtgaaggagatcattcacattccaagatcaaactctttgcaaatttgtcttgttaagacaggggcaactataccaatgatatcagctttggaattacgacctttggcgaatgatacttacatcgctaaatctggttccttgaaatattattttcgcatgtatcttagcaatgccaccgttcttcttcggtacccgaaagatgtttatgatcgttcgtgggttccatatattcaacccgaatggaatcaaatttcaacaacttcaaatgtgtccaataaaaatcactatgatccaccacaagttgctcttaagatggccgcaacgcctacaaatcttgatgcagcactgacaatggtttggcgtttggagaatcctgatgatcaaatctacttgtacatgcacttctcggagatccaagtcctaaaagccaatgacactagagaattcgacattatattgaatggagaaacaattaacactagaggtgttactcctaaatatcttgaaataatgacctggcttacaacaaatcctaggcaatgcaacggaggtatctgccgaatgcagttaacaaaaacccaaaaatcgacacttccacctctacttaatgcttttgaagtttactcagttctccagcttccacaatctcagacaaatgaaattgaagtggttgctatcaaaaacattagaactacttatggactgagtagaatcagttggcaaggagatccatgcgtaccgaaacaattcttgtgggatggattgaattgtaacatcacagatatatctgcaccaccaagaataatttctttaaatttatcatcgagtggcttgagtgggactatagtgtctaactttcagaatctggcgcatctagaaagtttggatttgtcaaataacagtttgagtggaatagtgcccgagtttctagccactatgaaatcattgttggtcataaacttgagcgggaataaacttagtggtgcaattcctcaagctcttcgcgatagagaaagggaggggctaaagttaaatgttcttggaaacaaagagctttgtctatctagtacatgcatagataagccaaagaaaaaagttgcggtaaaggttgttgcaccagtcgcttccattgccgctatcgttgttgtgatcctcctttttgtattcaaaaagaaaatgtcatcaagaaataaacctgaaccgtggatcaagaccaaaaagaaaaggtttacttattcagaagttatggaaatgactaagaacttgcaaagacctcttggggaaggggggtttggtgttgtttatcatggcgatctaaatggctcagagcaagtagctgtcaaactactatcccaaacatcagcacaaggctataaagaatttaaggcagaggttgaacttcttcttagggttcaccacataaatttggtcaaccttgttggatattgtgatgaacaagatcactttgctctcatctatgaatacatgtctaatggagacttacatcaacatttatcaggaaaacacggtggctctgttttaaattggggtactagattgcaaatagctatcgaagctgcattaggattagaatacttgcatactggatgcaaaccagcaatggtgcatagagatgtcaaaagtacaaatatattgttggatgaagaattcaaggccaaaattgcggattttggactgtctagatcgtttcaagtaggaggcgatcaatctcaagtttcaacagttgttgccggtactctaggatatcttgatcccgaatattacttaacaagtgagttatccgagaagagtgatgtctacagtttcgggatcttgttactagagattatcacaaaccaacgagtgattgatcaaacccgtgaaaaccctaacatagcagaatgggttacatttgtgatcaagaaaggagatactagtcaaattgtggatcctaaacttcacggaaactatgacacccactctgtctggagagctcttgaagtagcaatgtcatgcgcaaatccttcttcagtcaaacgaccaaacatgtctcaagtaatcatcaatcttaaagagtgtcttgcatctgaaaacacgaggataagtaggaataatcaaaacatggactctggtcatagctcggatcagcttaatgtgactgtgacctttgatactgatgtgaagcctaaggcaaga

SEQ ID NO: 562 - protein, 878 aa, Arabidopsis thaliana
  AT3G46330.1
MKNLCWVFLSLFWFGVFLIIRFAEGQNQEGFISLDCGLPLNEPPYIESETGIQFSSDENFIQSGKTGRIPKNLESENLKQYATLRYFPDGIRNCYDLRVEEGRNYLIRATFFYGNFDGLNVSPEFDMHIGPNKWTTIDLQIVPDGTVKEIIHIPRSNSLQICLVKTGATIPMISALELRPLANDTYIAKSGSLKYYFRMYLSNATVLLRYPKDVYDRSWVPYIQPEWNQISTTSNVSNKNHYDPPQVALKMAATPTNLDAALTMVWRLENPDDQIYLYMHFSEIQVLKANDTREFDIILNGETINTRGVTPKYLEIMTWLTTNPRQCNGGICRMQLTKTQKSTLPPLLNAFEVYSVLQLPQSQTNEIEVVAIKNIRTTYGLSRISWQGDPCVPKQFLWDGLNCNITDISAPPRIISLNLSSSGLSGTIVSNFQNLAHLESLDLSNNSLSGIVPEFLATMKSLLVINLSGNKLSGAIPQALRDREREGLKLNVLGNKELCLSSTCIDKPKKKVAVKVVAPVASIAAIVVVILLFVFKKKMSSRNKPEPWIKTKKKRFTYSEVMEMTKNLQRPLGEGGFGVVYHGDLNGSEQVAVKLLSQTSAQGYKEFKAEVELLLRVHHINLVNLVGYCDEQDHFALIYEYMSNGDLHQHLSGKHGGSVLNWGTRLQIAIEAALGLEYLHTGCKPAMVHRDVKSTNILLDEEFKAKIADFGLSRSFQVGGDQSQVSTVVAGTLGYLDPEYYLTSELSEKSDVYSFGILLLEIITNQRVIDQTRENPNIAEWVTFVIKKGDTSQIVDPKLHGNYDTHSVWRALEVAMSCANPSSVKRPNMSQVIINLKECLASENTRISRNNQNMDSGHSSDQLNVTVTFDTDVKPKAR

SEQ ID NO: 563 - DNA, 2667 bp, Arabidopsis thaliana
  AT3G46340.1
atggagtttccccattcggttttgttggtcgtactaattattgcaactttcgctatttctaaccttgttcaagctgaagaagatcaagaagggttcatcagtttggattgcggtttacccccaaatgaagtgtcaccatatatcgagccgtttactggactacggttttcatcagactcaagctttattcaaagtggaaaaatcggtaaagttgataaaagttttgaggccacgactctaaagtcatacatgacgttgagatactttccagatggaaaacgcaattgttacaatcttattgtgaagcaagggaaaacttatatgattagagctacagctctatatggaaattatgacggtcttaatattagtcctaagtttgatttatacattggcgctaacttctggacaacactagacgcgggagaatatttatctggcgtggttgaggaggtcaattacatcccaagatcaaattctttagacgtgtgtcttgttaaaacagacacgtcgacgccattcttatcactcttggaactaaggcctctagataatgattcttacctcactggttcgggttccttgaaaactttcaggcggtactatcttagtaattcagaatccgttatcgcgtatccagaagacgtcaaggacagaatatgggaaccaacctttgattcagaatggaagcagatttggaccactctcaaaccgaacaactccaatggttatcttgtgccgaagaatgtgcttatgaccgcagcaatacctgcaaatgatagtgcaccgtttagatttaccgaggagctcgattctcctactgacgaactttacgtgtacctccacttctctgaggttcagtcactacaggccaatgaatctagagagtttgacattttatggagtggagaagttgcgtacgaagcttttatccctgaatatctgaatatcacgacaattcaaaccaatactccagttacttgcccaggaggaaaatgcaacttagagctaaaaagaactaaaaactctactcacccacctcttatcaatgccatcgagttttacacggtggtaaattttccacagttggaaacaaatgaaactgatgttgttgctatcaaagatatcaaagcaacctatgaattgaatagaatcacatggcaaggagatccatgcgtcccacaaaagtttatctgggagggtctggattgcaacagcaaagatgcattaacactaccaagaatcacttcattgaacttgtcttcaaccggcttaaccggaaatattgcagctggaattcaaaatcttacccaccttgacaaattggatttgtcaaataacaatttgaccggaggagttcctgaatttctagctagtatgaagtctctgtcattcataaacttgagcaagaacaatctgaatggttcaatcccacaagctcttcttaaaagagaaaaggatggactgaagttatctgttgatgaacagattcggtgttttcctggttcatgtgtcatcactaagaagaaattcccagtaatgattgttgcattagtatcttcggctgtggtggtcattctagtggtactagttctcatttttgtatttaagaagaaaaagccatcaaatttggaagatctaccaccgtcatcaaatacgccgcgtgaaaacattacatctaccagtatatctgatacatcgattgagacaaaaagaaaaagattcagttactcagaggttatggaaatgacaaagaacttgcaaagaccacttggcgaaggaggttttggagtcgtttatcatggtgatataaatggttcatcacaacaagtagccgttaaactactttcccaatcatcaacacaaggctataaagagtttaaagctgaggtcgaacttttgttgagagttcaccacataaacttggtaagccttgtagggtattgtgatgaacgagatcacttggctctcatctatgaatacatgtcgaataaagacttaaaacatcatttgtcaggaaaacacggtggctctgttttaaagtggaatacccgactacaaatagccgtcgatgccgcactaggactggaatacttacatattggatgtcgaccatcgatggtgcatagagatgtcaaaagtacaaatatattgttggacgatcaatttactgctaaaatggcggatttcgggctgtcaagatctttccaactcggagatgaatctcaggtttcaaccgttgttgctggtactcctggatatcttgaccccgaatattacagaacaggtcggttagctgaaatgagcgatgtctacagttttggaattgtgttattggagataataacaaaccaacgtgtgattgacccagcccgagaaaaatctcacataacagaatggacagcatttatgcttaatagaggagatattacaagaatcatggatcctaaccttcaaggagattataactctcgttctgtctggagagctcttgaattagcaatgatgtgcgctaacccttcatcagaaaaacgaccgagcatgtcccaagttgttatcgagctaaaagagtgtatacgttctgaaaataaaactcaaggcatggattctcatagttcctttgaacaaagcatgagttttgataccaaagctgtccctagtgcaagg

SEQ ID NO: 564 - protein, 889 aa, Arabidopsis thaliana
  AT3G46340.1
MEFPHSVLLVVLIIATFAISNLVQAEEDQEGFISLDCGLPPNEVSPYIEPFTGLRFSSDSSFIQSGKIGKVDKSFEATTLKSYMTLRYFPDGKRNCYNLIVKQGKTYMIRATALYGNYDGLNISPKFDLYIGANFWTTLDAGEYLSGVVEEVNYIPRSNSLDVCLVKTDTSTPFLSLLELRPLDNDSYLTGSGSLKTFRRYYLSNSESVIAYPEDVKDRIWEPTFDSEWKQIWTTLKPNNSNGYLVPKNVLMTAAIPANDSAPFRFTEELDSPTDELYVYLHFSEVQSLQANESREFDILWSGEVAYEAFIPEYLNITTIQTNTPVTCPGGKCNLELKRTKNSTHPPLINAIEFYTVVNFPQLETNETDVVAIKDIKATYELNRITWQGDPCVPQKFIWEGLDCNSKDALTLPRITSLNLSSTGLTGNIAAGIQNLTHLDKLDLSNNNLTGGVPEFLASMKSLSFINLSKNNLNGSIPQALLKREKDGLKLSVDEQIRCFPGSCVITKKKFPVMIVALVSSAVVVILVVLVLIFVFKKKKPSNLEDLPPSSNTPRENITSTSISDTSIETKRKRFSYSEVMEMTKNLQRPLGEGGFGVVYHGDINGSSQQVAVKLLSQSSTQGYKEFKAEVELLLRVHHINLVSLVGYCDERDHLALIYEYMSNKDLKHHLSGKHGGSVLKWNTRLQIAVDAALGLEYLHIGCRPSMVHRDVKSTNILLDDQFTAKMADFGLSRSFQLGDESQVSTVVAGTPGYLDPEYYRTGRLAEMSDVYSFGIVLLEIITNQRVIDPAREKSHITEWTAFMLNRGDITRIMDPNLQGDYNSRSVWRALELAMMCANPSSEKRPSMSQVVIELKECIRSENKTQGMDSHSSFEQSMSFDTKAVPSAR

SEQ ID NO: 565 - DNA, 2613 bp, Arabidopsis thaliana
  AT3G46350.1
atgaacagttcccacgagcttttgttaactgcacttatagcaacttttgctatttttcaccttgttcaagctcaagaacaagaaggattcataagtttggattgtgggttagctccgactgagccgtccccttataccgagccggtaactacgttacagtactcatcggattcaaacttcatccaaagtgggaaacttggtagaattgatacaagtctacagacatttttcctaaagcaacaaacaacgttaagatactttccagacggaatacgcaattgttacaatcttacggtcaagcagggaaccaactatttgatcagagctaggttcacatatgggaattatgatggtcgtaatatgtctcctacctttgatctatacttgggccccaatttgtggaaaagaatagacatgacaaagttacaaaacaaagttagtacattggaggagattacatacattccattatcaaactctttggatgtgtgtcttgttaagacaaacacgaccattccatttatatcggccttagaattaaggcctttaccaagtaacagttatatcactacggccggttcattgaggacgttcgtgcggttttgtttcagcaattcagtggaagatatacggttcccgatggatgtccatgatagaatgtgggaatcatactttgatgacgactggacgcagatttccactagtcttacagtgaacacatccgatagttttcgtctgccacaggctgccctcataacggctgcaacacctgcgaaggatggtccatcatatataggtatcacgttttctacctcctctgaagaaaggtttttcatatacctccatttctccgaagttcaagctttacgtgccaacgagactagagaattcaacatttcgattaacggagaatctgttgccgacttgtatagacctttgtcaagaactcaaagctctacgcatccacctatgattaacgccattgaaattttccttgtttccgaacttctacagtctgaaacatacgagaatgatgtgattgctataaaaaaaatcaaagacacatatggattgcagctaatctcatggcaaggtgacccatgtgttcctcgactttataagtgggacggtcttgattgtacagacacagacacatatatagcaccaaggatcacttccttaaaattatcttcaaaggggttaacgggaaccatagcagctgatattcaatatctcacctctctagaaaagttggacttgtcagataacaagttggtgggagtagtgcctgaatttctagctaacatgaaatcactaatgttcataaacttgaccaagaatgatctgcatggttcaattccacaagcacttcgcgatagagaaaagaaaggactgaaaatcttgtttgatggtgataagaatgatccatgtttatctacctcttgtaacccaaagaagaaattttcggtcatgattgttgcaattgttgcttcgacagtcgtgtttgttctagtagtatcactagccctcttttttgggctcagaaagaaaaaaacgtcaagtcatgtgaaagctataccaccatcaccaactacgccattagagaatgttatgtccactagtatctctgagacatcgattgagatgaaaaggaaaaagtttagttattcagaagttatgaaaatgacaaacaacttccaaagagctctcggtgaaggagggtttggtaccgtatatcatggtgatctagatagttcacaacaagtagctgtcaaactactctcccaatcatcaacacaaggctataaagagttcaaggcagaggtcgatctccttctaagggttcaccacataaatttgttaaacctggtcggttattgcgatgaacgagatcacttggctcttatctacgaatacatgtcgaatggagacctaaaacaccatttgtcaggagaacatggtggctctgtcttgagttggaatatacgactacgaatagctgtcgatgccgcactagggttggaatacttacatattggatgtcgaccatcaatggtgcatagagatgtaaaaagtacaaatatactgttggacgagaatttcatggcaaaaattgctgattttggactttcaagatctttcatactcggaggtgaatctcatgtgtcgactgttgttgctggttcacttggatatcttgatcccgaatattacagaacaagtcgattggctgagatgagcgatgtgtacagttttgggattgtgttattggagataatcacaaaccaacgtgtgattgacaaaacccgtgaaaagccccacataacagaatggacggcatttatgcttaatagaggagatattaccagaatcatggatcctaaccttaacggtgattacaactcccattcagtctggagagctcttgaattggcaatgtcatgtgcaaatccttcgtcagaaaatagaccaagcatgtcccaggttgttgctgaactgaaagagtgtcttatttctgaaaactcgctgagaagtaagaatcaagatatgagctcacaaagatccttggacatgagcatgaactttgataccaaggatgtcccaagtgcaagg

SEQ ID NO: 566 - protein, 871 aa, Arabidopsis thaliana
  AT3G46350.1
MNSSHELLLTALIATFAIFHLVQAQEQEGFISLDCGLAPTEPSPYTEPVTTLQYSSDSNFIQSGKLGRIDTSLQTFFLKQQTTLRYFPDGIRNCYNLTVKQGTNYLIRARFTYGNYDGRNMSPTFDLYLGPNLWKRIDMTKLQNKVSTLEEITYIPLSNSLDVCLVKTNTTIPFISALELRPLPSNSYITTAGSLRTFVRFCFSNSVEDIRFPMDVHDRMWESYFDDDWTQISTSLTVNTSDSFRLPQAALITAATPAKDGPSYIGITFSTSSEERFFIYLHFSEVQALRANETREFNISINGESVADLYRPLSRTQSSTHPPMINAIEIFLVSELLQSETYENDVIAIKKIKDTYGLQLISWQGDPCVPRLYKWDGLDCTDTDTYIAPRITSLKLSSKGLTGTIAADIQYLTSLEKLDLSDNKLVGVVPEFLANMKSLMFINLTKNDLHGSIPQALRDREKKGLKILFDGDKNDPCLSTSCNPKKKFSVMIVAIVASTVVFVLVVSLALFFGLRKKKTSSHVKAIPPSPTTPLENVMSTSISETSIEMKRKKFSYSEVMKMTNNFQRALGEGGFGTVYHGDLDSSQQVAVKLLSQSSTQGYKEFKAEVDLLLRVHHINLLNLVGYCDERDHLALIYEYMSNGDLKHHLSGEHGGSVLSWNIRLRIAVDAALGLEYLHIGCRPSMVHRDVKSTNILLDENFMAKIADFGLSRSFILGGESHVSTVVAGSLGYLDPEYYRTSRLAEMSDVYSFGIVLLEIITNQRVIDKTREKPHITEWTAFMLNRGDITRIMDPNLNGDYNSHSVWRALELAMSCANPSSENRPSMSQVVAELKECLISENSLRSKNQDMSSQRSLDMSMNFDTKDVPSAR

SEQ ID NO: 567 - DNA, 2379 bp, Arabidopsis thaliana
  AT3G46370.1
atgcgaaactgttacaatcttagtgtgcataaagaaacaaagtatttgattagggttacaagtaactatggaaattacgatggtcgtaacgaacctcctagatttgatttgtacttaggccctaacttctgggtaacaatagatttggggaagcatgtaaatggtgatacatggaaggagattattcatatcccaaagtcaaactctctagatgtgtgtcttatcaaaacaggtacaacaacgccaattatatcgaccttggaactaaggtctctaccaaagtatagttacaacgcaatatcaggttctttgaagtcgacactgagggcattcctaagcgaatcaacagaagttataaggtacccaaatgatttctacgatcggatgtgggttccacattttgagacggaatggaagcaaatttctaccaatctcaaagtgaacagctccaatggttatcttctgccacaggatgtgctcatgaccgccgcaatacctgtgaatactagtgcacgattgagttttaccgagaatcttgagttccctcatgatgaactttacctgtacttccacttctctgaggtccaagtcttacaggccaaccagagtagagagttcagcattttgtggaacggaatggttatttacccagattttatccctgactatcttggtgccgccactgtgtacaacccgtcaccatctctttgtgaagtagggaaatgcttattagagcttgaaagaactcagaaatcaactctcccgcctctccttaacgccattgaagttttcacagtgatgaattttccacagtctgagacaaacgatgatgatgtaattgctataacaaagatcaaagacacacacagattgaatagaacctcctggcaaggagatccatgcgtccctcaactgttttcgtgggccggtctaagttgcattgacacgaatgtatctaccccaccaagaatcatttccctaaacttgtcttcaagtgggttaacaggaaacatagcaactggaattcaaaatctgaccaaactgcaaaagctggacttgtcaaataacaatttgacaggagtagtgcccgaatttctagctaacatgaaatcgttgctgttcatagacttgaggaagaacaaactgaatggttcaataccaaagactctacttgatagaaaaaagaaaggactacaattatttgttgatggcgatgatgataagggcgatgataataagtgtttatccggttcatgtgtcccaaaaatgaaattcccattgatgattgttgcattagcggtttctgcggttgtggtcattgcagtggtaatgattctcatttttctgttcagaaagaaaaagaaatcaagtttaggtattacgtcagctgctatatctgaagaatcgattgagacgaaaaggagaaggtttacctattctgaagttgtggaaatgacaaaaaacttccaaaaaactctaggtgaaggagggttcggaaccgtgtattatggtaatttgaatggttcagagcaagtagcggttaaagtactctcgcaatcatcatcacagggctataaacacttcaaggcagaggtcgaacttcttttaagagttcaccacataaatttggtgagtcttgttggatattgcgatgaaagaaatcacttggccctcatctacgaatgcatgtccaatggagacttaaaagatcatttgtcaggaaaaaagggtaacgctgttttgaaatggagtactagactacgaatagctgtcgatgctgcgctaggattggaatacttgcattatggatgtcgaccatcgatagtgcatagagatgtcaaaagtaccaatatactgctggatgatcagctcatggccaaaattgctgattttgggctttcaagatcattcaaactcggagaagaatcacaggcttccacggttgttgctggtactcttggataccttgatcccgaatattatagaacatgtcggttggctgagatgagtgatgtatacagtttcggtattttactactagagataatcacaaaccaaaatgtgattgaccatgcccgcgaaaaggctcacattacagaatgggtaggacttgtgcttaagggaggagatgttactaggattgttgatcctaaccttgacggtgaatataactctcgttcagtttggagagctcttgaattggctatgtcatgcgccaacccttcttcagaacatcgaccaatcatgtcccaggttgttatcgatctaaaagagtgtttaaatactgaaaactcaatgaaaataaagaaaaatgacacggacaatgatggttctctggaactgagctcgagtgatactgaggcggtcccttgtgcaagg

SEQ ID NO: 568 - protein, 793 aa, Arabidopsis thaliana
  AT3G46370.1
MRNCYNLSVHKETKYLIRVTSNYGNYDGRNEPPRFDLYLGPNFWVTIDLGKHVNGDTWKEIIHIPKSNSLDVCLIKTGTTTPIISTLELRSLPKYSYNAISGSLKSTLRAFLSESTEVIRYPNDFYDRMWVPHFETEWKQISTNLKVNSSNGYLLPQDVLMTAAIPVNTSARLSFTENLEFPHDELYLYFHFSEVQVLQANQSREFSILWNGMVIYPDFIPDYLGAATVYNPSPSLCEVGKCLLELERTQKSTLPPLLNAIEVFTVMNFPQSETNDDDVIAITKIKDTHRLNRTSWQGDPCVPQLFSWAGLSCIDTNVSTPPRIISLNLSSSGLTGNIATGIQNLTKLQKLDLSNNNLTGVVPEFLANMKSLLFIDLRKNKLNGSIPKTLLDRKKKGLQLFVDGDDDKGDDNKCLSGSCVPKMKFPLMIVALAVSAVVVIAVVMILIFLFRKKKKSSLGITSAAISEESIETKRRRFTYSEVVEMTKNFQKTLGEGGFGTVYYGNLNGSEQVAVKVLSQSSSQGYKHFKAEVELLLRVHHINLVSLVGYCDERNHLALIYECMSNGDLKDHLSGKKGNAVLKWSTRLRIAVDAALGLEYLHYGCRPSIVHRDVKSTNILLDDQLMAKIADFGLSRSFKLGEESQASTVVAGTLGYLDPEYYRTCRLAEMSDVYSFGILLLEIITNQNVIDHAREKAHITEWVGLVLKGGDVTRIVDPNLDGEYNSRSVWRALELAMSCANPSSEHRPIMSQVVIDLKECLNTENSMKIKKNDTDNDGSLELSSSDTEAVPCAR

SEQ ID NO: 569 - DNA, 2649 bp, Arabidopsis thaliana
  AT3G46400.1
atggagagttcccataggtttttgttggtggcgctaacagtagcttcctctattattcaccttgttcaagctcaagcagggttcatcagtttggattgtggattatccccgaatgagcaatctccgtatgttgagctggaaactggattacagttcttatcagattcaagcttcatccaaagtgggaaaattggtagaattgatgcaagtcttgagtccaagtacccaagatcacagactacgttgagatattttccagatggaatacgaaactgctacaacgttaatgtttataagggaacaaattatttgatcagggctacaattaactatggaaattacgatggtcttaacatttctcctagatttgatttgtacattggtcctaatttttgggtgacaatagatttggagaagcatgtaggtggtgatacatgggaggagatcattcacatcccaaagtctaactctttggatgtgtgtcttattaagactggcacatcaacgccgatcatatcagtattggaactaaggtctctaccaaataatacttacatcacagaatcaggttctttgaagtctatactaagatcatacctaagtgtatcaacaaaagttataaggtacccagatgatttttatgatcgaaaatgggttccatactttgagtcagaatggaggcaaatatccaccattctcaaagtgaacaacaccattaatggttttcttgcgccgcaagaggtgctcatgactgccgcggtaccttccaatgctagtgtgccattgagtttcaccaaggatcttgaattccccaaagataaactttacttctacttccacttctctgagatccaacctttacaagccaatcagagtagagagtttagtattttgtggaacggagaaattattattcccactttgagtcctaaatatctaaaggctagtactctttatagtgtgtcaccatttgtttgtgaagtagggaaatgcttattagagctgaaaagaactcaaaactcaactctcccgcctctacttaccgccattgaagtttttacagttatcgactttccacagtctaaaacaaacgaagatgatgtgagtgctataaaaaacataaaagacacccatggattgagtagagtctcatggcaaggagatccatgcgtcccacgacagtttttgtgggaaggtctaagttgcaacgacaagaatgtgtctgcatcaccaagaataacttccttaaatttatcttcaagtgggctagtgggaaccataccttctggaattcaaaattttactcttctcgaaaagttggacttgtcaaataacaatttgacaggactggtgcccgaatttctagctaaaatggaaacattgttgttcatagacttgaggaagaacaaactgaatggttcaattccaaatactcttcgtgatagagaaaagaaaggactacaaatatttgttgatggtgataatacgtgtttatcatgtgtcccaaaaaataaatttccaatgatgattgctgcgttagctgcttctgcgatagttgtcgccatattggtactgattctcattttcgttttcacaaagaaaaagtggtcaactcatatggaagtaattttgccaacaatggatattatgtccaagactatatccgaacaattaatcaagacaaaaaggagaagatttgcttattcagaagttgtagaaatgacaaaaaaattcgaaaaagctctaggtgaaggagggtttggcatagtctaccatggttatctgaaaaatgtagagcaagtagcggttaaagtactatcacaatcatcatcgcaaggctataaacacttcaaggcagaggtcgaacttcttctaagagttcaccacataaatttggtaagtcttgtcggatattgcgatgaaaaagatcatttggccctcatctacgaatacatgcccaatggagatttaaaagatcacttgtcagggaaacaaggtgactctgttttggaatggactaccagactacaaatagctgtcgatgttgccctaggattggaatacttgcattatggatgccggccatcgatggtgcatagagatgtcaaaagtacaaatatattgttggatgatcagttcatggccaaaattgcggattttgggctttcaaggtcgtttaaagttggagacgaatctgagatttcgacggttgttgctggtactcctggttatcttgatcccgaatattatagaacaagtcggttggctgagatgagtgatgtatacagttttgggattgtattactagagattatcacaaaccaacgtgtgtttgaccaagctcgcggaaaaattcacatcacagaatgggtggcatttatgcttaacagaggagatattactaggattgttgatcctaaccttcacggtgaatacaactctcgttcagtatggagagctgttgaattggctatgtcatgtgcaaacccttcttcagaataccggccaaacatgtcccaggttgttatcgaactaaaagagtgtttaactactgaaaactctatgaaagtaaagaaaaatgacacagacgctggtagttctctcgaactgagcttgagcttcgatactgaggtggtccctactgcaaga

SEQ ID NO: 570 - protein, 883 aa, Arabidopsis thaliana
  AT3G46400.1
MESSHRFLLVALTVASSIIHLVQAQAGFISLDCGLSPNEQSPYVELETGLQFLSDSSFIQSGKIGRIDASLESKYPRSQTTLRYFPDGIRNCYNVNVYKGTNYLIRATINYGNYDGLNISPRFDLYIGPNFWVTIDLEKHVGGDTWEEIIHIPKSNSLDVCLIKTGTSTPIISVLELRSLPNNTYITESGSLKSILRSYLSVSTKVIRYPDDFYDRKWVPYFESEWRQISTILKVNNTINGFLAPQEVLMTAAVPSNASVPLSFTKDLEFPKDKLYFYFHFSEIQPLQANQSREFSILWNGEIIIPTLSPKYLKASTLYSVSPFVCEVGKCLLELKRTQNSTLPPLLTAIEVFTVIDFPQSKTNEDDVSAIKNIKDTHGLSRVSWQGDPCVPRQFLWEGLSCNDKNVSASPRITSLNLSSSGLVGTIPSGIQNFTLLEKLDLSNNNLTGLVPEFLAKMETLLFIDLRKNKLNGSIPNTLRDREKKGLQIFVDGDNTCLSCVPKNKFPMMIAALAASAIVVAILVLILIFVFTKKKWSTHMEVILPTMDIMSKTISEQLIKTKRRRFAYSEVVEMTKKFEKALGEGGFGIVYHGYLKNVEQVAVKVLSQSSSQGYKHFKAEVELLLRVHHINLVSLVGYCDEKDHLALIYEYMPNGDLKDHLSGKQGDSVLEWTTRLQIAVDVALGLEYLHYGCRPSMVHRDVKSTNILLDDQFMAKIADFGLSRSFKVGDESEISTVVAGTPGYLDPEYYRTSRLAEMSDVYSFGIVLLEIITNQRVFDQARGKIHITEWVAFMLNRGDITRIVDPNLHGEYNSRSVWRAVELAMSCANPSSEYRPNMSQVVIELKECLTTENSMKVKKNDTDAGSSLELSLSFDTEVVPTAR

SEQ ID NO: 571 - DNA, 2514 bp, Arabidopsis thaliana
  AT3G46420.1
atggagagtctcaagaagcttttgttggttgcattaatagcaacttctgccattcaccttgttcaagctcaaaatcaagacggatttatcagtgtagactgcggattatctcctaatgaggtctctccttatattgagccgtttactggactacagttcacaacggattcaaatttcattgaaaccggaaaacttggtagaattcaggcaagcctagagccgaagtaccgaaagtcgcaaacgacgttgagatattttcctgatggaatacgcaactgttacaatcttacagtgacacaaggaaccaactatttaatcagagctagagcaatatatgggaattatgatggtcttaacatttatcctaaatttgacttgtacataggccctaatttttgggtaacaatagacttaggaaagtatgtaaatggtacatgggaggagatcatctacataccaaaatctaatatgttggacgtgtgtcttgtcaagacagggccgtccacaccattgatatcatccttggtgttaaggcctcttgcaaatgctacttacatcactcaatctggttggttgaagacttatgttcgggtttatctaagcgactcaaatgacgtcatacgatatccggatgatgtctatgatcgtatatggggttcatactttgagccggagtggaagaagatttccactacacttggagtgaacagttctagtggatttctgcctccactaaaggcactcatgactgccgcctctcctgccaatgctagtgcaccattggctattcccggagtactagatttcccaagtgataaactatacttgttcctccacttctctgagattcaagtcttaaaggccaacgaaactagagagttcgaaattttttggaataaaaagcttgtttacaatgcttatagtcctgtatatctacagaccaagactatacgcaacccatctccagttacttgtgaaagaggagaatgcatactagagatgatcaaaactgagaggtcaactctcccgcctttgcttaacgccgttgaagttttcacagtggttgaatttcctcagccggaaacagatgctagtgatgtggtggctataaaaaacatcaaggccatctatggattgactcgagtcacatggcaaggagatccatgtgttcctcaacaatttttgtggaacggtttaaattgcaacagcatggagacgtctacacctccaagaatcacttccttggacttgtcttcaagcgggttaaccggaagcatatcagttgttattcaaaatcttacccatctagaaaagttggatttgtcaaataacaacttgactggggaagttcccgattttctagcaaacatgaaatttcttgtgttcataaacttaagcaagaacaatctgaatggttcgattcctaaagctcttcgcgatagagaaaataaaggacttaagttaattgtcgacaaaaatgtggacaactgctcatctggttcatgcacccaaaaaaagaaattcccattgcttattgttgcattaactgtttcgttgatcctagtcagtacagtggttatagacatgacaaataacttccaaagagctctaggagaaggagggtttggtgtcgtttatcatggttatttgaatggttcagagcaagtagctgtcaaattactttcgcaatcatcagtacaaggctataaagaattcaaggcagaggttgaacttcttctaagggttcaccatataaatttggtaagccttgttgggtattgcgatgatcgcaatcacttggctctcgtctacgaatacatgtccaatggagacttaaaacatcatttgtcaggaagaaacaatggttttgttttgagttggagtactcgactacaaatagctgtcgatgctgcactaggattggaatacttacatattggatgccgaccatcgatggtgcatagagatgtcaaaagtacgaatatactgttgggtgagcagttcacagccaagatggctgattttgggctttcaaggtctttccaaattggtgatgaaaatcatatttctacggttgttgctggtactcctggatatcttgatcccgaatactacagaacaagtcggttggctgagaagagcgatatctacagttttgggattgtgttattggaaatgatcacaagccaacatgcgattgatcgaacccgcgtgaaacatcacataacagactgggtggtgtctttgattagcagaggagatatcacacggatcattgatcccaatcttcagggcaattataattctcgctctgtctggagagctcttgaattggctatgtcatgtgcaaaccctacatcagaaaaacgaccaaacatgtcacaagttgttatcgatctgaaagaatgtcttgctactgaaaattcaacgagaagtgagaaagacatgagttctcatagttctgatcttgatcgtagcatgaacttttacaccgacatggttcctagagctagg

SEQ ID NO: 572 - protein, 838 aa, Arabidopsis thaliana
  AT3G46420.1
MESLKKLLLVALIATSAIHLVQAQNQDGFISVDCGLSPNEVSPYIEPFTGLQFTTDSNFIETGKLGRIQASLEPKYRKSQTTLRYFPDGIRNCYNLTVTQGTNYLIRARAIYGNYDGLNIYPKFDLYIGPNFWVTIDLGKYVNGTWEEIIYIPKSNMLDVCLVKTGPSTPLISSLVLRPLANATYITQSGWLKTYVRVYLSDSNDVIRYPDDVYDRIWGSYFEPEWKKISTTLGVNSSSGFLPPLKALMTAASPANASAPLAIPGVLDFPSDKLYLFLHFSEIQVLKANETREFEIFWNKKLVYNAYSPVYLQTKTIRNPSPVTCERGECILEMIKTERSTLPPLLNAVEVFTVVEFPQPETDASDVVAIKNIKAIYGLTRVTWQGDPCVPQQFLWNGLNCNSMETSTPPRITSLDLSSSGLTGSISVVIQNLTHLEKLDLSNNNLTGEVPDFLANMKFLVFINLSKNNLNGSIPKALRDRENKGLKLIVDKNVDNCSSGSCTQKKKFPLLIVALTVSLILVSTVVIDMTNNFQRALGEGGFGVVYHGYLNGSEQVAVKLLSQSSVQGYKEFKAEVELLLRVHHINLVSLVGYCDDRNHLALVYEYMSNGDLKHHLSGRNNGFVLSWSTRLQIAVDAALGLEYLHIGCRPSMVHRDVKSTNILLGEQFTAKMADFGLSRSFQIGDENHISTVVAGTPGYLDPEYYRTSRLAEKSDIYSFGIVLLEMITSQHAIDRTRVKHHITDWVVSLISRGDITRIIDPNLQGNYNSRSVWRALELAMSCANPTSEKRPNMSQVVIDLKECLATENSTRSEKDMSSHSSDLDRSMNFYTDMVPRAR

SEQ ID NO: 573 - DNA, 2676 bp, Arabidopsis thaliana
  AT5G59650.1
atggatagtccttgttggcttttgctgctgctattaggagcttttgccattattggttgtgttcaagctcaggatcaacaagagtttatcagtttggattgcgggttacccatgactgaaccgtcttcttatactgagtcagtaaccggactacggttctcgtctgatgctgaattcatccagactggtgaaagtggtaaaatccaggcgagtatggagaatgactaccttaagccgtacacgaggctgaggtattttccagaggagagaaggaactgctatagtttgagtgttgacaagaacaggaaatatttgatcagggctaggttcatttatgggaattacgatggtcgtaactctaacccgatatttgaactgcatctaggacctaatctgtgggcaactatagatttgcaaaagtttgtgaatggtacaatggaggagatccttcacactccaacatcaaactctttgaacgtttgtcttgttaagacagggacaactacacccttgatctcagccttggaattacggccattaggaaataattcttatctcacagatggttctttgaatcttttcgttcggatatatctcaacaagacagatggctttcttcggtacccggatgatatttatgatcgcagatggcataattactttatggtggatgattggacccaaattttcaccactctcgaagtgaccaatgataacaattatgaaccaccaaaaaaggctcttgcagcggctgccacgccttctaatgccagcgcgccattgacaatcagttggccaccagacaatcctggtgaccaatattacttgtacagccacttctctgagatacaagatttacagaccaatgataccagagaatttgacatattatgggatggagctgttgttgaagaaggtttcatccctccaaagttaggggtgactactatccataatctttctccagtgacatgcaaaggagaaaattgcatttaccagctaataaaaacctcgaggtcaactcttccttctctacttaacgctcttgaaatctacacagttatccaatttccacgaaatcaacttcacctgctaattctcacatccttgagctctacatcagtggttgctgttaaaaatatcgaagctgcctataaattgagtagaatcaggtggcaaggagatccttgcgtccctcaaaagtatgcgtgggatggtttgaactgtagcaacaacacagatgtttctaaacctccaagagtattatccttaaatttgtcttcgagcggtttaactggaatcattgcggccgcaattcaaaaccttacacatttagaaaaactggacttgtcaaataacacactaactggagtggtgccggaatttctagcccagatgaaatcgttggtgatcataaacttaagcggcaacaatcttagtggtccccttcctcaaggtcttcgaagagagggactagaattactagttcaaggcaacccaaggctttgtctctctggttcctgcacagaaaaaaactcgaagaagaaattcccggtggtgattgttgcatcagttgcttctgtggccataattgttgctgtgttggttattatttttgttctcagtaagaaaaagtcatctactgtgggagctctacaacctccactgagtatgccaatggttcatgataattcacctgaaccatcaatcgagacgaaaaagagaaggtttacttattcagaggttatcaaaatgacgaataattttcaaagagttgtaggggaaggaggattcggtgttgtttgtcatggtactataaatggttctgaacaggtggctgttaaagttctctctcaatcatcaagtcaaggatataagcattttaaggcagaggttgatcttcttctacgagttcaccatacaaatttggtgagtcttgttggatattgcgatgaaagagatcacttggctctcatctatgagtttttgcccaagggagacttaagacaacatctatctggaaaaagcggtgggtcctttatcaactggggtaatcgtctacgaatagctctggaggctgcactaggattggaatatctacattctggatgcacaccaccaattgtacatagagatataaaaacgacaaacatattgctggacgaacagttaaaggccaagcttgccgatttcggcctttcgagatctttccctattggaggtgaaacacatatttcaactgtggttgctggtactcctggataccttgatcctgaatattaccagacaactcgactgggtgagaagagcgatgtgtacagcttcggaattgtgttattggagattatcacaaaccaacctgtgattgaccagtcccgttcaaagtctcacatatcacaatgggttggatttgagcttacccgaggagatattactaagatcatggatccaaacctgaacggggattacgaatctcgttctgtatggagagttcttgaactggcaatgtcgtgtgcgaatccttcttctgtgaaccgaccaaacatgtcccaagttgctaatgaactgaaagaatgtcttgtttctgaaaacttgagggaaaatatgaatatggactctcagaattctcttaaagtgagcatgagctttgacacagagttgtttccgagggcaagg

SEQ ID NO: 574 - protein, 892 aa, Arabidopsis thaliana
  AT5G59650.1
MDSPCWLLLLLLGAFAIIGCVQAQDQQEFISLDCGLPMTEPSSYTESVTGLRFSSDAEFIQTGESGKIQASMENDYLKPYTRLRYFPEERRNCYSLSVDKNRKYLIRARFIYGNYDGRNSNPIFELHLGPNLWATIDLQKFVNGTMEEILHTPTSNSLNVCLVKTGTTTPLISALELRPLGNNSYLTDGSLNLFVRIYLNKTDGFLRYPDDIYDRRWHNYFMVDDWTQIFTTLEVTNDNNYEPPKKALAAAATPSNASAPLTISWPPDNPGDQYYLYSHFSEIQDLQTNDTREFDILWDGAVVEEGFIPPKLGVTTIHNLSPVTCKGENCIYQLIKTSRSTLPSLLNALEIYTVIQFPRNQLHLLILTSLSSTSVVAVKNIEAAYKLSRIRWQGDPCVPQKYAWDGLNCSNNTDVSKPPRVLSLNLSSSGLTGIIAAAIQNLTHLEKLDLSNNTLTGVVPEFLAQMKSLVIINLSGNNLSGPLPQGLRREGLELLVQGNPRLCLSGSCTEKNSKKKFPVVIVASVASVAIIVAVLVIIFVLSKKKSSTVGALQPPLSMPMVHDNSPEPSIETKKRRFTYSEVIKMTNNFQRVVGEGGFGVVCHGTINGSEQVAVKVLSQSSSQGYKHFKAEVDLLLRVHHTNLVSLVGYCDERDHLALIYEFLPKGDLRQHLSGKSGGSFINWGNRLRIALEAALGLEYLHSGCTPPIVHRDIKTTNILLDEQLKAKLADFGLSRSFPIGGETHISTVVAGTPGYLDPEYYQTTRLGEKSDVYSFGIVLLEIITNQPVIDQSRSKSHISQWVGFELTRGDITKIMDPNLNGDYESRSVWRVLELAMSCANPSSVNRPNMSQVANELKECLVSENLRENMNMDSQNSLKVSMSFDTELFPRAR

SEQ ID NO: 575 - DNA, 2604 bp, Arabidopsis thaliana
  AT5G59670.1
atggagagttcttttgggcttttgttggcactgttaactttgaccatcattcatattgttcaagctcaagacccacaagggttcatcagtttggattgcgggctacccgcaaatgagacgtctccttatacagagactcaaactggtctgttgttctcttcggacgcaacattcatccagagcggaaaaactggtagagtccaagcaaatcaagagagtaaattcttgaagccatacagaacgctgagatatttcccagagggagtacggaattgctacaatctgagtgtgttcaaggagcgtaaatatttgatcgctgctagttttttatatggaaattacgatggtcataacatagcccctgtgtttgatctttatcttggaccaaatttatgggcgaaaatagatttacaagatgtgaatggtacaggggaagagatcttacacatcccaacatcgaactcgttgcagatatgtcttgttcagactggggaaactacaccgctgatatcctctttggaattacggccaatgagaactggaagctataccactgtgtctggttccctgaaaacatacaggcgtttatattttaaaaagtctggatctaggctacggtacagtaaagatgtttatgatcgctcatggtttccgcgcttcatggacgaatggacccagatttccactgctctcggggtgattaataccaacatctaccaaccaccggaagatgcgctgaaaaatgctgccacgcctactgatgctagtgcgccactgacatttaaatggaattcagaaaaattggatgtccaatattacttttacgcacactatgctgagatccaagacttgcaggcaaatgataccagagaattcaacatcttattgaatggacaaaatttatctgtgactggccctgaagtcccagataagctaagtataaagaccttccaaagctcgtcaccgataagttgcaatggatgggcatgtaattttcagctgataagaaccaaaagatcaactcttccacctctacttaatgctttggaagtctacacagttattcagtttccacggtccgaaacagatgaaagcgacgtggttgctatgaaaaacatctcagccagctatggattgagtagaatcaactggcaaggcgatccatgcttccctcagcagcttaggtgggacgctttagactgcaccaacagaaatatctcccaaccaccaagaatcacttctttaaacttgtcttcaagtcgtttaaatggaaccatagcagctgccattcaaagtattacacaacttgaaacactggacttgtcgtataataacttaactggagaggtgccagagtttcttggcaaaatgaaatcgttgtcggtcataaacttaagcgggaacaatcttaatggttcaattccgcaagctcttcgaaagaaaagactaaaactataccttgaaggaaacccaaggcttataaaaccacctaagaaggaatttcctgtggcaattgttacattagttgtttttgtcacagtcattgtggttctttttcttgttttcagaaagaaaatgtccacgattgtaaaaggtctacgcctgccaccaaggacatcaatggtggatgttacattttctaataaaaaaagcaaaaggttcacatattcagaggtcgtccaagtgacaaagaacttccaaagagttttaggtaaaggagggttcggcatggtctatcacggtactgtaaagggttctgaacaggtggccgttaaggttctctctcaatcgtcaactcaaggctctaaggagttcaaagcagaggttgatctccttctgagagtgcaccatacaaatttggtgagcctggttgggtattgctgtgaaggagattacttggccctcgtctatgagtttcttcccaatggagacttaaaacaacatttgtcaggaaaaggaggtaattccatcatcaactggagtattcgactgcgaatagctttggaagcagcactaggtttggagtacttgcatattggatgcacaccaccgatggttcatagagatgtcaaaactgccaacatattgctcgacgagaattttaaggccaaactcgctgattttggtctttcaagatctttccaaggtgaaggcgaatctcaggaatcgacaacaattgctggtactcttggataccttgatcccgaatgttaccattcaggtcgattgggtgagaagagtgatgtctacagtttcgggatcgtgttattggagatgatcacaaaccaaccagtgatcaatcaaacctcgggagattctcacataacacaatgggttggctttcagatgaaccgaggtgatattcttgagattatggatccaaaccttcgcaaggattataacattaattctgcctggagagctttggaactggcaatgtcatgcgcgtatccttcttcctcaaaacgaccatccatgtctcaggttatacacgagctgaaagagtgtattgcgtgtgaaaacacagggataagtaagaatcgaagcttggaatatcaagaaatgaacgttagcttggacactacggcggttcccatggcaaga

SEQ ID NO: 576 - protein, 868 aa, Arabidopsis thaliana
  AT5G59670.1
MESSFGLLLALLTLTIIHIVQAQDPQGFISLDCGLPANETSPYTETQTGLLFSSDATFIQSGKTGRVQANQESKFLKPYRTLRYFPEGVRNCYNLSVFKERKYLIAASFLYGNYDGHNIAPVFDLYLGPNLWAKIDLQDVNGTGEEILHIPTSNSLQICLVQTGETTPLISSLELRPMRTGSYTTVSGSLKTYRRLYFKKSGSRLRYSKDVYDRSWFPRFMDEWTQISTALGVINTNIYQPPEDALKNAATPTDASAPLTFKWNSEKLDVQYYFYAHYAEIQDLQANDTREFNILLNGQNLSVTGPEVPDKLSIKTFQSSSPISCNGWACNFQLIRTKRSTLPPLLNALEVYTVIQFPRSETDESDVVAMKNISASYGLSRINWQGDPCFPQQLRWDALDCTNRNISQPPRITSLNLSSSRLNGTIAAAIQSITQLETLDLSYNNLTGEVPEFLGKMKSLSVINLSGNNLNGSIPQALRKKRLKLYLEGNPRLIKPPKKEFPVAIVTLVVFVTVIVVLFLVFRKKMSTIVKGLRLPPRTSMVDVTFSNKKSKRFTYSEVVQVTKNFQRVLGKGGFGMVYHGTVKGSEQVAVKVLSQSSTQGSKEFKAEVDLLLRVHHTNLVSLVGYCCEGDYLALVYEFLPNGDLKQHLSGKGGNSIINWSIRLRIALEAALGLEYLHIGCTPPMVHRDVKTANILLDENFKAKLADFGLSRSFQGEGESQESTTIAGTLGYLDPECYHSGRLGEKSDVYSFGIVLLEMITNQPVINQTSGDSHITQWVGFQMNRGDILEIMDPNLRKDYNINSAWRALELAMSCAYPSSSKRPSMSQVIHELKECIACENTGISKNRSLEYQEMNVSLDTTAVPMAR

SEQ ID NO: 577 - DNA, 2661 bp, Arabidopsis thaliana
  AT5G59680.1
atggagaggtctcttgagctcttgttgctccttatcagaactttggccatcattcatatttctcaagctcaaagccaacaagggttcatcagtttggattgtggtctacccgcgaatgaaccatctccttatacagagccgaggactggattgcagttttcttcggacgcagcattcatccagagtggaaaaattggtaggattcaagcaaatctggaggctgacttcctgaagccatcaacgacgatgagatattttccagacggaaaacggaactgctacaatctaaacgttgagaagggaagaaatcatcttatcagggctcggtttgtatatggaaattatgatggtcgtgacactggccccaagtttgatctgtatcttggacctaatccatgggccacgatagatttggcaaaacaagtgaatggtacacgtcccgagatcatgcacatcccaacatcaaacaagttgcaggtttgtcttgttaagactggggaaactacaccgctaatatcggttttggaagtacggccgatgggaagtggtacttatctcaccaagtctggctctctgaaactttactatcgagaatattttagcaagtctgattcttctctaaggtaccctgatgatatctatgaccgccaatggacttcgttctttgatacagagtggacacaaattaacaccactagcgatgtgggaaattccaatgactataagccaccaaaagtcgctctcactactgcggccattccaactaatgccagtgcgccattgacgaatgaatggagttcagtaaaccccgatgaacagtattacgtatacgcccatttttctgagatccaagagttgcaggcaaatgaaaccagggaattcaacatgttactaaatgggaaacttttttttggccctgtggttcctccaaagctagcaataagtactatcctaagtgtgtcgccgaatacttgtgaaggaggggagtgcaatttacagctgataagaaccaacagatcaactcttccacctctacttaacgcttatgaggtctacaaagttattcagtttccgcagttggaaacaaatgaaaccgacgtttctgctgtgaaaaacatccaagccacctatgaattgagtagaatcaactggcaaagcgatccatgcgtccctcaacagtttatgtgggatggtttaaactgcagcatcacagatataaccacgccaccaagaatcactactttaaacttgtcatcaagtggtttaactggaacgataacagctgccattcaaaatcttacgacactagaaaagctggacttgtcgaataataacttgaccggagaggtgccagaatttctaagcaacatgaaatcgctgttggtcataaacttaagcgggaacgatcttaacggtacaattcctcaatctctacaaaggaaaggacttgagctactttatcaaggaaaccccaggcttatttcccctggttcaactgaaaccaaatctggcaagagctttccagtaacaatagttgcatcagttggttctgcagccattcttattgttgtgctggttcttgtactttttctccgaaagaaaaagccgtcggctgttgaagttgttctcccgcgtccaagtaggccaacgatgaatgttccttatgctaactcacctgagccgtcaatcgagatgaaaaagagaaagtttacttattcagaggttacgaaaatgactaataatttcggaagagttgtaggggaaggaggatttggcgttgtctgccatggtactgtaaatggttctgaacaggtggctgttaaactactttcacaatcatcaactcaaggctataaagagttcaaggcagaggttgatcttcttctgagagttcaccatacgaatttggtaagccttgtcggatattgtgatgaaggagaccacttggcccttatctacgagtttgtacccaatggagacttaagacaacatttgtctggaaaaggaggtaaacccatcgtcaattggggtactcggctaagaatagcggcggaggcagcactaggtttggagtacttacacattggatgcacaccaccaatggttcatagagatgtcaaaactacaaacatattgctggacgagcattataaggccaaacttgctgattttgggctctcgagatctttccctgttggaggtgaatctcatgtttcgacggtgattgctggtactcctggttaccttgatccagaatattaccatacaagtcggttgagtgagaaaagtgatgtttacagtttcgggattgttttattagagatgatcacaaaccaagcagtgattgatcgaaaccgcagaaagtctcacataacacaatgggtagggtctgagcttaacggaggagatattgctaagatcatggatctaaagcttaacggtgattatgattctcgttctgcgtggagagctcttgagctagcaatgtcgtgcgcggatcctacctcagcaagacgaccaaccatgtctcatgttgttattgaactaaaagagtgtctcgtgtctgaaaactcgaggagaaatatgagtcgaggcatggatacactaagttcccctgaagtgagcatgatctttgatgctgagatgattcccagagcaaga

SEQ ID NO: 578 - protein, 887 aa, Arabidopsis thaliana
  AT5G59680.1
MERSLELLLLLIRTLAIIHISQAQSQQGFISLDCGLPANEPSPYTEPRTGLQFSSDAAFIQSGKIGRIQANLEADFLKPSTTMRYFPDGKRNCYNLNVEKGRNHLIRARFVYGNYDGRDTGPKFDLYLGPNPWATIDLAKQVNGTRPEIMHIPTSNKLQVCLVKTGETTPLISVLEVRPMGSGTYLTKSGSLKLYYREYFSKSDSSLRYPDDIYDRQWTSFFDTEWTQINTTSDVGNSNDYKPPKVALTTAAIPTNASAPLTNEWSSVNPDEQYYVYAHFSEIQELQANETREFNMLLNGKLFFGPVVPPKLAISTILSVSPNTCEGGECNLQLIRTNRSTLPPLLNAYEVYKVIQFPQLETNETDVSAVKNIQATYELSRINWQSDPCVPQQFMWDGLNCSITDITTPPRITTLNLSSSGLTGTITAAIQNLTTLEKLDLSNNNLTGEVPEFLSNMKSLLVINLSGNDLNGTIPQSLQRKGLELLYQGNPRLISPGSTETKSGKSFPVTIVASVGSAAILIVVLVLVLFLRKKKPSAVEVVLPRPSRPTMNVPYANSPEPSIEMKKRKFTYSEVTKMTNNFGRVVGEGGFGVVCHGTVNGSEQVAVKLLSQSSTQGYKEFKAEVDLLLRVHHTNLVSLVGYCDEGDHLALIYEFVPNGDLRQHLSGKGGKPIVNWGTRLRIAAEAALGLEYLHIGCTPPMVHRDVKTTNILLDEHYKAKLADFGLSRSFPVGGESHVSTVIAGTPGYLDPEYYHTSRLSEKSDVYSFGIVLLEMITNQAVIDRNRRKSHITQWVGSELNGGDIAKIMDLKLNGDYDSRSAWRALELAMSCADPTSARRPTMSHVVIELKECLVSENSRRNMSRGMDTLSSPEVSMIFDAEMIPRAR

SEQ ID NO: 579 - DNA, 2664 bp, Arabidopsis thaliana
  AT1G49100.1
atggagaagtattttcatggagttttatgtgtgttcatcatcacagttgcttttatacatgttgttcaggctcaagatccaaacggattcatcactttggattgtggtctgttacctgatggatctccatataccaatccatctactggattaacattcacttcggattctagtttcatcgagagtggaaagaatggccgagtcagtaaggactctgagcgaaacttcgaaaaagcttttgtaactctaagatactttccagatggagagcggaactgttataacctgaatgtcacacaaggaacaaattacttgattagagcagctttcttatatggaaattacgatggtcttaatactgtcccaaactttgatctatttattggccctaataaggtgacaacagtgaattttaatgcaaccggaggtggtgtgttcgtggagataattcacatgtcaaggtcaacccctttggatatttgtcttgttaagacaggaacaactacaccgatgatatcaaccttggagctacgacctttgagaagtgatacttacattagtgccattgggagctccttgctcctctattttagaggttatcttaatgattcaggtgtcgttttacggtaccccgatgatgtcaacgaccgtagatggttcccattctcatataaggagtggaaaattgtaaccacaactctcaatgtaaacacttcaaatggttttgatctaccacaaggtgcaatggcatcggctgcaacccgtgttaatgataatgggacatgggaatttccatggagcttagaggattctaccacacggtttcacatttaccttcacttcgcagagcttcaaactttgttagccaacgagactagagaattcaatgttttgctgaatggaaaagtttattatggaccttatagtcctaaaatgttaagtatagatactatgagcccccaacccgattcgacattgacatgtaaaggaggaagttgcctcttgcagctagtgaagacaacaaagtcaactcttcctcctctcatcaatgctattgaactttttactgttgttgagtttcctcaatcagaaacaaaccaagatgaagtgattgctatcaagaagatccaacttacttatggattgagtagaattaactggcaaggagatccatgtgtccccgagcagtttttgtgggctggtttgaagtgcagcaatattaatagttccactccaccaacaatcactttcttaaacttgtcttcaagtggactaaccgggatcatttcaccttccatccagaatttgacccatttacaagagttggatttgtcaaataacgacttgaccggggatgtgcctgagtttctagctgacataaaatcgctcttgatcataaacttaagtggaaacaattttagcggtcaacttcctcaaaagcttatagataagaaaagactgaagctgaatgttgaaggaaaccctaagcttctttgcacaaaaggaccatgtggaaataaacctggagaaggtggacatcccaaaaagagtataattgtaccggttgtctcatcagttgctttaatagctattcttatagctgcattggttttgtttttggttcttagaaagaaaaatccatcaaggagtaaagaaaatggtagaacttcaagatcatccgagccaccaagaataacaaaaaagaaaaagtttacttacgtggaagttactgaaatgacaaataactttagaagtgttcttgggaaaggagggttcggtatggtttatcatggatatgtaaatggtagagagcaagttgctgttaaagtactctcacacgcttcaaaacatggccataaacaattcaaagcagaggttgaacttcttttgagagttcatcacaagaatttggtaagcctagttggatactgcgaaaaagggaaggaattggctcttgtctacgaatacatggctaatggagacttaaaagagtttttctcagggaagcgtggtgatgatgttttaaggtgggaaactagattacaaatagcagtggaggccgcacaaggtttggagtacttgcataaaggatgtagaccaccaattgttcatagagatgtcaaaaccgcaaacatattattggatgaacacttccaagccaaacttgctgactttgggctttcgagatcatttctaaacgaaggagaaagtcatgtctcgacagttgttgcaggaactattggttaccttgatccagaatattacagaacaaattggttgacagagaagagtgatgtgtatagttttggggtcgttttattggagatcataacaaatcagcgcgtgattgagcggactcgagaaaagccacacatagcagaatgggtgaatttaatgattaccaaaggagatattagaaaaattgtagatccaaatctcaagggagattaccattctgattctgtttggaagtttgtggagctagcaatgacttgtgtaaatgattcttcagcgacaagaccgaccatgactcaagttgttaccgaactaaccgaatgtgtaactttagaaaactcaaggggagggaaaagtcagaacatgggttcaacgagttcaagcgaagtgaccatgacctttgataccgaagtgaaccctgtggctcgc

SEQ ID NO: 580 - protein, 888 aa, Arabidopsis thaliana
  AT1G49100.1
MEKYFHGVLCVFIITVAFIHVVQAQDPNGFITLDCGLLPDGSPYTNPSTGLTFTSDSSFIESGKNGRVSKDSERNFEKAFVTLRYFPDGERNCYNLNVTQGTNYLIRAAFLYGNYDGLNTVPNFDLFIGPNKVTTVNFNATGGGVFVEIIHMSRSTPLDICLVKTGTTTPMISTLELRPLRSDTYISAIGSSLLLYFRGYLNDSGVVLRYPDDVNDRRWFPFSYKEWKIVTTTLNVNTSNGFDLPQGAMASAATRVNDNGTWEFPWSLEDSTTRFHIYLHFAELQTLLANETREFNVLLNGKVYYGPYSPKMLSIDTMSPQPDSTLTCKGGSCLLQLVKTTKSTLPPLINAIELFTVVEFPQSETNQDEVIAIKKIQLTYGLSRINWQGDPCVPEQFLWAGLKCSNINSSTPPTITFLNLSSSGLTGIISPSIQNLTHLQELDLSNNDLTGDVPEFLADIKSLLIINLSGNNFSGQLPQKLIDKKRLKLNVEGNPKLLCTKGPCGNKPGEGGHPKKSIIVPVVSSVALIAILIAALVLFLVLRKKNPSRSKENGRTSRSSEPPRITKKKKFTYVEVTEMTNNFRSVLGKGGFGMVYHGYVNGREQVAVKVLSHASKHGHKQFKAEVELLLRVHHKNLVSLVGYCEKGKELALVYEYMANGDLKEFFSGKRGDDVLRWETRLQIAVEAAQGLEYLHKGCRPPIVHRDVKTANILLDEHFQAKLADFGLSRSFLNEGESHVSTVVAGTIGYLDPEYYRTNWLTEKSDVYSFGVVLLEIITNQRVIERTREKPHIAEWVNLMITKGDIRKIVDPNLKGDYHSDSVWKFVELAMTCVNDSSATRPTMTQVVTELTECVTLENSRGGKSQNMGSTSSSEVTMTFDTEVNPVAR

SEQ ID NO: 581 - DNA, 2652 bp, Arabidopsis thaliana
  AT1G51805.1
atggagagtcatcgtgtgttcgttgccacttttatgctgatacttcatcttgttcaagctcaagatcaacccggattcatcaatgtggattgcggtttactccctcgtgattctccttacaacgcactcggaaccggtttagtatatacatcagatgtcggtttagttagcagtgggaaaactggtaaaatcgccaaggaattcgaagagaacaacagtacaccgaatttgacattgagatactttccagacggagcacgaaactgctacaacttaaacgtgagccgtgacaccaactatatgatcaaggctacattcgtgtatggaaattacgatggtcataaagatgagccgaacttcgacctttacttgggtccaaatttatgggcaacggtaagccgcagtgaaactgttgaggagatcatccatgtgacgaaatccgattcgttacaggtttgtcttgctaagacgggagattttataccttttattaatatcttggagctacgaccattgaagaaaaatgtgtacgttacagaaagtggctcactcaagctcttatttaggaagtattttagtgactcaggtcaaacgataaggtatccagatgatatctatgaccgtgtatggcatgcatccttcctggaaaataattgggcacaagtatcgacgactttgggtgtaaacgttactgataattatgatttatcacaagatgtaatggcaacgggcgcaacacctctaaacgatagtgagacattgaacattacatggaacgtagagcctcctactacaaaggtttactcctacatgcactttgcagagcttgagacactaagggccaacgatacaagggaattcaatgtgatgctgaatggaaatgacttgtttggaccttacagtccaataccgctaaagaccgaaacagaaaccaacttaaaaccagaggaatgcgaagatggggcatgtattttgcagcttgtgaagacgtcaaaatcaactcttccgcctttacttaatgctatagaggctttcaccgtgattgatttcctacaagtggagacagatgaagatgacgctgctgctatcaagaatgttcaaaatgcttatggattgattaatagaagcagttggcaaggagatccatgtgtccccaaacagtattcgtgggacggtctaaagtgcagttactcagatagtactccaccaataattaatttcttagacttatctgcaagtggactaaccgggatcatcgcgcctgccattcaaaatcttactcacctagaaatattggccttgtcaaataacaatttgaccggagaagtacctgaatttctagctgacttaaaatcaatcatggtcatagacttaagaggcaataacctcagtggcccggttcctgcctcacttcttcagaagaaaggattgatgctacatcttgatgacaatccccatattctttgcacaactggttcatgtatgcacaaaggagaaggcgaaaaaaagagtatcattgtaccagtggttgcatcaattgtttcattggctgttattataggtgcactcattctgttccttgttttccgaaagaaaaaggcatcaaaagttgaagggacactaccatcttacatgcaagcatcagatggtagatcgccgagatcctctgaaccagcaatagtgacgaaaaacaaaaggtttacttactcacaagttgtgataatgacaaataacttccaaagaatccttgggaaaggagggtttggaatcgtttatcatggctttgtgaacggtgttgaacaagtagctgttaagatactctctcattcatcatctcaagggtataaacaattcaaagctgaggtagaacttcttcttagagttcatcacaagaatttggttggtcttgttgggtattgcgacgaaggagagaacatggctcttatctatgaatacatggccaatggagatttaaaagaacatatgtcaggaacaagaaaccgatttattttaaattgggaaactagactaaaaatagtcattgactctgcgcaagggcttgagtatttgcataatggatgcaaaccactaatggtacacagggacgtcaaaactacaaatatattgttaaatgaacactttgaagccaaacttgctgattttgggctttcaaggtcttttccgattggaggtgaaactcatgtgtcaacagttgttgctggaactcctggatatctcgatcctgaatattacaaaacaaatcggttgacagagaagagtgatgtatatagttttgggattgtattgttggagatgatcacaaatcggccagtgatagaccaaagccgtgaaaagccatatatttcagaatgggtggggataatgcttacgaaaggagacatcattagcattatggatccaagtctaaatggagactatgattctggttctgtgtggaaagctgttgaactagcaatgtcttgtctgaatccttcttcaacaagaagacctaccatgtctcaagttcttattgcattaaacgaatgtttggtatctgaaaattcaaggggaggagcgagtagggacatggactcaaagagttccctagaggtaagcttgacatttgatactgatgtgagcccaatggctagg

SEQ ID NO: 582 - protein, 884 aa, Arabidopsis thaliana
  AT1G51805.1
MESHRVFVATFMLILHLVQAQDQPGFINVDCGLLPRDSPYNALGTGLVYTSDVGLVSSGKTGKIAKEFEENNSTPNLTLRYFPDGARNCYNLNVSRDTNYMIKATFVYGNYDGHKDEPNFDLYLGPNLWATVSRSETVEEIIHVTKSDSLQVCLAKTGDFIPFINILELRPLKKNVYVTESGSLKLLFRKYFSDSGQTIRYPDDIYDRVWHASFLENNWAQVSTTLGVNVTDNYDLSQDVMATGATPLNDSETLNITWNVEPPTTKVYSYMHFAELETLRANDTREFNVMLNGNDLFGPYSPIPLKTETETNLKPEECEDGACILQLVKTSKSTLPPLLNAIEAFTVIDFLQVETDEDDAAAIKNVQNAYGLINRSSWQGDPCVPKQYSWDGLKCSYSDSTPPIINFLDLSASGLTGIIAPAIQNLTHLEILALSNNNLTGEVPEFLADLKSIMVIDLRGNNLSGPVPASLLQKKGLMLHLDDNPHILCTTGSCMHKGEGEKKSIIVPVVASIVSLAVIIGALILFLVFRKKKASKVEGTLPSYMQASDGRSPRSSEPAIVTKNKRFTYSQVVIMTNNFQRILGKGGFGIVYHGFVNGVEQVAVKILSHSSSQGYKQFKAEVELLLRVHHKNLVGLVGYCDEGENMALIYEYMANGDLKEHMSGTRNRFILNWETRLKIVIDSAQGLEYLHNGCKPLMVHRDVKTTNILLNEHFEAKLADFGLSRSFPIGGETHVSTVVAGTPGYLDPEYYKTNRLTEKSDVYSFGIVLLEMITNRPVIDQSREKPYISEWVGIMLTKGDIISIMDPSLNGDYDSGSVWKAVELAMSCLNPSSTRRPTMSQVLIALNECLVSENSRGGASRDMDSKSSLEVSLTFDTDVSPMAR

SEQ ID NO: 583 - DNA, 2655 bp, Arabidopsis thaliana
  AT1G51820.1
atggagagacattttgtgtttattgccacctatttgctgatatttcatcttgttcaagctcaaaatcaaacaggattcattagtgtggattgtggtttatcccttcttgagtctccttacgatgcaccacaaacgggtttaacatatacatcagatgccgatttagtagctagtggcaaaaccggtagactcgccaaagaatttgaaccactcgttgataagccgactttgacactgagatactttccagagggagtacgaaactgctacaatctaaatgtcaccagcgacaccaactatttaatcaaggccacatttgtatatgggaattacgatggtcttaatgttgggccaaacttcaacctttatctcggtccgaatttgtggacaacggtgagtagcaatgacactatagaggaaataatccttgtgaccagatccaactctttacaggtgtgtcttgttaagacgggaataagtataccttttataaatatgttggagctacgaccgatgaagaaaaatatgtacgttactcaaagcggttcactgaagtatttattcagagggtatattagcaattcaagtactcgtataaggttcccggatgatgtctatgaccgtaaatggtacccgctcttcgacgactcatggacacaagtaactacaaatctcaaagtgaacacaagtattacttatgaactaccacaaagtgtaatggcaaaagccgcaacgccaattaaggctaacgacaccttgaacattacatggacggtagagccccctactacacagttttactcttacgtacacattgcagagattcaggctctaagggcaaacgagacaagggagttcaatgtgacactgaatggagaatatacttttggaccttttagtcctataccgctaaaaaccgcatccatagtcgacttaagcccagggcaatgcgatggagggagatgcattttgcaggttgtgaagacgctgaaatctacgcttcctcctttacttaatgctatcgaagctttcaccgtgattgatttcccgcaaatggagacaaatgaaaatgatgttgctgggatcaagaatgttcaaggtacttatggattgagtagaattagttggcaaggagatccatgtgtccccaaacagttattgtgggatggtctaaactgcaaaaactcggatatttctacgccaccgataatcacttccttagacttatcttcaagtggattaactgggatcatcacgcaagccattaagaatcttactcacctgcaaatattggacttgtcagataataatttgactggagaagtacctgagtttttagctgacataaaatcactcttggtcataaacttaagtggtaataatctaagtggctcagttcctccctcacttcttcagaagaaaggaatgaagttaaatgtcgaaggcaatcctcatattctttgcacaacgggttcttgtgtcaagaaaaaagaggatggacataagaaaaagagtgtcatagtgccagttgttgcatcaattgcttcaatagctgttcttataggtgcattggttctgtttctaattcttagaaagaaaaggtcaccaaaagttgaagggccaccaccatcttatatgcaagcatcagatggtagattgcctagatcatctgaaccggcaatcgtaacgaaaaatagaaggttttcttattcacaagttgtgataatgacaaataacttccaaagaatccttgggaaaggagggtttggaatggtttatcatggtttcgtgaacggtacagagcaagtagctgttaagatactctcccattcatcgtctcaaggatataaacaattcaaagctgaggtagaacttcttcttagagttcatcacaagaacttggttggtcttgttgggtactgcgacgaaggagataacttggctcttatctatgaatacatggccaatggagatctaaaagaacatatgtcaggaacacgtaaccgctttattttgaattggggaactagactaaaaatagtcatcgagtctgcacaaggactcgagtacttgcataatggttgcaaaccaccaatggtacatagggacgtcaaaactacaaatatattgttgaacgaacactttgaggccaaacttgcggattttgggctttcgagatcattcctgatcgaaggtgaaactcatgtatcaacagttgttgctggaactcctggatatctcgatcctgaataccatagaacaaattggttgacagaaaagagtgatgtttatagttttgggattctattgttggagattatcacaaaccgacatgtgatcgaccaaagccgtgaaaagccacacataggagaatgggtaggagtaatgcttacaaaaggagacatccaaagcattatggatccaagtctcaatgaagattatgattccggttctgtttggaaagctgttgaactagcaatgagttgtctaaatcattcttcagcgagaagaccgaccatgtcccaagttgttattgaattgaacgagtgtctggcttctgaaaatgcaaggggaggagcaagtcgggacatggaatcaaagagttctatagaagtgagcttgacgtttggtactgaagtgagcccaaacgctcga

SEQ ID NO: 584 - protein, 885 aa, Arabidopsis thaliana
  AT1G51820.1
MERHFVFIATYLLIFHLVQAQNQTGFISVDCGLSLLESPYDAPQTGLTYTSDADLVASGKTGRLAKEFEPLVDKPTLTLRYFPEGVRNCYNLNVTSDTNYLIKATFVYGNYDGLNVGPNFNLYLGPNLWTTVSSNDTIEEIILVTRSNSLQVCLVKTGISIPFINMLELRPMKKNMYVTQSGSLKYLFRGYISNSSTRIRFPDDVYDRKWYPLFDDSWTQVTTNLKVNTSITYELPQSVMAKAATPIKANDTLNITWTVEPPTTQFYSYVHIAEIQALRANETREFNVTLNGEYTFGPFSPIPLKTASIVDLSPGQCDGGRCILQVVKTLKSTLPPLLNAIEAFTVIDFPQMETNENDVAGIKNVQGTYGLSRISWQGDPCVPKQLLWDGLNCKNSDISTPPIITSLDLSSSGLTGIITQAIKNLTHLQILDLSDNNLTGEVPEFLADIKSLLVINLSGNNLSGSVPPSLLQKKGMKLNVEGNPHILCTTGSCVKKKEDGHKKKSVIVPVVASIASIAVLIGALVLFLILRKKRSPKVEGPPPSYMQASDGRLPRSSEPAIVTKNRRFSYSQVVIMTNNFQRILGKGGFGMVYHGFVNGTEQVAVKILSHSSSQGYKQFKAEVELLLRVHHKNLVGLVGYCDEGDNLALIYEYMANGDLKEHMSGTRNRFILNWGTRLKIVIESAQGLEYLHNGCKPPMVHRDVKTTNILLNEHFEAKLADFGLSRSFLIEGETHVSTVVAGTPGYLDPEYHRTNWLTEKSDVYSFGILLLEIITNRHVIDQSREKPHIGEWVGVMLTKGDIQSIMDPSLNEDYDSGSVWKAVELAMSCLNHSSARRPTMSQVVIELNECLASENARGGASRDMESKSSIEVSLTFGTEVSPNAR

SEQ ID NO: 585 - DNA, 2595 bp, Arabidopsis thaliana
  AT1G51850.1
atggagagacattgtgtgttagttgccacttttttgctgatgcttcatatcgttcatgctcaggatcaaattggattcattagtgtggattgtggtttggcacctcgtgagtctccttacaatgaagccaaaactggtttaacatatacatcagatgacggtctagtcaacgttgggaaacccggtagaatcgccaaggaattcgaaccgctcgccgataagccgactttgacactgagatattttccagagggagtacgaaactgctacaatctaaatgtcaccagcgacaccaactatctgatcaaggccacattcgtatatggaaattacgatggtcttaatgttgggccaaacttcgacctttacttcggtccgaatttgtggactacggtatgtcttattaagactggaataagtataccttttataaatgttttggagctacgaccgatgaagaaaaacatgtacgttactcaaggcgaatcactgaattacttattcagggtgtatattagcaattcaagtactcgtataaggttcccggatgatgtctatgatcgtaaatggtacccgtacttcgacaactcatggacacaagtaactacgactctcgatgtaaacacaagtcttacttatgaactaccacaaagtgtaatggcaaaagccgcaacgccaattaaggctaacgacaccttgaacattacatggacagtagagcctcctactacaaagttttactcctacatgcactttgcagagcttcagactttaagagccaacgatgcaagggaattcaatgtgacgatgaatggaatatatacatatggaccttatagtcctaaaccactaaaaaccgaaaccatatacgacaaaatccctgagcaatgcgatggaggtgcatgccttttgcaggttgtgaagacacttaaatctacccttccacctttacttaatgctatcgaggctttcaccgtgattgatttcccgcagatggagactaatggagatgacgttgatgcaatcaagaatgttcaagatacgtatggaattagtagaattagttggcaaggagatccatgtgtccccaaactgtttttgtgggatggtctaaattgcaacaactccgataattcgacatcaccaatcatcacttccttagacttatcttcaagtggactaactgggagcatcacccaagccattcagaatctaactaacctgcaagaactggacttgtcagataacaatttgactggagaaatacctgatttcttaggggacattaaatcactcttggtcataaacttaagtggtaataatctaagtggctcagttcctccctcacttcttcagaagaaaggaatgaagttaaatgtcgaaggaaaccctcatcttctttgcacagctgattcatgtgtgaaaaaaggagaggatggacacaagaaaaagagtgtcatagtgccagttgttgcatcaattgcttcaatagctgttcttataggtgcattggttctgtttttcattcttagaaagaaaaagtcaccaaaagttgaaggaccaccaccatcttatatgcaagcatcagatggtagatcgccaagatcatctgaaccggcaatagtgacaaagaatagaaggtttacttactcacaagttgcgataatgacaaataacttccaaagaatccttggaaaaggagggtttggaatggtttatcatggttttgtgaacggtacagaacaagtagctgttaagatactctcccattcatcgtctcaaggatataaagaatttaaagcggaggtagaacttcttcttagagttcatcacaagaacttggtcggtcttgttgggtactgcgacgaaggagagaacatggctcttatctatgaatacatggccaatggagatctaaaagaacatatgtcaggaacacgtaaccggtttactttgaattggggaactagactgaaaatagtcgtcgagtctgcacaaggacttgagtacttgcataatggatgcaaaccaccaatggttcatagagatgtcaaaaccacaaatatattgctgaacgaacacttccaagccaaactagctgattttgggctttcaaggtcatttccaattgaaggtgaaactcatgtgtcaacagttgttgctggaacgcctggatatcttgatcccgaatactataaaacaaattggttgacagaaaagagtgatgtttatagttttgggattgtattgttggagcttatcacaaatcgacccgtgatcgacaaaagccgtgaaaagccacatatagcagaatgggtaggagtaatgcttacaaaaggagacatcaacagtatcatggatcctaatttaaatgaagattatgattctggttctgtttggaaagctgttgagctagccatgagttgtctcaatccttcttcagcaagaagaccgaccatgtcccaagttgttattgaactaaacgagtgtatagcatcagaaaattcaaggggaggagcgagtcgggatatggactcgaagagttccatagaagtgagcttgacctttgataccgaactgagcccaacggctcgg

SEQ ID NO: 586 - protein, 865 aa, Arabidopsis thaliana
  AT1G51850.1
MERHCVLVATFLLMLHIVHAQDQIGFISVDCGLAPRESPYNEAKTGLTYTSDDGLVNVGKPGRIAKEFEPLADKPTLTLRYFPEGVRNCYNLNVTSDTNYLIKATFVYGNYDGLNVGPNFDLYFGPNLWTTVCLIKTGISIPFINVLELRPMKKNMYVTQGESLNYLFRVYISNSSTRIRFPDDVYDRKWYPYFDNSWTQVTTTLDVNTSLTYELPQSVMAKAATPIKANDTLNITWTVEPPTTKFYSYMHFAELQTLRANDAREFNVTMNGIYTYGPYSPKPLKTETIYDKIPEQCDGGACLLQVVKTLKSTLPPLLNAIEAFTVIDFPQMETNGDDVDAIKNVQDTYGISRISWQGDPCVPKLFLWDGLNCNNSDNSTSPIITSLDLSSSGLTGSITQAIQNLTNLQELDLSDNNLTGEIPDFLGDIKSLLVINLSGNNLSGSVPPSLLQKKGMKLNVEGNPHLLCTADSCVKKGEDGHKKKSVIVPVVASIASIAVLIGALVLFFILRKKKSPKVEGPPPSYMQASDGRSPRSSEPAIVTKNRRFTYSQVAIMTNNFQRILGKGGFGMVYHGFVNGTEQVAVKILSHSSSQGYKEFKAEVELLLRVHHKNLVGLVGYCDEGENMALIYEYMANGDLKEHMSGTRNRFTLNWGTRLKIVVESAQGLEYLHNGCKPPMVHRDVKTTNILLNEHFQAKLADFGLSRSFPIEGETHVSTVVAGTPGYLDPEYYKTNWLTEKSDVYSFGIVLLELITNRPVIDKSREKPHIAEWVGVMLTKGDINSIMDPNLNEDYDSGSVWKAVELAMSCLNPSSARRPTMSQVVIELNECIASENSRGGASRDMDSKSSIEVSLTFDTELSPTAR

SEQ ID NO: 587 - DNA, 2079 bp, Arabidopsis thaliana
  AT1G51830.1
atgacagttttttttataaacgattgtgtcaggttcccggatgatgtgtatgaccgaaaatggtacccgatcttccagaactcatggacgcaagtaactacgaatctcaatgtaaatattagcactatttatgaactaccacaaagcgtaatgtcaacagccgcgacgccgctaaatgctaatgcgaccttgaacattacatggacaatagagcctcctactacaccattttactcctacattcactttgcagagcttcaatctctaagggccaatgatacaagagaattcaatgtgacgttgaatggggagtatacaattggaccttatagtcctaaaccgctaaaaaccgaaaccatacaagacttaagccccgagcaatgtaatggaggggcgtgtattttgcagcttgtggagacgctgaaatcaactcttccgcctttacttaatgctattgaggctttcactgtgattgatttcccgcaaatggagacaaatgaagatgatgttactggtatcaacgatgttcaaaacacttatggattgaatagaatcagttggcaaggagatccatgtgtccccaaacagtattcgtgggacggtctaaattgcaacaactcagatatctctataccaccaataatcatttccttagatttatcttcaagtggtttaaatggggtcattacacaaggcattcaaaatctaacccatcttcaatacttggacttgtcagataataatttaactggtgatatacctaaatttctagctgacatacaatcactcttggttataaacttaagtggtaataatctcactggatcggtgcctctctcacttcttcagaagaaaggattgaaattaaatgtcgaaggcaaccctcatcttctttgcacagatggtttatgtgttaacaaaggagatggacataagaaaaagagcatcatagcaccagtggtcgcatcaattgcttcaatagctattcttataggtgcattggttctgttttttgttcttaaaaagaaaacgcaatcaaaagggccaccagcagcatatgtacaagcgtcgaatggtagatcccgtagatctgcagaaccagcaatagtgacgaagaataaacggtttacttactctgaagttatgcaaatgacaaataacttccaaagagtgcttgggaaaggagggtttggaattgtttatcatggtttggtgaatggtactgaacaagtagctattaagatactctcccattcttcatctcaaggatataaacaattcaaagctgaggtagaacttcttcttagagttcatcacaagaatttggtaggccttgttggatactgtgacgaaggagagaacttggctcttatatatgaatacatggccaatggagatttaaaagaacacatgtcaggaacacgaaaccacttcattttaaattggggaactagactaaaaatagtcgttgaatctgcccaaggacttgagtatttgcacaatggatgcaaaccactaatggtgcatagagacatcaaaacaacaaatatattgttgaatgaacaatttgatgccaaacttgctgattttgggctctcgagatcattcccgattgaaggtgaaactcatgtttcaacagctgttgctggaactcctggatatctcgatcccgaatactacagaacaaattggttgactgaaaagagtgatgtttatagtttcggagtcgtattgttagagatcatcacaaaccaacccgtgatagacccaagacgtgaaaagccacatatagcagaatgggttggggaagtgcttacaaaaggagacataaaaaatataatggatccaagtctaaatggagattatgattccacttctgtttggaaagctgttgagctagcgatgtgttgtcttaatccttcatcagctagaagaccgaacatgtctcaagttgttattgaattaaacgagtgtttgacatctgaaaattcaaggggaggagcgattcgagacatggactcagaaggttctatagaagtaagcttgacctttggtaccgaagtgaccccattggctcgg

SEQ ID NO: 588 - protein, 693 aa, Arabidopsis thaliana
  AT1G51830.1
MTVFFINDCVRFPDDVYDRKWYPIFQNSWTQVTTNLNVNISTIYELPQSVMSTAATPLNANATLNITWTIEPPTTPFYSYIHFAELQSLRANDTREFNVTLNGEYTIGPYSPKPLKTETIQDLSPEQCNGGACILQLVETLKSTLPPLLNAIEAFTVIDFPQMETNEDDVTGINDVQNTYGLNRISWQGDPCVPKQYSWDGLNCNNSDISIPPIIISLDLSSSGLNGVITQGIQNLTHLQYLDLSDNNLTGDIPKFLADIQSLLVINLSGNNLTGSVPLSLLQKKGLKLNVEGNPHLLCTDGLCVNKGDGHKKKSIIAPVVASIASIAILIGALVLFFVLKKKTQSKGPPAAYVQASNGRSRRSAEPAIVTKNKRFTYSEVMQMTNNFQRVLGKGGFGIVYHGLVNGTEQVAIKILSHSSSQGYKQFKAEVELLLRVHHKNLVGLVGYCDEGENLALIYEYMANGDLKEHMSGTRNHFILNWGTRLKIVVESAQGLEYLHNGCKPLMVHRDIKTTNILLNEQFDAKLADFGLSRSFPIEGETHVSTAVAGTPGYLDPEYYRTNWLTEKSDVYSFGVVLLEIITNQPVIDPRREKPHIAEWVGEVLTKGDIKNIMDPSLNGDYDSTSVWKAVELAMCCLNPSSARRPNMSQVVIELNECLTSENSRGGAIRDMDSEGSIEVSLTFGTEVTPLAR

SEQ ID NO: 589 - DNA, 2232 bp, Arabidopsis thaliana
  AT1G51810.1
atgtggatcacggtgaatactgataacactatcaaggagatcctccacgtatcgaaatcaaacactttgcaagtgtgtcttgttaagacaggtacaagtataccttatataaatacattggaactacgaccattggccgacgatatatacaccaacgaaagtggctccctcaactatctttttcgggtttattatagcaatttaaagggctatatagagtaccccgatgatgtccacgatcgcatatggaaacaaatcctaccttaccaggattggcagattttaactacgaatctccaaataaacgtttctaatgattatgatctaccccaacgtgtaatgaaaacagctgtaacacccattaaagctagcacaacgacgatggaatttccctggaacttagagcctccaacttcacagttttacttattccttcactttgcagagcttcaaagtctacaagccaacgagacgagggaattcaatgtggtgttgaacggaaatgttacatttaaatcttatagtcctaagtttttagaaatgcaaacagtatatagcacagcaccaaagcaatgcgatggagggaaatgcttgttgcagttagtgaaaacgtcaaggtccactttgccgcctctaattaatgctatggaggcttacactgtgcttgatttcccacagatagaaacaaatgtagatgaagtgattgctatcaagaatatacaatctacttatggattgagtaaaacaacctggcaaggagatccatgtgtacccaaaaagttcttgtgggatggtttaaactgcaacaactcggatgattctacgccaccaattatcacttccttaaacttgtcttcaagtggattgactggaattatcgtgctgaccattcagaatctcgccaatttacaagaactggacttgtcaaataacaacttgtctggaggtgttcctgaatttctagcggatatgaagtcgctcttggtcataaacttaagtgggaacaatctcagtggtgtagttcctcaaaagcttatagagaagaaaatgttgaaattgaacattgaaggcaatccgaagcttaattgcacagtggagtcatgtgtaaacaaagatgaagagggtggacgacagataaagagcatgacaatcccaattgtggcatcaattggttctgttgttgccttcacagttgcattgatgatattttgtgttgttcgaaagaataacccgtcaaacgatgaagctccaacatcatgtatgctacccgcggatagtagatcatctgaaccgacaatagtgacgaagaataaaaaatttacgtatgcggaggttttaaccatgacaaacaatttccaaaaaatccttggaaaaggaggatttggaattgtatattatggttcagtaaacggtacagagcaggttgctgtgaaaatgctttcccattcatcagctcaaggatataagcaatttaaagctgaggttgaacttcttcttagagtacatcacaagaatttggtaggccttgtcgggtattgcgaagaaggagataaattggctctcatctacgaatacatggccaatggagacttagatgagcatatgtcaggaaaacgaggtggttctatattaaattggggaacaaggctaaagatagctctcgaggctgcacaaggattagagtacttgcataatggatgcaaacccttaatggttcatagagatgttaaaaccacaaatatattgttgaatgaacatttcgataccaaacttgctgattttgggctttcgagatcattcccgatagaaggggaaactcatgtatcaactgttgttgctggaactattggttacctcgatcccgaatattaccgaacaaattggttgacggagaaaagtgatgtgtatagttttggagttgtattattggtgatgattacaaaccaacccgtgatagaccaaaaccgcgaaaagagacatatagcagaatgggtgggaggaatgcttacgaaaggagacatcaaaagtattactgatccaaatctccttggagattataattctggttctgtttggaaagctgttgaactagcaatgtcatgtatgaatccttcttcgatgacaagaccgacaatgtctcaagttgtttttgaactgaaagagtgtttggcctctgaaagctccagggaagtgagcatgaccttcggaactgaagtggcccctatggctcgg

SEQ ID NO: 590 - protein, 744 aa, Arabidopsis thaliana
  AT1G51810.1
MWITVNTDNTIKEILHVSKSNTLQVCLVKTGTSIPYINTLELRPLADDIYTNESGSLNYLFRVYYSNLKGYIEYPDDVHDRIWKQILPYQDWQILTTNLQINVSNDYDLPQRVMKTAVTPIKASTTTMEFPWNLEPPTSQFYLFLHFAELQSLQANETREFNVVLNGNVTFKSYSPKFLEMQTVYSTAPKQCDGGKCLLQLVKTSRSTLPPLINAMEAYTVLDFPQIETNVDEVIAIKNIQSTYGLSKTTWQGDPCVPKKFLWDGLNCNNSDDSTPPIITSLNLSSSGLTGIIVLTIQNLANLQELDLSNNNLSGGVPEFLADMKSLLVINLSGNNLSGVVPQKLIEKKMLKLNIEGNPKLNCTVESCVNKDEEGGRQIKSMTIPIVASIGSVVAFTVALMIFCVVRKNNPSNDEAPTSCMLPADSRSSEPTIVTKNKKFTYAEVLTMTNNFQKILGKGGFGIVYYGSVNGTEQVAVKMLSHSSAQGYKQFKAEVELLLRVHHKNLVGLVGYCEEGDKLALIYEYMANGDLDEHMSGKRGGSILNWGTRLKIALEAAQGLEYLHNGCKPLMVHRDVKTTNILLNEHFDTKLADFGLSRSFPIEGETHVSTVVAGTIGYLDPEYYRTNWLTEKSDVYSFGVVLLVMITNQPVIDQNREKRHIAEWVGGMLTKGDIKSITDPNLLGDYNSGSVWKAVELAMSCMNPSSMTRPTMSQVVFELKECLASESSREVSMTFGTEVAPMAR

SEQ ID NO: 591 - DNA, 2553 bp, Arabidopsis thaliana
  AT2G04300.1
atgaaaacacatcctcaagcaattctcttatgtgtgttattcttcatcacgtttggtcttttacatgtcgttgaagctggaaatcaagaaggattcatcagtttagattgtgggttatcccccaatgaacctccttacgtcgatgctgcaaccgacttaacatacacaacggacaatgatttcgtgcagagcggtaaaactggtacaatcgataaggaattggagtcaacctacaacaaaccaattttacagcttaggtacttccccgaaggagtccgaaactgttataccttgaacgtcacgctcggcacaaactacctgatcagagccagtttcgtgtatggtaactacgatggtcttaataaagaactcgagtttgacctttaccttggtcctaatctatgggcaaacgtgaacacagctgtatatttaatgaacggagtgaccacagaagaaatcatccacagtaccaaatctaaggtactccaggtttgtcttattaagacaggcgagagtatacctattattaatagcttagagctgcgaccacttataaacgatacttacaatactcaaagtggctcgctgaaatacttatttcggaattatttcagcacttcaaggagaataatacggtacccgaatgatgtcaacgatcgtcattggtatccgttctttgatgaggatgcgtggacagaattgactacaaatctcaatgttaacagttcaaatggttatgatccaccaaaatttgtaatggcttcagcctcaacacccataagtaaaaatgcgcccttcaacttcacctggtcattgattccttctacggccaaattttatagttacatgcacttcgccgatattcagactctacaggccaatgaaacccgagaattcgacatgatgttgaatggaaaccttgccttggaacgtgccctcgaggttttcaccgtgatcgatttccccgaattggaaacaaatcaagatgatgttattgctatcaagaatatccaaaatacttatggagtgagtaaaactagctggcaaggagatccatgtgttcctaaacggtttatgtgggatggcttaaactgcaacaactcgtatatttccacaccacctacaataacttttttaaacctatcatcaagtcatttaacggggatcattgcatctgccattcaaaacctaacccacctgcaaaatttggacttgtcaaataacaatttgacaggaggagtacccgagtttcttgctggcttaaaatcactcttagtcataaacttaagtgggaataatcttagtggttctgttcctcaaacccttctccagaagaaaggacttaagttaaatcttgaaggaaatatttatcttaattgtccggatggatcatgtgtaagcaaagacggaaatggaggtgccaagaaaaagaatgttgtagtattggttgtggtatcaattgcacttgtagtagttcttggatctgcattagctctttttttggtgtttagaaaaagaaaaacaccacgcaatgaagtttctagaacatctagatcattagacccgacaataacgacgaaaaacagaagatttacttattcggaagttgtaaagatgacaaataattttgagaaaatccttggtaaaggagggtttggaatggtctatcatggaactgtgaatgatgctgaacaagtagccgttaaaatgttatcaccctcatcatctcaagggtataaagaattcaaagcagaggtagaactccttctcagagttcaccataaaaatttggttggcctcgttggatattgtgatgaaggagaaaatttatctctcatctacgagtacatggctaaaggagatcttaaagaacatatgttaggaaaccaaggtgtatctattttggactggaaaactagactaaagatagtggccgagtccgcgcaagggctggaatacttgcataatggatgcaaaccaccaatggtacatagagatgtcaaaaccacaaatatattgttggatgaacattttcaggccaagcttgctgatttcggtctttcgagatcttttcctcttgaaggagaaacccgtgtggacacagttgttgctggaactcctgggtaccttgatccagaatattatcgaacaaattggttgaacgagaaaagtgatgtttatagctttggaatcgtactattagagatcatcacaaaccaacatgtgatcaaccaaagtcgtgaaaaaccacatatagctgaatgggttggggtgatgcttacaaaaggagacatcaaaagcattatagatccaaaatttagtggagattatgatgctggttctgtctggagagcagttgaactagcaatgtcgtgtgtaaatccttcttcaactggaagaccaaccatgtctcaagttgtaatcgaattaaatgaatgtttggcatcagaaaactcaaggagaggaatgagtcaaaacatggagtcaaagggatctatccaatatacagaagtcagcacgaactttggtactgaatatacccctgaagctcgc

SEQ ID NO: 592 - protein, 851 aa, Arabidopsis thaliana
  AT2G04300.1
MKTHPQAILLCVLFFITFGLLHVVEAGNQEGFISLDCGLSPNEPPYVDAATDLTYTTDNDFVQSGKTGTIDKELESTYNKPILQLRYFPEGVRNCYTLNVTLGTNYLIRASFVYGNYDGLNKELEFDLYLGPNLWANVNTAVYLMNGVTTEEIIHSTKSKVLQVCLIKTGESIPIINSLELRPLINDTYNTQSGSLKYLFRNYFSTSRRIIRYPNDVNDRHWYPFFDEDAWTELTTNLNVNSSNGYDPPKFVMASASTPISKNAPFNFTWSLIPSTAKFYSYMHFADIQTLQANETREFDMMLNGNLALERALEVFTVIDFPELETNQDDVIAIKNIQNTYGVSKTSWQGDPCVPKRFMWDGLNCNNSYISTPPTITFLNLSSSHLTGIIASAIQNLTHLQNLDLSNNNLTGGVPEFLAGLKSLLVINLSGNNLSGSVPQTLLQKKGLKLNLEGNIYLNCPDGSCVSKDGNGGAKKKNVVVLVVVSIALVVVLGSALALFLVFRKRKTPRNEVSRTSRSLDPTITTKNRRFTYSEVVKMTNNFEKILGKGGFGMVYHGTVNDAEQVAVKMLSPSSSQGYKEFKAEVELLLRVHHKNLVGLVGYCDEGENLSLIYEYMAKGDLKEHMLGNQGVSILDWKTRLKIVAESAQGLEYLHNGCKPPMVHRDVKTTNILLDEHFQAKLADFGLSRSFPLEGETRVDTVVAGTPGYLDPEYYRTNWLNEKSDVYSFGIVLLEIITNQHVINQSREKPHIAEWVGVMLTKGDIKSIIDPKFSGDYDAGSVWRAVELAMSCVNPSSTGRPTMSQVVIELNECLASENSRRGMSQNMESKGSIQYTEVSTNFGTEYTPEAR

SEQ ID NO: 593 - DNA, 2697 bp, Arabidopsis thaliana
  AT3G21340.1
atggagtaccatcctcaagcaattaggttatgtgcgttgatcttcatctctttctatgctcttttacacctcgttgaagcacaagaccaaaaaggattcattagtttggattgcgggtcattgccaaatgagcctccttacaacgatccttcaaccggattaacatactcgacggacgatggtttcgtgcagagtggcaaaactggaagaatccagaaagcgttcgagtcgatcttcagtaaaccgtctttgaagcttagatacttcccggacggattccgaaactgctataccttgaatgtcacgcaagacacaaactatctgatcaaagctgtatttgtgtatggtaactacgatggtcttaacaatcccccgagtttcgatctttaccttggtccgaatctatgggtaacggttgatatgaatggacggaccaatggtactatccaggagattatccacaagaccatatctaagtctctccaggtctgtcttgttaagacaggaacaagctcacctatgattaatacgttagagctacgaccacttaaaaacaatacttacaatactcagagtggctctctgaagtatttcttccgatattatttcagcggttcaggccaaaacatacggtaccctgatgatgtcaatgatcgtaaatggtatccattctttgatgcaaaagagtggacagagttaacaaccaatctgaatataaacagttctaatggttatgcaccaccagaagttgtgatggcgtcagcctcaacgcctataagtacttttggaacatggaacttctcatggttattgccatcttccacaacccaattttatgtgtacatgcattttgccgagattcaaactctacggtccctcgatacccgagaattcaaagtgacgttgaatggaaaacttgcttatgaacgctacagccctaaaacgttagccaccgaaaccattttctattcgacaccacaacaatgtgaagatgggacatgcctcttggagttgacgaaaacacctaagtctactcttcctcctctcatgaacgctcttgaggttttcaccgtgatcgattttccacagatggaaacaaatccagatgatgttgctgctatcaagagtatccaaagcacttatggattaagtaaaatcagctggcaaggagatccatgcgttcctaaacagtttttgtgggagggtttaaactgcaataatctagataactccacgccgcctattgtcacttccttaaacttatcgtcaagtcatttaacggggatcatcgcgcaaggcattcagaatctgacacacctacaagaactagacttgtcaaataacaatttgacgggaggaatacccgaatttcttgctgacataaaatcactcttagtaataaatttaagtgggaacaattttaatggctctattcctcaaatccttttacagaagaaaggactaaagctaattcttgaaggaaacgccaatctgatttgtccggatggattatgtgtaaacaaagctggcaatggtggtgccaagaaaatgaatgttgtaataccgattgttgcatcagttgcgtttgtggttgttcttggatctgcattggcgttcttttttattttcaaaaagaaaaagacatcaaacagtcaagatttaggtccatcttcatatactcaagtatcagaagttagaacaatcagatcttcagagtcggcaataatgactaagaacagaagatttacatattcggaggttgtaacaatgacaaataactttgaaagagttcttggtaaaggaggatttggaatggtttatcatggaactgtaaataatactgaacaagtagccgttaaaatgctttcacactcatcttctcaaggatataaagaattcaaagcagaggtggaacttcttctcagagttcaccacaaaaatttggttggcctcgttggatattgtgatgaaggagaaaacttggctcttatctacgagtacatggctaacggagacttgagagaacatatgtcaggaaagcgaggtggatctattctaaattgggaaactagactaaaaatagttgtcgagtctgcccaaggtttggaatacttgcataatggatgcaaaccaccaatggttcatagggatgttaaaaccacaaatatattgttgaatgaacacctccatgctaagctagctgattttgggctttcgagatcttttccaattgaaggagaaactcatgtgtcaacagttgttgctggaactcctggataccttgatccagaatattaccgaacaaattggttgaacgagaaaagtgatgtttatagctttggaattgtactattagagatcatcacaaaccaacttgtgatcaatcaaagtcgtgaaaaaccacatatagcagaatgggtggggttaatgcttacaaaaggagacattcaaaacattatggatccaaaactttatggtgattatgactctggttctgtctggagagcagttgaactagcaatgtcatgtctaaatccttcttcagctagaagaccaacaatgtctcaagttgttatcgaattaaacgaatgtttgtcatatgaaaacgcaagaggaggaacgagtcaaaacatgaactcagagagttcaatagaagtcagcatgaactttgatattggagctacccctgatgctcgt

SEQ ID NO: 594 - protein, 899 aa, Arabidopsis thaliana
  AT3G21340.1
MEYHPQAIRLCALIFISFYALLHLVEAQDQKGFISLDCGSLPNEPPYNDPSTGLTYSTDDGFVQSGKTGRIQKAFESIFSKPSLKLRYFPDGFRNCYTLNVTQDTNYLIKAVFVYGNYDGLNNPPSFDLYLGPNLWVTVDMNGRTNGTIQEIIHKTISKSLQVCLVKTGTSSPMINTLELRPLKNNTYNTQSGSLKYFFRYYFSGSGQNIRYPDDVNDRKWYPFFDAKEWTELTTNLNINSSNGYAPPEVVMASASTPISTFGTWNFSWLLPSSTTQFYVYMHFAEIQTLRSLDTREFKVTLNGKLAYERYSPKTLATETIFYSTPQQCEDGTCLLELTKTPKSTLPPLMNALEVFTVIDFPQMETNPDDVAAIKSIQSTYGLSKISWQGDPCVPKQFLWEGLNCNNLDNSTPPIVTSLNLSSSHLTGIIAQGIQNLTHLQELDLSNNNLTGGIPEFLADIKSLLVINLSGNNFNGSIPQILLQKKGLKLILEGNANLICPDGLCVNKAGNGGAKKMNVVIPIVASVAFVVVLGSALAFFFIFKKKKTSNSQDLGPSSYTQVSEVRTIRSSESAIMTKNRRFTYSEVVTMTNNFERVLGKGGFGMVYHGTVNNTEQVAVKMLSHSSSQGYKEFKAEVELLLRVHHKNLVGLVGYCDEGENLALIYEYMANGDLREHMSGKRGGSILNWETRLKIVVESAQGLEYLHNGCKPPMVHRDVKTTNILLNEHLHAKLADFGLSRSFPIEGETHVSTVVAGTPGYLDPEYYRTNWLNEKSDVYSFGIVLLEIITNQLVINQSREKPHIAEWVGLMLTKGDIQNIMDPKLYGDYDSGSVWRAVELAMSCLNPSSARRPTMSQVVIELNECLSYENARGGTSQNMNSESSIEVSMNFDIGATPDAR

SEQ ID NO: 595 - DNA, 2670 bp, Arabidopsis thaliana
  AT1G51860.1
atgaaatctcttcactggtttttgcatcttttgatcatagcttttaccgttttgagatcagtggaagctcaaaatcaagcaggatttattagtttggattgtgggttggtgcctaaggaaactacttatacagagaagtcgacgaatataacatacaaatcagacgtggattacatcgacagtggattggtcggaaagatcaatgatgcatacaaaactcagtttcagcaacaggtttgggccgtgagaagcttccctgtaggtcaaagaaactgttacaatgtcaacctcacggcaaacaacaaatatttgatcagaggaacctttgtgtatgggaattatgatggcctgaatcagttcccaagttttgatcttcatatcggtcctaacaaatggtcgtctgttaaaatactaggagtaacaaatacttctatgcatgagataatccatgtcgtaccacaagatagtcttgaagtttgtcttgttaagactggaccgacgacaccattcatttcgtcgctggaggttcgtccattgaacaatgaaagttatctcacgcaaagtggatcattgatgttgttcgccagagtatactttccatccagttcatcatctttcattaggtatgatgaggacatacatgaccgtgtttggaattcattcacagatgatgaaaccgtctggataagtacagacctcccgatcgatacaagtaactcctatgacatgcctcaatccgtgatgaagacagctgctgtccctaaaaatgctagtgagccatggctcttatggtggactcttgatgagaacaccgcacaatcatatgtatatatgcatttcgccgaagtccagaatcttacagcaaatgaaaccagagaattcaacattacttacaatggtggtctacgttggttcagctatttgaggcctcctaatctcagcatttcaacgatctttaatccaagggcagtgagttcttcaaatgggatatttaatttcacattcgcaatgacgggtaactcaactctgcctccccttctcaacgccctcgagatttatacagtcgtagacattctacagctagagacaaacaaagatgaagtttctgctatgatgaacatcaaagaaacatatggtttaagcaaaaagataagctggcaaggagatccgtgtgctcctcagctttatcggtgggaaggtttaaattgtagttatccggactccgagggatcaagaatcatatccttgaacttgaatgggagcgagttgacaggttctataacatctgacatatccaagctaacactgttgacagtattagatttatcaaataatgatttatcaggagatattccaacattttttgctgagatgaagtcgttgaaactcataaacttaagtggaaacccgaaccttaatctcacagcaattccagactctcttcagcaaagggtaaacagcaaatctttaacactaattttgggtgaaaacctgactctgactcccaaaaaagagagtaaaaaggttcccatggttgctatcgcagcgtcagtggctggcgtgttcgctctgctcgttatcttagccatattttttgtcattaaaaggaaaaatgtgaaagctcataagtctccaggaccacccccattagtcactcccggtatagttaaaagtgagacaagatcatccaatccatcaatcataacaagggaacgcaagatcacgtatccagaggtactgaagatgactaataacttcgagagagttcttggcaaaggaggctttggaacagtgtatcatggaaacttggatggtgctgaagtggcagtgaaaatgctttctcattcatcagctcaaggttataaagagttcaaagcagaggttgaacttcttttaagagttcaccatagacatttggtgggacttgtgggttactgtgatgatggagacaacttggctctgatttatgaatatatggcaaatggagacctgagggagaatatgtcaggaaaacgtggaggcaatgtccttacctgggaaaacaggatgcaaatagctgtagaggctgcacaagggctggagtatctgcacaatggatgtaggcctcctatggtacatagagatgttaaaactactaacattttattgaatgagcggtgtggagcaaaactagccgactttgggctctcgagatctttcccaatcgatggcgaatgtcatgtttcgacagtggttgcgggtacacctggttacctagacccggagtactacagaacaaactggctaagcgagaagagtgacgtgtacagcttcggtgtagtgctattagagatagtcacaaaccagcctgtgatagataaaacccgggagagacctcacatcaatgactgggttgggttcatgctcactaaaggagacatcaagagcatcgttgacccgaaactgatgggggactatgatacaaacggtgcatggaagattgtggagctagctctggcctgtgtgaacccatcttcgaaccggagaccaacaatggcacacgttgtgatggagctaaacgactgtgtggccttagaaaatgcaaggcggcaaggtagtgaagagatgtactcaatgggttctgttgactatagtctctcttctacttctgactttgctcctggagccaga

SEQ ID NO: 596 - protein, 890 aa, Arabidopsis thaliana
  AT1G51860.1
MKSLHWFLHLLIIAFTVLRSVEAQNQAGFISLDCGLVPKETTYTEKSTNITYKSDVDYIDSGLVGKINDAYKTQFQQQVWAVRSFPVGQRNCYNVNLTANNKYLIRGTFVYGNYDGLNQFPSFDLHIGPNKWSSVKILGVTNTSMHEIIHVVPQDSLEVCLVKTGPTTPFISSLEVRPLNNESYLTQSGSLMLFARVYFPSSSSSFIRYDEDIHDRVWNSFTDDETVWISTDLPIDTSNSYDMPQSVMKTAAVPKNASEPWLLWWTLDENTAQSYVYMHFAEVQNLTANETREFNITYNGGLRWFSYLRPPNLSISTIFNPRAVSSSNGIFNFTFAMTGNSTLPPLLNALEIYTVVDILQLETNKDEVSAMMNIKETYGLSKKISWQGDPCAPQLYRWEGLNCSYPDSEGSRIISLNLNGSELTGSITSDISKLTLLTVLDLSNNDLSGDIPTFFAEMKSLKLINLSGNPNLNLTAIPDSLQQRVNSKSLTLILGENLTLTPKKESKKVPMVAIAASVAGVFALLVILAIFFVIKRKNVKAHKSPGPPPLVTPGIVKSETRSSNPSIITRERKITYPEVLKMTNNFERVLGKGGFGTVYHGNLDGAEVAVKMLSHSSAQGYKEFKAEVELLLRVHHRHLVGLVGYCDDGDNLALIYEYMANGDLRENMSGKRGGNVLTWENRMQIAVEAAQGLEYLHNGCRPPMVHRDVKTTNILLNERCGAKLADFGLSRSFPIDGECHVSTVVAGTPGYLDPEYYRTNWLSEKSDVYSFGVVLLEIVTNQPVIDKTRERPHINDWVGFMLTKGDIKSIVDPKLMGDYDTNGAWKIVELALACVNPSSNRRPTMAHVVMELNDCVALENARRQGSEEMYSMGSVDYSLSSTSDFAPGAR

SEQ ID NO: 597 - DNA, 2511 bp, Arabidopsis thaliana
  AT1G51870.1
atgaagtctcttcatttttgtttgctctttatgatcgtatcttttacagtttcgagacccgtcgaagctcaagatcaagcaggattcatcagcttggattgtgggttggtgcctaaggaaaccacttatgtggaaacgtcgacgaatataacatacaaatcagacgcaaattacaccgacagcggattggtcgggaagatcaatgatgcacacaagacactggttcaacaaccgctttgggccttgagaagcttccctgagggtgaaagaaactgttacaacttcaaccttaccgtgaacagcacatatttgatcagaggaacttttttgtatgggaattatgacggcttgaatcaatccccaagctttgaccttcacattggtgctagcaaatggacctctgttaacatagtaggagtaacagataccgtaatgcccgagataatccatgtcttaacacaaaaacgtcttcaagtctgtcttgttaagacaggaaagacgacaccgttcatttcgtcattggaattgcgtccgttgataaataacatttacatcgcggaaagtggatcaatggtcttgcaaaatagagtatattttccatctgattcaacatctatcgtcaggtacgatgaggacatacacgaccgagtatggaatccagtttcagatgatgattcctcatcgataagcacggacctccaggtccaaacaaataacttatatgacgtgcctcaattcgtaatgaagactgctgctatccctaaagatgctagtgcgccatggagcttagtgtggactatagataacaccactgctctgtcatatgtatatatgcatttcgcagaaattcaggatttaaaagccaatgaccttagagaattcgacattacttacaatggtggcaagctttggttttcccagtttaggcctaacaaactcagcattctaacgatgttcagtcaagtccccttgacttcatcaaatggcgagtataatttcactttcgaaatgactagtaactcaactcttccaccccttatcaacgccctcgagatatatacaggtctagaaattctacagcttcagacagacaaggatgaagtttctgctatgatgaacatcaaaacgacttatgatttgagcaaaaagataagctggcagggagatccatgtgctcctcagctgtatcggtgggaaggtctagattgtagttatccggacaccgaggcatcacggattatatccttgaacttgaatgcgagcgggttgaacggtaccataacatctgacataaccaagctaacacagttgagcgagcttttgggtgaaaaggttaaaatgaatcccacagccaaaaaagagagtaaaaaggttcccatagttcctatcgcagcatcagtggctggcgtgtttgctctgatagttatattggccatctttttcattgttaaaggaaaaaaagggaaaagtgctgaaggaccacccttatcagtcactagtggtacagctaaaagtgagacaagatcatccaatccatcaatcatgagaaaagatcgcaagatcacatatcctcaggtattgaagatgactaataacttcgagagagttcttggtaaaggagggtttggaacagtatatcatggaaacatggaagatgctcaagtagctgtgaaaatgctctcgcactcatcggctcaaggttataaagagttcaaagcagaggttgaacttcttttaagagttcaccacagacatttggtgggacttgtgggttactgtgatgatggagataacttggctctgatttatgaatatatggcaaatggagacctgagggagaatatgttaggaaaacgtggaggcaatgtccttacctgggaaaacaggatgcaaatagctgtagaggctgcacaaggactggagtatctgcacaatggatgtacgcctccaatggtccatagagatgttaaaactactaacatcttattgaatgcacagtgtggagcgaaactagccgactttgggctctctagatcttttccaatcgatggtgaatgtcatgtctcaacagtcgttgcgggtacacctgggtacctagaccctgagtattacagaacaaactggctaagcgagaagagtgacgtgtacagcttcggtgtagtgctattagagatagtcacaaaccagcctgttataaatcaaacaagagagagacctcacatcaatgaatgggttggcttcatgctcagtaaaggagacatcaagagcatcgtcgacccaaaactgatgggggactatgacacaaacggtgcatggaagattgtggagctgggtcttgcctgtgtgaacccgtcttcgaacctaagaccaacaatggcacacgttgtgattgagctaaacgagtgtgtggcctttgaaaatgcaaggcgacaaggtagtgaagagatgtacacaagaagttctactaactttagtcacacgtctgcttccgaattttcccccggggcaaga

SEQ ID NO: 598 - protein, 837 aa, Arabidopsis thaliana
  AT1G51870.1
MKSLHFCLLFMIVSFTVSRPVEAQDQAGFISLDCGLVPKETTYVETSTNITYKSDANYTDSGLVGKINDAHKTLVQQPLWALRSFPEGERNCYNFNLTVNSTYLIRGTFLYGNYDGLNQSPSFDLHIGASKWTSVNIVGVTDTVMPEIIHVLTQKRLQVCLVKTGKTTPFISSLELRPLINNIYIAESGSMVLQNRVYFPSDSTSIVRYDEDIHDRVWNPVSDDDSSSISTDLQVQTNNLYDVPQFVMKTAAIPKDASAPWSLVWTIDNTTALSYVYMHFAEIQDLKANDLREFDITYNGGKLWFSQFRPNKLSILTMFSQVPLTSSNGEYNFTFEMTSNSTLPPLINALEIYTGLEILQLQTDKDEVSAMMNIKTTYDLSKKISWQGDPCAPQLYRWEGLDCSYPDTEASRIISLNLNASGLNGTITSDITKLTQLSELLGEKVKMNPTAKKESKKVPIVPIAASVAGVFALIVILAIFFIVKGKKGKSAEGPPLSVTSGTAKSETRSSNPSIMRKDRKITYPQVLKMTNNFERVLGKGGFGTVYHGNMEDAQVAVKMLSHSSAQGYKEFKAEVELLLRVHHRHLVGLVGYCDDGDNLALIYEYMANGDLRENMLGKRGGNVLTWENRMQIAVEAAQGLEYLHNGCTPPMVHRDVKTTNILLNAQCGAKLADFGLSRSFPIDGECHVSTVVAGTPGYLDPEYYRTNWLSEKSDVYSFGVVLLEIVTNQPVINQTRERPHINEWVGFMLSKGDIKSIVDPKLMGDYDTNGAWKIVELGLACVNPSSNLRPTMAHVVIELNECVAFENARRQGSEEMYTRSSTNFSHTSASEFSPGAR

SEQ ID NO: 599 - DNA, 2640 bp, Arabidopsis thaliana
  AT1G51880.1
atgaagtctattcatgggtttttgctcttcttgatcacagcttatgtcattttggaatcagttcaagctcaagatcaattaggattcatcagtttggattgtgggttagtccctaagaacgcaacttatacggagaagacgacaaatataacatacaaatcagatgcaaattacatcgatagtggattggtcgggaggatcagtgctgagtacaaagcgcagcttcagcaacaaacttggaccgtaagaagcttccctgagggtgaaagaaactgttacaacttcaaccttaccgctaaaagcagatatctcatcagagcaacctttacgtatgggaattacgatggtttgagacaagtccccaagtttgatattcacattggtcctagcaaatggacttctgttaagttggatggagtaggaaatggtgcagtcctcgagatgattcatgtcttaacacaagaccgtcttcaaatttgtcttgttaagacaggaaaagggataccatttatttcgtcgctggaacttcgtccgttgaacaataatacttacctcacgcaaagtggatcgttgattgggttcgcaagagttttcttttcagccactccaacattcataaggtatgatgaggatatccatgatcgagtctgggttcgacagtttggtaatggattgaaatcgataagcacagaccttttggtcgatacaagtaacccctatgatgtgccacaagctgtggcaaagactgcatgtgtaccttcaaatgctagtcagcctctgatctttgattggactcttgacaacatcacttcacaatcatatgtatacatgcatttcgctgaaatccagactcttaaggataatgacatcagagaattcaacattacttataatggtggtcagaatgtgtactcctatttgaggcctgaaaaattcgagatatcaactctattcgattcaaagcctttgagttctccggatggcagtttcagtttgtctttcacgaagaccggtaactcaactcttcctcctcttatcaacggcctcgagatttataaagtcttagaccttctagaactcgagacagatcaagatgaagtttctgctatgataaacatcaaggcaacgtatgatttgagcaaaaaggttagctggcaaggagatccatgtgctcctaagtcttatcagtgggaaggtttaaactgcagttatccaaactctgatcaacctcggatcatatccttgaacttggcagagaacaagttgaccggtaccataacacctgaaatatccaagctaacacagttgatagagctagatttgtcaaaaaacgatttatcaggagagataccggagttttttgcagatatgaagttattaaaacttataaagcttaatgttttcatttgcagaaacttaagtggaaatctaggtctcaacagcacaattccagactctattcaacaaagattagatagcaaatctctaatactaattttgagtaagactgttactaaaactgtcaccctgaaaggcaaaagtaaaaaggttccaatgattcctatcgtagcgtcagtggctggtgtgttcgctctgctagttatcttggccatctttttcgtcgttagaaggaaaaacggggaaagtaataagggtacgaatccatcaatcataacaaaggaacgcaggatcacgtatcccgaggtactaaagatgactaataactttgagagagttcttggtaaaggaggatttggaacagtgtaccatggaaacttggaggatactcaagtagctgtgaaaatgctctctcattcgtcagctcaagggtataaagagttcaaagcagaggttgaacttcttttaagagttcaccatagaaatttggtgggacttgtgggttactgtgatgatggagataacttggctttgatttatgaatacatggctaatggagatctcaaggagaatatgtcaggaaaacgtggaggcaatgtccttacctgggaaaacaggatgcaaatagctgtagaggctgcacaaggattggagtatcttcacaatggatgtacgcctcctatggtccatagagatgttaaaactaccaacatcttattgaatgagcggtatggagcaaaactagccgactttgggctctcaagatctttcccagttgatggcgaaagtcatgtctcgacagtggttgcgggcacacctggttaccttgaccctgagtactacagaacaaactggctaagcgagaagagtgatgtgtacagcttcggtgtagtcctattagagatagtcacaaaccagcctgtgacagataaaacaagagagagaactcacatcaatgaatgggttgggtccatgctcactaaaggggacatcaagagcatccttgacccaaaactgatgggggactatgacacaaacggtgcctggaagattgttgagctggctcttgcatgtgtgaacccgtcttcaaaccggagaccaacaatggcacacgtcgtgactgagctaaacgaatgtgtggccttagaaaatgcaaggcgacaaggtcgtgaagagatgcacacaagtggttatgttgactttagtcgctcttctgcttccgaattttcccctggagccaga

SEQ ID NO: 600 - protein, 880 aa, Arabidopsis thaliana
  AT1G51880.1
MKSIHGFLLFLITAYVILESVQAQDQLGFISLDCGLVPKNATYTEKTTNITYKSDANYIDSGLVGRISAEYKAQLQQQTWTVRSFPEGERNCYNFNLTAKSRYLIRATFTYGNYDGLRQVPKFDIHIGPSKWTSVKLDGVGNGAVLEMIHVLTQDRLQICLVKTGKGIPFISSLELRPLNNNTYLTQSGSLIGFARVFFSATPTFIRYDEDIHDRVWVRQFGNGLKSISTDLLVDTSNPYDVPQAVAKTACVPSNASQPLIFDWTLDNITSQSYVYMHFAEIQTLKDNDIREFNITYNGGQNVYSYLRPEKFEISTLFDSKPLSSPDGSFSLSFTKTGNSTLPPLINGLEIYKVLDLLELETDQDEVSAMINIKATYDLSKKVSWQGDPCAPKSYQWEGLNCSYPNSDQPRIISLNLAENKLTGTITPEISKLTQLIELDLSKNDLSGEIPEFFADMKLLKLIKLNVFICRNLSGNLGLNSTIPDSIQQRLDSKSLILILSKTVTKTVTLKGKSKKVPMIPIVASVAGVFALLVILAIFFVVRRKNGESNKGTNPSIITKERRITYPEVLKMTNNFERVLGKGGFGTVYHGNLEDTQVAVKMLSHSSAQGYKEFKAEVELLLRVHHRNLVGLVGYCDDGDNLALIYEYMANGDLKENMSGKRGGNVLTWENRMQIAVEAAQGLEYLHNGCTPPMVHRDVKTTNILLNERYGAKLADFGLSRSFPVDGESHVSTVVAGTPGYLDPEYYRTNWLSEKSDVYSFGVVLLEIVTNQPVTDKTRERTHINEWVGSMLTKGDIKSILDPKLMGDYDTNGAWKIVELALACVNPSSNRRPTMAHVVTELNECVALENARRQGREEMHTSGYVDFSRSSASEFSPGAR

SEQ ID NO: 601 - DNA, 2628 bp, Arabidopsis thaliana
  AT1G51890.1
atgaggtttttgtctttcttgatcttcgttttcgcagttcttggattggttcaagctcaagaccaatcaggattcataagcttagattgtggtttggtgcctacggaaattacttatgtggaaaagtcgacgaatataacatacagatcagacgcaacttacatcgacagtggagttcccgggaagatcaatgaagtgtacagaacacagtttcagcaacaaatttgggccttgagaagcttccctgagggtcaaagaaattgttacaacttcagtctcaccgcaaaacgtaagtatctaatcagaggaacctttatctatgggaattatgacggtttgaatcaactcccgagctttgatctttacatcggtccaaacaaatggacctctgtttcgatccccggagtgagaaatggttcagtctccgagatgatccatgtcttaagacaagaccatcttcaaatttgtcttgtgaaaacaggagaaactacaccgtttatttcttcattggaacttcgtcctttgaacaataatacatacgtcacaaaaagtggatcgcttattgtggtcgcaagactttacttttcacccactccaccatttctcaggtatgatgaggacgtccatgaccgaatttggattccattcttagataacaaaaattccttgttaagcacggaactctctgttgatacaagtaacttctacaatgtgcctcaaactgtagcgaaaactgctgctgtccctttaaatgctactcagcctctgaaaataaattggagtctcgacgacatcacttcacagtcatatatatacatgcatttcgctgaaatcgagaatcttgaagctaatgagaccagagaattcaatattacttacaatggtggcgaaaattggttctcctattttagacctccaaagtttcgtataacaactgtatacaatccagcagctgtgagttctctagatgggaatttcaacttcactttctcgatgaccggtaactctactcatcctcctcttatcaacggccttgagatttatcaagttctagagcttccacagcttgatacataccaagatgaagtttccgctatgatgaatatcaagacaatatatggattgagcaaaaggtctagctggcaaggagatccatgtgctcctgagttatatagatgggaaggtttaaactgtagttatccaaactttgcgccaccgcagatcatatccttgaacttgagtggaagcaatttgagtggtaccataacatctgatatatccaagctaacacatttgagagaactagatttatcaaacaatgacttatcaggagatattccatttgttttttctgatatgaagaatttgacactcataaacttgagtggaaacaagaatctaaatcgctcagttccagagactcttcagaagaggatagataacaaatctttaacactaattagagatgaaaccggaaaaaatagtacaaatgtagttgctatcgcagcatcagtggctagcgtgtttgctgtgctagttatcttggctatcgtttttgtcgtcataaggaaaaaacagagaactaatgaagcttcaggaccccgatcattcactactggcacggttaagagtgatgcaagatcatcgagttcatcaatcataacaaaggaacgcaagttcacttattcggaggtactaaagatgactaaaaactttgagagagttcttggtaaaggagggtttggaacagtgtatcatggtaacttggatgatactcaagtagctgtgaaaatgctttctcattcatcagctcaaggttataaagagttcaaagcagaggttgaacttcttttaagagttcatcacagacatttggtgggacttgttggttactgtgatgatggagacaacttagctctgatctatgaatatatggaaaaaggagacctgagggaaaatatgtcaggaaaacacagtgtcaatgtcctaagctgggaaacaagaatgcaaatagctgtagaggcagcacaaggattggagtatttgcataacggatgtaggcctcctatggtacatagagatgtgaaaccaaccaacattttattaaatgagcggtctcaagcaaaactagccgactttgggctatcgagatcttttcctgttgatggtgaatctcatgtcatgacagtcgttgcaggaacacctggttacttagatcctgagtattacagaacaaactggctaagcgagaagagtgatgtgtacagctttggtgtagtgcttttagagatagtcacaaaccagcctgtgatgaataaaaaccgagagagacctcatatcaatgaatgggttatgttcatgcttaccaatggggatatcaagagtattgtcgacccgaaactgaatgaagactatgacacaaacggtgtgtggaaggttgtagagttggctttagcttgtgtaaacccgtcttcaagccgtagaccgacaatgccacacgtggtgatggagctaaacgaatgtcttgctttggaaatagaaaggaaacaaggtagtcaagcgacgtacataaaggaatctgttgagtttagtccatcttctgcttctgatttttcccctttagctagg

SEQ ID NO: 602 - protein, 876 aa, Arabidopsis thaliana
  AT1G51890.1
MRFLSFLIFVFAVLGLVQAQDQSGFISLDCGLVPTEITYVEKSTNITYRSDATYIDSGVPGKINEVYRTQFQQQIWALRSFPEGQRNCYNFSLTAKRKYLIRGTFIYGNYDGLNQLPSFDLYIGPNKWTSVSIPGVRNGSVSEMIHVLRQDHLQICLVKTGETTPFISSLELRPLNNNTYVTKSGSLIVVARLYFSPTPPFLRYDEDVHDRIWIPFLDNKNSLLSTELSVDTSNFYNVPQTVAKTAAVPLNATQPLKINWSLDDITSQSYIYMHFAEIENLEANETREFNITYNGGENWFSYFRPPKFRITTVYNPAAVSSLDGNFNFTFSMTGNSTHPPLINGLEIYQVLELPQLDTYQDEVSAMMNIKTIYGLSKRSSWQGDPCAPELYRWEGLNCSYPNFAPPQIISLNLSGSNLSGTITSDISKLTHLRELDLSNNDLSGDIPFVFSDMKNLTLINLSGNKNLNRSVPETLQKRIDNKSLTLIRDETGKNSTNVVAIAASVASVFAVLVILAIVFVVIRKKQRTNEASGPRSFTTGTVKSDARSSSSSIITKERKFTYSEVLKMTKNFERVLGKGGFGTVYHGNLDDTQVAVKMLSHSSAQGYKEFKAEVELLLRVHHRHLVGLVGYCDDGDNLALIYEYMEKGDLRENMSGKHSVNVLSWETRMQIAVEAAQGLEYLHNGCRPPMVHRDVKPTNILLNERSQAKLADFGLSRSFPVDGESHVMTVVAGTPGYLDPEYYRTNWLSEKSDVYSFGVVLLEIVTNQPVMNKNRERPHINEWVMFMLTNGDIKSIVDPKLNEDYDTNGVWKVVELALACVNPSSSRRPTMPHVVMELNECLALEIERKQGSQATYIKESVEFSPSSASDFSPLAR

SEQ ID NO: 603 - DNA, 2628 bp, Arabidopsis thaliana
  AT1G51910.1
atgaagactatgaatgggtttttgcttctctcgactatagcttttgccgtttttcacttagtccaagctcaatctcaatcaggttttatcagcttggattgtggactaattcctaaggacacaacctataccgagcagataacgaacataacatacatatcagacgcggattacatcgatagtggattaaccgaaaggatcagtgattcatacaagtcacagcttcagcaacagacttggaccttaagaagcttccctgaaggtcaaagaaattgttacaacttcaatctcaaagcgaatctcaaatatctgattagaggaacgtttgtgtatgggaattatgatggtttgaatcaaatgcctaagtttgatcttcatattggtcctaataaatggacttctgttatattggaaggagtagcaaatgctaccatcttcgagataattcatgtcttaacacaagaccgtctccaagtttgtcttgtcaaaacaggacaaacgacaccgtttatatcgtcgttggaacttcgtccgttgaacaatgatacttacgtcactcaaggtgggtcgttgatgtcctttgccagaatctactttccaaagactgcatacttcctcaggtattctgatgacttgtatgaccgagtttgggttccattcagccagaatgaaacagtgtcgttaagtaccaatctaccggttgatacaagtagcaattcctacaatgtgcctcaaaatgtggcgaattccgcaattattccggcggaagctactcatcctctcaacatatggtgggatctccaaaacatcaatgcaccgtcatatgtatacatgcattttgcagaaatccaaaatcttaaagctaatgacatcagagaattcaacattacatacaatggtggtcaggtttgggaaagttccattagacctcacaatctcagcatcactacaatctctagtccaacagctttaaattcttcagatgggtttttcaatttcacttttacaatgaccacaacctctactcttcctccacttatcaatgccctcgaggtttatacacttgtagaaaatttactgctcgagacatatcaagatgaagtttctgctatgatgaacatcaagaaaacatatggattgagtaaaaagataagttggcaaggagatccatgttctcctcaaatatatagatgggaaggtctgaattgcctttatttggactctgatcaacctctgatcacatcattgaacttgagaacgagtggattgaccggtatcataacacatgatatatctaatctaatacaattgagggaactagatttatcagataatgatttatccggagagattccagattttcttgctgatatgaagatgttgacactagtaaacttaaaaggaaacccgaagctcaacctcacagttccagattctattaagcataggataaacaacaaatctttaaaactaattatagatgaaaaccagagtagtgaaaaacacggtataaagtttcctttggttgctatcttagcatcagtggctggtgtgatcgcattactagctatctttaccatatgtgtcatttttaaaagagaaaaacagggaagtggtgaagctccaactagggttaatactgagatcagatcatcctatcaatcaatcgaaacaaaggatcgaaaatttacgtattccgagatactaaagatgacgaataactttgagagagttcttggtaaaggaggatatggaagagtgtattatggaaaattggatgatactgaagtagctgtgaaaatgctctttcattcctcagctgaacaagattataaacatttcaaagcagaggttgaactacttttaagagtccaccatagacatttggtgggacttgttggttactgtgatgatggagataactttgccttgatttatgaatacatggcaaatggagacttgaaggagaatatgtctggaaaccgcagtggacatgttctaagttgggaaaacagaatgcaaatagctatggaggcagcacaaggattggagtatctacataatggaagtagaccacctatggtccatagagatgtgaaaactactaacattttattgaatgagctgtatcaagcgaaactagctgattttgggctctctagatcttccccggtggatggtgaatcttatgtatcaacaatcgttgccggaacacctggttacttagaccctgaaacaaacttgttaagcgagaagactgatgtgtacagctttggggtagttttattagaaatcatcacaaaccagcctgtgattgatacaacccgcgagaaagcgcatattacagattgggttggatttaagctcatggaaggagacattaggaatattattgacccgaaactgattaaggaatttgatacaaacggtgtgtggaaggctgtggagttggctttgtcttgtgtaaaccctacgtcaaaccatagaccgacgatgccacatgttgtgatggagctaaaagagtgtctggactctgagattgccaggaaacaaggtagtcaagacatgttttctagagattctattgaattaaccttctctcctactggattctcacctggaccgagg

SEQ ID NO: 604 - protein, 876 aa, Arabidopsis thaliana
  AT1G51910.1
MKTMNGFLLLSTIAFAVFHLVQAQSQSGFISLDCGLIPKDTTYTEQITNITYISDADYIDSGLTERISDSYKSQLQQQTWTLRSFPEGQRNCYNFNLKANLKYLIRGTFVYGNYDGLNQMPKFDLHIGPNKWTSVILEGVANATIFEIIHVLTQDRLQVCLVKTGQTTPFISSLELRPLNNDTYVTQGGSLMSFARIYFPKTAYFLRYSDDLYDRVWVPFSQNETVSLSTNLPVDTSSNSYNVPQNVANSAIIPAEATHPLNIWWDLQNINAPSYVYMHFAEIQNLKANDIREFNITYNGGQVWESSIRPHNLSITTISSPTALNSSDGFFNFTFTMTTTSTLPPLINALEVYTLVENLLLETYQDEVSAMMNIKKTYGLSKKISWQGDPCSPQIYRWEGLNCLYLDSDQPLITSLNLRTSGLTGIITHDISNLIQLRELDLSDNDLSGEIPDFLADMKMLTLVNLKGNPKLNLTVPDSIKHRINNKSLKLIIDENQSSEKHGIKFPLVAILASVAGVIALLAIFTICVIFKREKQGSGEAPTRVNTEIRSSYQSIETKDRKFTYSEILKMTNNFERVLGKGGYGRVYYGKLDDTEVAVKMLFHSSAEQDYKHFKAEVELLLRVHHRHLVGLVGYCDDGDNFALIYEYMANGDLKENMSGNRSGHVLSWENRMQIAMEAAQGLEYLHNGSRPPMVHRDVKTTNILLNELYQAKLADFGLSRSSPVDGESYVSTIVAGTPGYLDPETNLLSEKTDVYSFGVVLLEIITNQPVIDTTREKAHITDWVGFKLMEGDIRNIIDPKLIKEFDTNGVWKAVELALSCVNPTSNHRPTMPHVVMELKECLDSEIARKQGSQDMFSRDSIELTFSPTGFSPGPR

SEQ ID NO: 605 - DNA, 2556 bp, Arabidopsis thaliana
  AT1G05700.1
atggaagagtttcgttttctctatttgatatattcagcagcatttgcattgtgtctcgtcgtttctgttcttgctcaagaccaatcaggtttcataagcatcgattgtggaattccaagtggatcatcgtacaaagacgacacaacaggtataaactacgtctcagattcatcctttgtcgaaaccggagtctccaaatcgatccctttcacagctcaaagacagcttcaaaacctgaggagctttcccgaaggttcaagaaactgctatacattgattccaatacaagggaagggcaagaaatatctcataagagctagtttcatgtacggtaactacgatggagaaaatggttcaccggagtttgatctgtttcttggtggcaatatttgggataccgtcttgctcagcaatgggtcgagcattgtttccaaagaagtcgtttacttgagccaatctgagaacatatttgtgtgtttgggaaacaaaggcaaaggaactccatttatctcgactttagagcttaggtttctcgggaacgacaatacgacatatgattctccaaacggtgctctcttcttctctagacgctgggacttacgctctctcatgggttcacctgttagatatgatgatgatgtgtacgacagaatctggatacctcgcaactttggctattgtagagagatcaatacctcactccccgtgacctcagacaataatagttatagtctttcaagtttggtgatgagcacagcgatgactccaataaacacaacaagacccatcacaatgactttggaaaacagtgatccaaatgtcaggtactttgtctacatgcacttcgcagaggttgaagatcttagtctcaaaccgaaccagacaagagagttcgacatcagcattaacggagtgacagttgctgctggattcagccccaagtatcttcagacaaacacgttttttctaaaccctgagagccaatcgaaaattgcgttttcactcgttcgaaccccaaagtccactcttccgccaattgttaacgctctagagatctacgtcgcaaatagtttctcgcagtctctcactaaccaagaggatggtgacgcggttacgagtctaaagacgagttataaagtgaagaagaactggcacggagatccttgtttgcctaatgactacatttgggagggccttaattgcagttatgatagtcttactcctccaagaatcacatcactgaacttatcatcaagcgggttaacgggtcatatatcttcctccttctctaacctcacaatgattcaagagctagacttatcaaacaatggcttaaccggagacattccggagttcctctcaaaactgaagttcttgagggttttaaatctagaaaataacactcttaccggttcagttccatccgagttattagaaagatcaaacaccggatcattctcgctaaggctaggagaaaatccaggactctgtactgagatttcttgcagaaaaagcaacagcaaaaaactcgttatcccgcttgtcgcatcatttgcagcattgttcatcctcttgttattgtctggtgtgttttggagaatcagaaaccggagaaacaagtccgtaaactccgcacctcaaaccagtccaatggcgaaatcggagaacaaattactgtttacctttgcagacgttataaagatgacaaataacttcggtcaagtcctcggcaaaggagggtttggaacagtctaccatggcttctatgacaaccttcaagtagctgttaaacttttatcagaaacatcagctcaaggattcaaagagtttcgctctgaggtcgaagttcttgtgagggttcatcatgttaacctcactgcgctgatcggttatttccatgaaggtgaccaaatgggattgatctatgagttcatggctaacggcaacatggcggatcatctcgcgggaaagtatcagcacacattgagctggagacaaaggcttcagattgcacttgatgcagcacaagggcttgagtatcttcactgtggatgcaaacctccaatagtccacagagatgtgaagacttcaaacatattgttgaacgagaaaaacagagcaaagcttgcagatttcggactctcacggagttttcatacagagagtcgttctcacgtatccaccctagtcgctggaactcccggatatctcgatccgctatgctttgagacaaatgggctaaacgagaagagtgacatttacagctttggagttgttctgttggagatgattacaggcaaaaccgtgatcaaagagtcacaaacgaaacgtgttcatgtgagtgattgggtgatatcgatcttgaggtctacgaatgatgtgaacaatgttatagattcaaagatggcgaaagattttgatgtaaactctgtatggaaagttgtggagcttgcattatcctctgtttcgcagaacgtctctgataggccaaacatgccacatattgttagaggattgaatgagtgtcttcaaagagaagagagtaacaagaactat

SEQ ID NO: 606 - protein, 852 aa, Arabidopsis thaliana
  AT1G05700.1
MEEFRFLYLIYSAAFALCLVVSVLAQDQSGFISIDCGIPSGSSYKDDTTGINYVSDSSFVETGVSKSIPFTAQRQLQNLRSFPEGSRNCYTLIPIQGKGKKYLIRASFMYGNYDGENGSPEFDLFLGGNIWDTVLLSNGSSIVSKEVVYLSQSENIFVCLGNKGKGTPFISTLELRFLGNDNTTYDSPNGALFFSRRWDLRSLMGSPVRYDDDVYDRIWIPRNFGYCREINTSLPVTSDNNSYSLSSLVMSTAMTPINTTRPITMTLENSDPNVRYFVYMHFAEVEDLSLKPNQTREFDISINGVTVAAGFSPKYLQTNTFFLNPESQSKIAFSLVRTPKSTLPPIVNALEIYVANSFSQSLTNQEDGDAVTSLKTSYKVKKNWHGDPCLPNDYIWEGLNCSYDSLTPPRITSLNLSSSGLTGHISSSFSNLTMIQELDLSNNGLTGDIPEFLSKLKFLRVLNLENNTLTGSVPSELLERSNTGSFSLRLGENPGLCTEISCRKSNSKKLVIPLVASFAALFILLLLSGVFWRIRNRRNKSVNSAPQTSPMAKSENKLLFTFADVIKMTNNFGQVLGKGGFGTVYHGFYDNLQVAVKLLSETSAQGFKEFRSEVEVLVRVHHVNLTALIGYFHEGDQMGLIYEFMANGNMADHLAGKYQHTLSWRQRLQIALDAAQGLEYLHCGCKPPIVHRDVKTSNILLNEKNRAKLADFGLSRSFHTESRSHVSTLVAGTPGYLDPLCFETNGLNEKSDIYSFGVVLLEMITGKTVIKESQTKRVHVSDWVISILRSTNDVNNVIDSKMAKDFDVNSVWKVVELALSSVSQNVSDRPNMPHIVRGLNECLQREESNKNY

SEQ ID NO: 607 - DNA, 2628 bp, Arabidopsis thaliana
  AT2G19190.1
atggcgatgttaaaatctctttcatcgattttattcacaagctttgctcttctgttctttcttgttcatgctcaagatcaatctggtttcataagtatagattgcgggataccggatgattctagctacaacgatgagactacaggtataaagtatgtttcggattcggcgtttgttgattcaggaacaacaaagagaattgcagctcagtttcaatcaagtggttttgatagacacttgttgaacgtgagaagtttccctcaaagcaagagaagctgttacgatgttccgacgccgagaggcaaaggttttaagtatctaatcagaactcgtttcatgtacgggaactatgatgatcttggaagagtacccgagttcgatctctatctaggagtaaacttttgggactctgttaaactcgacgatgcaacaactatactcaacaaagagataatcaccattccacttttagacaatgttcaagtgtgtgttgttgataagaacgcaggaactccatttttgtctgtcttggagatacggctcttgttgaacactacttatgagactccttacgatgcacttaccctccttcggagattagattacagcaaaacgggaaaacttccatcgaggtacaaagatgacatatatgaccgtatatggacaccgcgtatagtgagttcagaatacaagatattaaatacatctctcactgtcgatcaatttcttaacaatggctaccaaccggcttctactgtcatgagcactgcagaaacagcgcgaaacgagagcctctacctaacgcttagtttcagaccgcccgaccctaacgcaaagttttatgtatacatgcactttgctgaaattgaagtactgaaaagcaaccagacgagagaattcagcatctggctaaatgaggatgtaatctctccttcgtttaagcttcggtacttgcttaccgacacattcgttacaccggatcccgtgagcggaattaccattaacttctctcttcttcaaccacctggtgaatttgtacttccaccgatcattaacgcccttgaggtctatcaagtcaatgagttccttcagatcccaactcatccacaggatgttgatgccatgaggaagattaaagccacgtatagagtgaagaagaactggcaaggagatccttgtgttcccgtagattattcttgggaaggtattgactgtatccaaagtgataacactactaatcctagagtcgtttcactaaatatatcttttagtgaattaagaggccagatagatccagccttctccaaccttacatctataagaaaattagatttatccggtaatactttaacaggagaaatacctgctttcctcgctaacttaccaaacttgaccgaattaaacgttgaaggaaacaagttaacgggcatagttccacaaagattgcatgaaagatcaaagaatggatctctttccttaagatttggtagaaatccggacctttgtctctctgattcctgttcaaacacaaagaagaagaacaagaatggatacatcattccattagtagtcgtaggaatcatcgtcgttcttttgacggctttagctttgttccggcgtttcaagaaaaaacaacaaagaggtacacttggtgagaggaatgggccgttgaaaactgcaaagcgatactttaagtactcagaagttgtgaatatcacaaataactttgagagagttattggcaaaggaggttttggtaaagtataccatggtgtcataaatggagaacaagttgctgtcaaggtactctctgaagaatcagctcaaggctacaaagagtttcgagcagaggttgaccttctcatgagagttcatcacacgaacctgacttctcttgttggatattgcaacgaaataaaccacatggtgcttatctatgagtatatggctaatgagaacttaggagactatttggcaggtaaaaggtcatttatcttgagctgggaagagaggttgaagatatcattagatgcagcgcaaggactagagtatcttcacaatggttgtaagcctcctatagttcacagagatgtgaagccaacaaacatcttactaaacgagaagctccaagcgaagatggcggacttcgggttatctagaagcttctctgttgaaggaagcggtcagatttcaacagttgtcgctggatccatcggttaccttgaccccgagtactattcgactcgccaaatgaacgaaaagagtgatgtttatagtcttggggttgttcttcttgaagtgattacaggccaacctgctattgcaagctcaaaaacagagaaggtgcatataagtgatcatgtcaggtcaatattagccaacggagacattagaggaatcgtggatcagcgtctaagagagagatatgacgttggctcggcttggaaaatgtcagagatcgctcttgcttgtaccgagcacacttctgcgcagaggccaacgatgagtcaggtcgttatggagctgaaacagattgtttatggcatagtgactgatcaggaaaactacgatgactcgacgaaaatgcttacagtgaatctagacaccgagatggttcctcgagcaagg

SEQ ID NO: 608 - protein, 876 aa, Arabidopsis thaliana
  AT2G19190.1
MAMLKSLSSILFTSFALLFFLVHAQDQSGFISIDCGIPDDSSYNDETTGIKYVSDSAFVDSGTTKRIAAQFQSSGFDRHLLNVRSFPQSKRSCYDVPTPRGKGFKYLIRTRFMYGNYDDLGRVPEFDLYLGVNFWDSVKLDDATTILNKEIITIPLLDNVQVCVVDKNAGTPFLSVLEIRLLLNTTYETPYDALTLLRRLDYSKTGKLPSRYKDDIYDRIWTPRIVSSEYKILNTSLTVDQFLNNGYQPASTVMSTAETARNESLYLTLSFRPPDPNAKFYVYMHFAEIEVLKSNQTREFSIWLNEDVISPSFKLRYLLTDTFVTPDPVSGITINFSLLQPPGEFVLPPIINALEVYQVNEFLQIPTHPQDVDAMRKIKATYRVKKNWQGDPCVPVDYSWEGIDCIQSDNTTNPRVVSLNISFSELRGQIDPAFSNLTSIRKLDLSGNTLTGEIPAFLANLPNLTELNVEGNKLTGIVPQRLHERSKNGSLSLRFGRNPDLCLSDSCSNTKKKNKNGYIIPLVVVGIIVVLLTALALFRRFKKKQQRGTLGERNGPLKTAKRYFKYSEVVNITNNFERVIGKGGFGKVYHGVINGEQVAVKVLSEESAQGYKEFRAEVDLLMRVHHTNLTSLVGYCNEINHMVLIYEYMANENLGDYLAGKRSFILSWEERLKISLDAAQGLEYLHNGCKPPIVHRDVKPTNILLNEKLQAKMADFGLSRSFSVEGSGQISTVVAGSIGYLDPEYYSTRQMNEKSDVYSLGVVLLEVITGQPAIASSKTEKVHISDHVRSILANGDIRGIVDQRLRERYDVGSAWKMSEIALACTEHTSAQRPTMSQVVMELKQIVYGIVTDQENYDDSTKMLTVNLDTEMVPRAR

SEQ ID NO: 609 - DNA, 2628 bp, Arabidopsis thaliana
  AT4G29990.1
atgacacgtctacgccttctttcatggatttcaatcacgagctgtgtttgtctcgtttttgctcaagaccaatcaggttttattagtatcgattgtgggataccagatgattcaagctacactgatgagaaaacaaacatgaaatacgtttcggatttgggttttgttgagtctggaacaagtcatagcatagtctctgaccttcaaacaacttctcttgaaaggcagttccaaaacgtaagaagcttccctgaaggtaagagaaactgttacgacataaggcctcagcaagggaaaggtttcaagtatctgattagaactcgttttatgtacgggaactatgatggttttagtaaaacacctgagtttgatctctatattggagccaatctttgggaatctgttgttcttatcaatgaaacggctataatgaccaaagaaatcatttatacacctccatcagaccatattcatgtgtgtcttgttgataaaaacagaggaactccttttctctctgtcttggaaataagatttttgaagaacgatacatatgacactccttatgaagcgcttatgcttggtcgaagatgggatttcggcacagcgaccaatcttcaaatcaggtacaaagatgatttctatgatcgcatatggatgccttataagtctccgtaccagaaaactttgaatacatccctcaccatcgatgaaactaaccacaacggtttcagacctgctagtatagtcatgagatctgcgatagcacctggaaacgaaagcaatcccttgaagtttaactgggcaccagatgatccgaggtcgaagttttatatatacatgcacttcgctgaagttcgagagctacaaagaaacgagacacgagaattcgatatatacataaatgacgttatacttgccgagaatttccgtcctttttatttgtttacagacacacgctccactgtagatccagttggcagaaaaatgaatgaaattgtccttcagagaactggtgtatcgacccttccaccgatcatcaacgctatagagatctatcaaatcaacgagttccttcagttaccaacagatcaacaggatgttgatgccatgacgaagattaagttcaagtatagagtaaagaagaactggcaaggagacccatgtgttccagtggacaattcttgggaaggtcttgaatgtctccatagtgataataatacttctccaaaatccattgctctgaacttatcctccagtggactgactggccagattgatccagctttcgccaacctaacatcaataaataaattagacttatcaaacaacagcttaacagggaaagtacccgatttcctcgccagtttaccaaacttgactgaattaaacctggaaggaaacaagttaactggttcgattccagctaaactgttggagaaatcaaaagatggttctctttcgcttagatttggtggaaacccggacctttgtcagtctccctcatgtcaaacaacaacgaagaagaaaattggttacatcgtcccagtagtagcatcactcgcaggattgctcattgttttgaccgcattagctttgatctggcattttaaaaaacgatcacgaagaggtacaatctcaaacaaaccattaggtgtcaacaccggaccattggacacagccaaaagatactttatatactcagaagttgtgaatatcacaaacaacttcgagagagttcttggtaaaggaggttttggtaaagtataccatggtttcttgaatggagatcaagtagctgtgaagatactttccgaagagtcaactcaaggttacaaagagtttcgagcagaggttgagcttctgatgagagtccatcacacaaatttgacatctcttatcggatactgcaatgaagataaccacatggcacttatctacgagtacatggctaatggaaacttaggagactatttgtcaggaaaaagttccttaatcttgagctgggaagagagattacagatatcattggatgcagcacaaggcctcgagtatctccattacggttgcaagcctcccatagttcacagagatgtgaagccggcaaatatcttactgaacgagaatcttcaagccaagatagctgactttggtttatctagaagcttcccagtcgaaggtagtagtcaagtctccaccgttgtcgctggaaccatcggttacttagaccctgagtattacgcaacgcggcaaatgaacgagaagagtgatgtttacagcttcggggtggttcttcttgaagtaataacaggaaaaccggcaatttggcattcaagaacagagagtgtgcatctaagtgatcaggttggttcaatgttggcgaatggagacataaaaggtattgtggatcaacgtctgggagatagatttgaggttggctcggcttggaagatcactgaactagcattggcttgtgcgtctgagagttcagaacaaagaccgacaatgagccaagtcgttatggagctgaaacagagtatctttgggagagtgaacaatcgaagtgaccataaggaccctgtgagaatggttacgatgaacctcgatactgaaatggttcctcgggcgagg

SEQ ID NO: 610 - protein, 876 aa, Arabidopsis thaliana
  AT4G29990.1
MTRLRLLSWISITSCVCLVFAQDQSGFISIDCGIPDDSSYTDEKTNMKYVSDLGFVESGTSHSIVSDLQTTSLERQFQNVRSFPEGKRNCYDIRPQQGKGFKYLIRTRFMYGNYDGFSKTPEFDLYIGANLWESVVLINETAIMTKEIIYTPPSDHIHVCLVDKNRGTPFLSVLEIRFLKNDTYDTPYEALMLGRRWDFGTATNLQIRYKDDFYDRIWMPYKSPYQKTLNTSLTIDETNHNGFRPASIVMRSAIAPGNESNPLKFNWAPDDPRSKFYIYMHFAEVRELQRNETREFDIYINDVILAENFRPFYLFTDTRSTVDPVGRKMNEIVLQRTGVSTLPPIINAIEIYQINEFLQLPTDQQDVDAMTKIKFKYRVKKNWQGDPCVPVDNSWEGLECLHSDNNTSPKSIALNLSSSGLTGQIDPAFANLTSINKLDLSNNSLTGKVPDFLASLPNLTELNLEGNKLTGSIPAKLLEKSKDGSLSLRFGGNPDLCQSPSCQTTTKKKIGYIVPVVASLAGLLIVLTALALIWHFKKRSRRGTISNKPLGVNTGPLDTAKRYFIYSEVVNITNNFERVLGKGGFGKVYHGFLNGDQVAVKILSEESTQGYKEFRAEVELLMRVHHTNLTSLIGYCNEDNHMALIYEYMANGNLGDYLSGKSSLILSWEERLQISLDAAQGLEYLHYGCKPPIVHRDVKPANILLNENLQAKIADFGLSRSFPVEGSSQVSTVVAGTIGYLDPEYYATRQMNEKSDVYSFGVVLLEVITGKPAIWHSRTESVHLSDQVGSMLANGDIKGIVDQRLGDRFEVGSAWKITELALACASESSEQRPTMSQVVMELKQSIFGRVNNRSDHKDPVRMVTMNLDTEMVPRAR

SEQ ID NO: 611 - DNA, 2643 bp, Arabidopsis thaliana
  AT2G19210.1
atggtgcattacaactttctctcgctgattatatttgcatgcttcttcgctgtttttgttcttcttgttcgtgctcaagaccaatcaggttttgtcagtatagattgtggtatacctgaggattcaagctataatgatgaaacaacagacataaagtatgtttcagatgctgcgtttgttgagtctgggacaattcatagcatagatcctgagtttcaaacaagttctcttgagaagcagtttcaaaacgttaggagcttccctgaaggcaacagaaactgttacgatgtgaagcctccgcagggaaaaggcttcaagtatttgataagaacccgtttcatgtatggtaactacgataatctagggaaagcaccggacttcgatctttatcttgggttcaatatttgggattctgttacaatagataacgcaactacgatagttaccaaagagatcatccacactcttcgctcagaccatgttcatgtgtgtcttgttgataaaaacagaggaactccgttcctgtctgcgttagaaatcaggctcctgaagagtaatacatacgagactccttatgattcacttattctgtttaaaagatgggatcttgggggactcggtgctcttcccgtcaggtacaaagatgatgtttttgaccggatatggatacctctaaggtttccaaagtataccatcttcaatgcatcgctcacaatagattcgaataacaacgagggattccaacccgctcgctttgttatgaacactgcaacttcacctgaggatttaagccaagacataatcttttcttgggaaccaaaggatcctacttggaagtattttgtgtatatgcactttgcagaagttgtggagctgccaagtaatgagacaagagaatttaaggtgttattaaacgaaaaggaaatcaacatgagctcctttagcccgcgatacttgtatacagacacgctttttgttcagaaccccgtgagcggaccaaaactcgagtttcgtcttcaacaaactcctagatctacccttccacccatcattaacgccattgaaacatatcgtgtcaacgagtttctacagtcacctactgatcaacaagatgttgatgcaattatgagaatcaagtccaagtatggagtgaagaagagctggcttggggacccttgtgctccagtaaaatacccttggaaggatattaactgcagctatgtcgataatgagtctcccagaattatttctgtaaatttatcctcgagtggcttgactggagagattgatgcagcgttctcaaaccttacattgttacatatattagacttatcaaacaacagtttaacaggaaaaatacctgatttcctcggtaatctacataatttgacagagttaaacttggaaggaaacaagttatcgggtgctattccggttaaactattggagagatcaaacaaaaaactgattttgctaagaattgatgggaatccggacctctgcgtgtctgcttcatgtcaaatttcggatgagaagacaaaaaagaatgtatacatcattccattagtagcatctgtcgtgggagtgctaggtcttgtactagctatagctttgtttttgttgtacaagaagcgacacagaagaggcggctctggtggtgtcagggctgggccattggatacaactaagcgatactacaaatactcggaagttgtgaaagttacaaacaactttgagagagttcttggacaaggaggttttggaaaagtatatcatggtgtcttaaatgatgaccaagtcgctgtcaagattctgtctgaatcatcagctcaaggttacaaagagttcagagcagaggttgaacttctcctgagagtccatcacaagaacctaaccgctcttatcggatactgccacgaaggcaagaagatggcgcttatctatgagtttatggctaatggaaccttaggagattacttgtcaggggaaaaatcttatgtcttgagctgggaagagaggttacaaatatcactagacgcggcacaagggcttgagtatcttcacaatggctgcaagcctcccattgtacaaagagatgtgaagccggctaatattctaatcaacgagaagctccaggccaagattgctgactttggattatctagaagtgtcgcactagacggtaataaccaggatacaaccgctgttgctggaaccatcggttatctcgatcccgagtaccatttgacgcaaaaattaagcgagaagagtgatatttacagcttcggggtggttcttttagaggttgtctcaggccaaccggtgattgcacgttcaagaacaacagcagagaacatacacataactgaccgggtcgacttaatgctgtcgacaggagatatcagaggcattgtggatccaaagctaggagagaggtttgatgctggttcggcatggaagatcactgaagtagcaatggcttgtgcatcttctagttctaagaatagaccgacgatgagtcatgtagtggctgagctaaaggagagtgtaagcagagcaagagccggtggtggttctggcgccagtagtgtcacggatccagctatgacgaattttgattcgggaatgtttcctcaagcaagg

SEQ ID NO: 612 - protein, 881 aa, Arabidopsis thaliana
  AT2G19210.1
MVHYNFLSLIIFACFFAVFVLLVRAQDQSGFVSIDCGIPEDSSYNDETTDIKYVSDAAFVESGTIHSIDPEFQTSSLEKQFQNVRSFPEGNRNCYDVKPPQGKGFKYLIRTRFMYGNYDNLGKAPDFDLYLGFNIWDSVTIDNATTIVTKEIIHTLRSDHVHVCLVDKNRGTPFLSALEIRLLKSNTYETPYDSLILFKRWDLGGLGALPVRYKDDVFDRIWIPLRFPKYTIFNASLTIDSNNNEGFQPARFVMNTATSPEDLSQDIIFSWEPKDPTWKYFVYMHFAEVVELPSNETREFKVLLNEKEINMSSFSPRYLYTDTLFVQNPVSGPKLEFRLQQTPRSTLPPIINAIETYRVNEFLQSPTDQQDVDAIMRIKSKYGVKKSWLGDPCAPVKYPWKDINCSYVDNESPRIISVNLSSSGLTGEIDAAFSNLTLLHILDLSNNSLTGKIPDFLGNLHNLTELNLEGNKLSGAIPVKLLERSNKKLILLRIDGNPDLCVSASCQISDEKTKKNVYIIPLVASVVGVLGLVLAIALFLLYKKRHRRGGSGGVRAGPLDTTKRYYKYSEVVKVTNNFERVLGQGGFGKVYHGVLNDDQVAVKILSESSAQGYKEFRAEVELLLRVHHKNLTALIGYCHEGKKMALIYEFMANGTLGDYLSGEKSYVLSWEERLQISLDAAQGLEYLHNGCKPPIVQRDVKPANILINEKLQAKIADFGLSRSVALDGNNQDTTAVAGTIGYLDPEYHLTQKLSEKSDIYSFGVVLLEVVSGQPVIARSRTTAENIHITDRVDLMLSTGDIRGIVDPKLGERFDAGSAWKITEVAMACASSSSKNRPTMSHVVAELKESVSRARAGGGSGASSVTDPAMTNFDSGMFPQAR

SEQ ID NO: 613 - DNA, 3075 bp, Arabidopsis thaliana
  AT2G19230.1
atggggaatttcaactttcttccgctagtttctttcgcaagctttgttgttgtccttgttcttgtttgtgctcaagaccaatcaggttttgttagtatagattgtggtataccagaagattccagttattacgatgagaaaacagacataaaatacatttcagatgctgcatttgtcgagtccgggacaattcatagcatagattctaagtttcagaaaaaaaatcttgagaaacagttccaaaaggttaggagcttccctgaaggcaagaaaaactgttacgatgtgcagcctcctcagggaaaaggcttcaagtatctgataagaacccgtttcatgtacggtaactacgataatctagggaaagcacccgacttcgatctttatcttggtgtcaatctctgggattctgttactcttgagaattcaactactatagtcaccaaagagatcatctacactcttcgctcggacaaggttcatgtgtgtcttgttgataaagaaagaggaactccattcttgtctgtcttagaactcaggctcctgaaaaataatatatacgagactgcttctgattctcttatgctgtatcgaagatgggatcttggtgcaaccggagatcttcctgccaggtacaaagacgatatttttgaccgcttctggatgccgttgatgtttccgaactttttgatcctcaatacgtcgctgatgatagatccgactagcagcaacggattcttaccccctagtgttgtcatgagcactgcagtagcaccaatgaattccagcatagagcagataatggtttattgggaaccacgggacccaaattggaaattctatatatacatacactttgctgaagttgagaaacttccaagtaatgagacaagggagttctctgtgtttctgaacaaagagcagatcgacactactagtgtgtttaggcctagctacttgtatacagatacactttacgttcaaaaccccgtgagcggaccatttctcgaatttgttcttagacaaggtgttaagtccacgcgtcctcctatcatgaatgccatcgagacatatcgtaccaacgagtttcttgatttgcctactgatcaaaatgatgttgatgcaattatgaaaataaagaccaagtataaagtgaagaagaactggctcggagatccttgtgctccatttggctatccttggcagggtattaattgtagctacaccgctaacaatcctccgagaatcatttctgtgaacctatcctttagtggattgactggccagattgatccagtcttcatcacccttacaccattacagaaactagacttatcaaataacagattaacaggaacagtacctgatttccttgctaatttaccggatttaaccgagttaaacttggaagaaaacaagttaacgggtatcctcccggagaaactattggagagatcaaaagatggatcgctttctctgagagttggcgggaatccagacctttgcgtgtctgattcatgtcgaaacaaaaagacggagaggaaagaatacattattccatcagtagcatctgttacaggattgttttttctcttgctcgcattaatttctttctggcaattcaagaagagacaacaaacaggtgtcaagaccggaccactagacacaaagcgatactacaagtattcagaaatagtggaaattacaaacaactttgagagagttcttggccaaggaggcttcggaaaagtatactatggtgtcttacgtggggaacaagttgctatcaagatgttgtctaaatcatcagctcaaggctacaaagaattccgagcagaggttgaacttctcctgagagttcatcacaagaacctaatagctcttattggatactgccacgaaggagatcaaatggcacttatctacgagtatatcggtaatgggaccttgggagactacttgtcagggaaaaactcgagtattttgagctgggaggaaaggttacagatatcattagatgcagcacaagggctagagtatctccacaatggatgcaaacctcctatagttcacagagatgtgaaacctacgaacattctaatcaacgaaaagctccaggccaagatcgctgacttcggtttatctagaagcttcacactggaaggtgacagtcaggtttcaactgaagtcgctggaactattggctatcttgaccctgagcactactcgatgcagcaattcagcgagaagagtgatgtttatagctttggggtggtactcctggaggtaatcacgggccaaccggtaatttcacgttcaaggactgaagagaacagacatataagcgaccgagttagcttgatgctgtctaaaggagatatcaaaagcattgtggatccgaagctaggagagaggttcaacgctggcttggcctggaagatcactgaagtagcattggcttgtgcgtctgaaagtactaagacaagactcacgatgagtcaggttgtggctgagctaaaagagagtctatgcagagcaagaaccagtggtgattctggagatatttcttttagcgagccgacggagatgaacgtgtccatgactgttgacccgggggtgcttcctcaaccgagaaatgagtatccagtaactcagcctgatgcagtcaactctacagataaatctgtgggcattactaaggagcacaaccttttacatggaatagtccagtggttccggaagcttaaacacactttgtcaagtgaggagacttcagatagaaaagcttctgatgccacaaagaccagtgatcaatggagactcaaatcagaatctgatgaggactctgaagaaccttggccagtccatgctctaacacattcaggtaacaagtatgagtatgttagtttcttgcctctagtggcagttgagttggttttccaacaagaacctagtctggttcaggcaggattgatagggaactttgctaaaaccaatttgatcgaaaagggacaagtcactgctacaacagcacttaaggagcttcggaaactcagtaatctgttgtcagagatg

SEQ ID NO: 614 - protein, 1025 aa, Arabidopsis thaliana
  AT2G19230.1
MGNFNFLPLVSFASFVVVLVLVCAQDQSGFVSIDCGIPEDSSYYDEKTDIKYISDAAFVESGTIHSIDSKFQKKNLEKQFQKVRSFPEGKKNCYDVQPPQGKGFKYLIRTRFMYGNYDNLGKAPDFDLYLGVNLWDSVTLENSTTIVTKEIIYTLRSDKVHVCLVDKERGTPFLSVLELRLLKNNIYETASDSLMLYRRWDLGATGDLPARYKDDIFDRFWMPLMFPNFLILNTSLMIDPTSSNGFLPPSVVMSTAVAPMNSSIEQIMVYWEPRDPNWKFYIYIHFAEVEKLPSNETREFSVFLNKEQIDTTSVFRPSYLYTDTLYVQNPVSGPFLEFVLRQGVKSTRPPIMNAIETYRTNEFLDLPTDQNDVDAIMKIKTKYKVKKNWLGDPCAPFGYPWQGINCSYTANNPPRIISVNLSFSGLTGQIDPVFITLTPLQKLDLSNNRLTGTVPDFLANLPDLTELNLEENKLTGILPEKLLERSKDGSLSLRVGGNPDLCVSDSCRNKKTERKEYIIPSVASVTGLFFLLLALISFWQFKKRQQTGVKTGPLDTKRYYKYSEIVEITNNFERVLGQGGFGKVYYGVLRGEQVAIKMLSKSSAQGYKEFRAEVELLLRVHHKNLIALIGYCHEGDQMALIYEYIGNGTLGDYLSGKNSSILSWEERLQISLDAAQGLEYLHNGCKPPIVHRDVKPTNILINEKLQAKIADFGLSRSFTLEGDSQVSTEVAGTIGYLDPEHYSMQQFSEKSDVYSFGVVLLEVITGQPVISRSRTEENRHISDRVSLMLSKGDIKSIVDPKLGERFNAGLAWKITEVALACASESTKTRLTMSQVVAELKESLCRARTSGDSGDISFSEPTEMNVSMTVDPGVLPQPRNEYPVTQPDAVNSTDKSVGITKEHNLLHGIVQWFRKLKHTLSSEETSDRKASDATKTSDQWRLKSESDEDSEEPWPVHALTHSGNKYEYVSFLPLVAVELVFQQEPSLVQAGLIGNFAKTNLIEKGQVTATTALKELRKLSNLLSEM

SEQ ID NO: 615 - DNA, 2646 bp, Arabidopsis thaliana
  AT1G51790.1
atgatgacatcgaaggcgaaggcgcttacgttcatttgttgtgtggctcttctcaatcttgccattgcccaggatcaatcagggttcattagcatagattgcgggttacaaccagaaaattccagctacacggaaacatcgaccgatattaagtatgtttcggattcaagttatacggatacagggacaagctatttcgttgcgcctgaaaatagacaaaatatgaagcagagcatgtggtccgtcagaagttttccagagggaatcagaaactgttacactattgctgttaatagcagcaccaagtatctgatccgggcggattttatgtacggtaactacgattcgagaaacgagataccgggtttcgatcttcacttaggtccaaacaaatgggacactgttgaattggtgtctcctctgcaaacagtgtccaaggagatcatatattatgtgttgacagatacaatacaagtgtgtttagtgaatacaggaaatggtacgccttttatatcggtattggaacttagacagttgccgaattcttcctatgcagctcaatctgaatcacttcaactatttcaacggttggattttggatcaacgacaaatctaacggttaggtatccaaacgatgtttttgatcggatttggtttcccgccacgccaaatgggacgaagccgttaagtgacccgtcgacttctctcacaagcaacagtaccggtaatttccgtcttccacaagttgtaatgagaactggaattgtaccagataatccaagaggatttgtagattttggatggattccagatgatccgtctcttgagtttttcttttacttgtatttcacggaacttcaacaacctaattccggaaccgtagaaacaagagaattcgtgatcttgttgaacgggaagtcttttggggaaccgttaagtcttaactacttccggaccttagccttgttcacttcaaaccctttgaaagcagagagcttccagttttctcttcgtcagactcagagttcatctcttccacctctgatcaatgctatggagacttactttgtaaacaaacttccacaatcatcaacggatccaaacgacctttctgctatgaggaatattaagtctgcatataaagtcaagagaaactgggaaggagacgtgtgtgtgcctcaagcttacacatgggaaggtctgaattgtagcttcaatggcacaaacatgccaagagtaatagcattaaacttatcgtccgccggattgactggagagataacgtctgatatatcgcgtctttcgcagttgcaaattctggacttatcaaataacaatttgagtggacctgcagtaccagctttcttagcgcaactccaattcctgagagtcctacatttggcgaacaaccagcttagtggtcctataccctctagtctcatagagagactagactcgtttagtgggaatccaagtatttgttctgcaaatgcgtgtgaagaggtctcacaaaatagatcaaagaagaataaacttcccagctttgtcattcctttagttgcatcacttgcagggctgcttcttctttttatcatatctgcagctatatttttaatcctcatgagaaaaaagaaacaagactacggagggaatgaaacagcggttgatgcgtttgatttggaaccatcaaataggaagtttacatatgcagagattgtgaacattacaaatgggtttgatagagatcaagggaaggtaggatttggaagaaactaccttggaaagttagatggtaaagaagtaactgtcaagcttgtttcttcactatcttctcaaggctacaaacaactcagagcagaggtcaaacatcttttcagaattcatcataaaaaccttataaccatgcttggttactgcaacgaaggcgataaaatggcggttatatacgagtacatggctaatggaaacttgaaacaacatatctcagagaacagtacaactgtttttagctgggaagataggctcggtatcgcggttgatgtcgcgcaaggacttgagtatttgcatactggttgcaagccgccgatcattcatagaaacgtcaagtgtacaaatgtattcttagatgaaagtttcaatgcgaagttaggcggttttggcctttcgagagcgtttgatgcagccgagggaagtcatttgaatacagctattgctgggactcctggatatgttgaccccgagtattacacatcaaacatgttaacagagaagagtgatgtgtacagtttcggtgtagttctattagagatcgttactgcgaaacccgctatcataaagaatgaggaaaggatgcatataagtcaatgggttgagtctttgctttcaagagaaaatattgtagagattcttgacccgagtctttgcggagactatgacccaaactcggcattcaagaccgtggaaatagccgtggcttgcgtttgtcgaaattcgggcgacagacctgggatgagtcaagtggtgacggctcttaaggagagtttagctgtagaagttgagaggaaaaagcatttgccggttggatcaacagattcacttgaagagcttgcacttggctttggatctaatccacctcctcgtttgaga

SEQ ID NO: 616 - protein, 882 aa, Arabidopsis thaliana
  AT1G51790.1
MMTSKAKALTFICCVALLNLAIAQDQSGFISIDCGLQPENSSYTETSTDIKYVSDSSYTDTGTSYFVAPENRQNMKQSMWSVRSFPEGIRNCYTIAVNSSTKYLIRADFMYGNYDSRNEIPGFDLHLGPNKWDTVELVSPLQTVSKEIIYYVLTDTIQVCLVNTGNGTPFISVLELRQLPNSSYAAQSESLQLFQRLDFGSTTNLTVRYPNDVFDRIWFPATPNGTKPLSDPSTSLTSNSTGNFRLPQVVMRTGIVPDNPRGFVDFGWIPDDPSLEFFFYLYFTELQQPNSGTVETREFVILLNGKSFGEPLSLNYFRTLALFTSNPLKAESFQFSLRQTQSSSLPPLINAMETYFVNKLPQSSTDPNDLSAMRNIKSAYKVKRNWEGDVCVPQAYTWEGLNCSFNGTNMPRVIALNLSSAGLTGEITSDISRLSQLQILDLSNNNLSGPAVPAFLAQLQFLRVLHLANNQLSGPIPSSLIERLDSFSGNPSICSANACEEVSQNRSKKNKLPSFVIPLVASLAGLLLLFIISAAIFLILMRKKKQDYGGNETAVDAFDLEPSNRKFTYAEIVNITNGFDRDQGKVGFGRNYLGKLDGKEVTVKLVSSLSSQGYKQLRAEVKHLFRIHHKNLITMLGYCNEGDKMAVIYEYMANGNLKQHISENSTTVFSWEDRLGIAVDVAQGLEYLHTGCKPPIIHRNVKCTNVFLDESFNAKLGGFGLSRAFDAAEGSHLNTAIAGTPGYVDPEYYTSNMLTEKSDVYSFGVVLLEIVTAKPAIIKNEERMHISQWVESLLSRENIVEILDPSLCGDYDPNSAFKTVEIAVACVCRNSGDRPGMSQVVTALKESLAVEVERKKHLPVGSTDSLEELALGFGSNPPPRLR

SEQ ID NO: 617 - DNA, 2556 bp, Oryza sativa
  LOC_Os09g18260.1
atgccatttttcattcctccatccgtttgcgcattaggtttcctaagcatcgattgcggtctggaaggagacgacagctacccggatgaccagaccggcattacttatgtccctgatggtccatatgtcgactctggggagaaccacagggtaaccaccgtgtacaggaactactggggccaggactaccgtactctcaagacgctcaggagcttcccttccgcttctggtaagcggaactgctacagcctccctaccaacgtcggggacaagtaccttgtcaggctggaattcttatatggcaactacgacagcatggacagctctttgcttaaattcaacttatctcttggggtgaaccactggaacaccgtgaatttggacaccaccgacgaccaagatggttataacttttatgaggcggtgttcgtggcatgggcgagctgggcgccggtgtgcctcatcaacattggccaaggcataccatttgtgtccacagtagagctgaggctgctcggcactttgccctacccggctatcatcggcaatcagtcactctccctctatgtcagaaggagcataggatcgagcgctgacgatgatatgaggtatcctgatgatcagtatgatcggtactggatcatgggagaaacaacaggagctgccgacatgtccaacatttccaccccgacgatcatcccgccgagcgtcccttttgcagtgccctcgcctatactccagaaggcagttgtgccagctgacaactcaatgaaactagttttccactcagaccaattagatgcacagctccgtgaccaccttgtgatcctacacttcgccgacttccagaataacaagtcccgggaattcactgtttcaattgacagtggtgtacagagcggcccattcagtccaccatacctgaaagttttgtccatcaccacagattggtccagcgataccgaaggcaagtataacttcacactcacggccacatcaacgtcttccctgcccccgatcctcaatgcttacgaggtctacggtcgcatcatccatgacaatccaatgacattctcccaagattttgatgcgatcatggctattaaatatgagtatggaataaggaagaactggatgggtgatccgtgtttcccacctgaatttgcttgggatggtgttgaatgtagcagtgacggaaaaactatgaggataatatctctcgatctctccaacagcgaactgcacgggttaatatccaataatttcacattgcttactgccctcaagtatttaaacctgtcatgcaatcaactgaatggagcaattccagactccctccgtagaaagaatggatcaatggttctaagttatgagtctggtggagatatgtgcaaaaaaccagtaagtccgtcgtcaagaaacagagcagctgccttagctgtttcagtagtggttccaatgctggcagtggccatacttggtctggcatatttattctggagagccaaaagaaagcacaataatgatcctcccacggtactagaactcacgggtgctccaggacataagacaaatcattgggaccgtctacaaaaacctgaaaatcgtcgattcacatttgaggagctacagaagttcactgataacttcaaacgtttaattgggcatggaggctttgggcatgtgtattatggttctctagaagacagtactgaggttgcagtcaagatgcgatctgaatcatcattgcatgggcttgatgagttcttagctgaggttcagagcttgaccacggtgcatcatagaaatcttgtctctttgtttggttactgctgggacgacgatcacttagcgcttgtctatgagtacatgtctagtggcaatctttgtgattatctgagaggtaaaaccagtatgaccgaaacgtttaattgggcaacacgtgtaaaaattgcgttagaagctgcacaaggcctggattatctacacaagggttgcaacttgccaataattcatggggatgtgaagacaaataacattctcttgggtcgaaatctaaaagccaaaatagcagattttgggctttctaaaacctatcatagcgactctcaaactcacatatcagctagtattgcagctggatctatgggttatattgaccctgagtactacaccaccggcaggctcactgagagcagtgatgtctatagcttcggtgttgttttactggaggtaactaccggtgaacctcccataatacctggaaatggacacgttgttcagcgtgtgaagcagaagattgtcacaggtaacatcagctctattgttgatacacgtcttggaggttcctataatgttagctccatgtggaaggttctagatgctgccatgatgtgcacaacaaatattgctgctgaaaggccaacaatggctacagtggttatgcaactgaaggaaagtctagaattagaggaagctcatggtgaaaggggtgatatggaaaaccaagcaagggataacacatatttgatgtccacatttggtccattggcaaga

SEQ ID NO: 618 - protein, 852 aa, Oryza sativa
  LOC_Os09g18260.1
MPFFIPPSVCALGFLSIDCGLEGDDSYPDDQTGITYVPDGPYVDSGENHRVTTVYRNYWGQDYRTLKTLRSFPSASGKRNCYSLPTNVGDKYLVRLEFLYGNYDSMDSSLLKFNLSLGVNHWNTVNLDTTDDQDGYNFYEAVFVAWASWAPVCLINIGQGIPFVSTVELRLLGTLPYPAIIGNQSLSLYVRRSIGSSADDDMRYPDDQYDRYWIMGETTGAADMSNISTPTIIPPSVPFAVPSPILQKAVVPADNSMKLVFHSDQLDAQLRDHLVILHFADFQNNKSREFTVSIDSGVQSGPFSPPYLKVLSITTDWSSDTEGKYNFTLTATSTSSLPPILNAYEVYGRIIHDNPMTFSQDFDAIMAIKYEYGIRKNWMGDPCFPPEFAWDGVECSSDGKTMRIISLDLSNSELHGLISNNFTLLTALKYLNLSCNQLNGAIPDSLRRKNGSMVLSYESGGDMCKKPVSPSSRNRAAALAVSVVVPMLAVAILGLAYLFWRAKRKHNNDPPTVLELTGAPGHKTNHWDRLQKPENRRFTFEELQKFTDNFKRLIGHGGFGHVYYGSLEDSTEVAVKMRSESSLHGLDEFLAEVQSLTTVHHRNLVSLFGYCWDDDHLALVYEYMSSGNLCDYLRGKTSMTETFNWATRVKIALEAAQGLDYLHKGCNLPIIHGDVKTNNILLGRNLKAKIADFGLSKTYHSDSQTHISASIAAGSMGYIDPEYYTTGRLTESSDVYSFGVVLLEVTTGEPPIIPGNGHVVQRVKQKIVTGNISSIVDTRLGGSYNVSSMWKVLDAAMMCTTNIAAERPTMATVVMQLKESLELEEAHGERGDMENQARDNTYLMSTFGPLAR

SEQ ID NO: 619 - DNA, 2658 bp, Oryza sativa
  LOC_Os09g18594.1
atgccctgcagtccgccatcttacctgttcattattgtcactggtgtactgcttgtgcttgtgcactcccagacctccttagatgaagactttataagcatcgattgtggccttcccagtggctttagctatgtggatgagaagacaaatatcacatatatttcagatgatcagtacatagacacgggagaaaaccacaacatttcttcacaactccaaggggcagaacaattcagatcaggtttaaatctcagaagttttcctacaggaggtaggaattgctatactctttatcctgccataaaaggtcagaagtatcttataagaggaatgttcatgcatgggaattacgataacaaaggccaggatcttgtaagctcaccagtgacattcgacatccgcatcgggctcaacttctggaaccggctgaacataatcaatgcaaccatgacttacacatctgaagctatcgtagttgccattgtaaattcagtatcagtttgtttggttgataatggagaaggaactcctttcatatcatcgttggaaatgaggccaatgaagagttcaaattaccctgcagcaacaccaaatcatccccttttgcttcaggatcgacgaagcatgggcgcaagtagaataattaggtatccagatgatccctacgaccgtgtatggtggctgccacagattacatctgggttgataaagatttccacaagaagcttgatcagccgctacactgatgatgtatatgaggtgccagttgcagtcctgaagacagccgccacaacatcatcgacctctaccgccctgaatttcttgtgggctgctccaacaggctgggacgcaacacctggatacttgattggcttacacttcactgacttccagcaggggcagctgcgtgagttcgacatatactacaacaacgacctgtggaactatgataataagaaaacaaaaccgccctatctcctggctaattatatcaatggcaccactccatacacgtctgacaattatctatacaacatctcactcgttgccaccaatgcatctgtgctgccccccatgctcaatgccattgaaatatactaccaagtccaacaagatgagaagatgacctactcggaagatgttgaagccatgatgactgttaaaattgattatcaagtgaagaaaaattggatgggtgacccatgcttaccagaaaagtacacatggagtggcttgaaatgtagaagtcaaggagttacgtcaagaattatatccttagacttgtccagtagtgatttgcagggtgcaatatctgaacaattttccatgctcaggtcactcgaatacttgaatttgtcgaacaatgatttaactggatcactacctgaatccttgacaaacttaccaaatatccatgttctagatctatcaggaaaccaactaaatggtacattccctgaagcattatgcaaaaatcgagcgctcacattgaggtatgacacggcaaatggagatccatgcagtccaagatcatcaaagaagaaacataaagcagtcttagcagttgctgtagtggttccagtggtgatagtagttatacttatatctgctatgctgatgctacttttctggaaaaagcaagccattgtgaagtctagaggtcaagaacaatatggagatcatatacatattcctgaaaaccgtgagttcacatatgaggagttagtgaaaattacaaacaatttctcagtattcataggtgaaggcggatttgggcctgtttttcatggtcagttaaaagatggcactcagttggctgttaagatgcgctctccgacatcaatgtcagggaagggaatgccagagtttttagctgaggtcgagagtttaacaactgtacaccacaggtatctggttttattggttggttactgcactgaccaggatcatttaggtcttgtttacgagtatatgcctaatggaagcctttatgatcatttgagaggaaaaaatgctattatccagagattaagttggcaacatcgagcaaaaattgcacacgaagctgcccaaggtctggactacctgcacacaggatgtgtgttgcctatagttcacagagatgttaagtcacacaacattcttctagggtgtgacctaactgcaaaaatatcagattttggattgtcaaagtcatatctgaatgttgcacagagtcacattacagccactgctgctggcaccctaggctacattgacccagagtactgtcttagtggcagacttactattagcagtgatgtcttcagctttggagtagttctgctagagattgtaacaggggagcctcccatcatacccacaaatggacatattgtgcagcgcataaaagagaaggttaatatgggaaatattgaggcaattgctgatccgcgacttcatggtgagtttgatatcagctcaatttggaaggttgtggacatagcgctgttgtgcacaaaagaggcatctagtgaaaggccaacgatgagtatggtggtagcacagctaaaggatgccctagcattggaagaagcccgtttaagctacagtaccagtgacattagccaaggtggtgccaatgccgaattgtcaatcaactccatgccaacagcgagg

SEQ ID NO: 620 - protein, 886 aa, Oryza sativa
  LOC_Os09g18594.1
MPCSPPSYLFIIVTGVLLVLVHSQTSLDEDFISIDCGLPSGFSYVDEKTNITYISDDQYIDTGENHNISSQLQGAEQFRSGLNLRSFPTGGRNCYTLYPAIKGQKYLIRGMFMHGNYDNKGQDLVSSPVTFDIRIGLNFWNRLNIINATMTYTSEAIVVAIVNSVSVCLVDNGEGTPFISSLEMRPMKSSNYPAATPNHPLLLQDRRSMGASRIIRYPDDPYDRVWWLPQITSGLIKISTRSLISRYTDDVYEVPVAVLKTAATTSSTSTALNFLWAAPTGWDATPGYLIGLHFTDFQQGQLREFDIYYNNDLWNYDNKKTKPPYLLANYINGTTPYTSDNYLYNISLVATNASVLPPMLNAIEIYYQVQQDEKMTYSEDVEAMMTVKIDYQVKKNWMGDPCLPEKYTWSGLKCRSQGVTSRIISLDLSSSDLQGAISEQFSMLRSLEYLNLSNNDLTGSLPESLTNLPNIHVLDLSGNQLNGTFPEALCKNRALTLRYDTANGDPCSPRSSKKKHKAVLAVAVVVPVVIVVILISAMLMLLFWKKQAIVKSRGQEQYGDHIHIPENREFTYEELVKITNNFSVFIGEGGFGPVFHGQLKDGTQLAVKMRSPTSMSGKGMPEFLAEVESLTTVHHRYLVLLVGYCTDQDHLGLVYEYMPNGSLYDHLRGKNAIIQRLSWQHRAKIAHEAAQGLDYLHTGCVLPIVHRDVKSHNILLGCDLTAKISDFGLSKSYLNVAQSHITATAAGTLGYIDPEYCLSGRLTISSDVFSFGVVLLEIVTGEPPIIPTNGHIVQRIKEKVNMGNIEAIADPRLHGEFDISSIWKVVDIALLCTKEASSERPTMSMVVAQLKDALALEEARLSYSTSDISQGGANAELSINSMPTAR

SEQ ID NO: 621 - DNA, 2664 bp, Oryza sativa
  LOC_Os01g59550.1
atggctgttggccttccaattgtttttggctgccacgattattcagggttcacaaacattgactgtggcttcgtagacggcgagagttacacggacagcacaacaaatttaacatacgtacctgatcatgaattcgttgaaggcggcacacaccatgaagttgtgccaaagctaattagtggatccaccgatgagcaagagaaaaccttgagaagcttccctgatggccaacgcaactgttacacaataccgtccactagtggtaagaagtatctcatcagaacaaccttcacttacggaaactacgatggactcaggtcgtcagagaacggttccttatttctgtttggactccacatcggcgtcaacttctggacaacggtgaacttgacaaaacaggactcatcagacactatctggaaagaggtgctcacggttgctccggacgagttcatatatgtgtgcctggtaaactttggatcaggaacccctttcatttctgcattggagttgcggcaattggatgatccaatgtacccattcctgaatctttttgtgtctgtaagctactttactcgaatgagatttggggcagtcgatgatttcatcacaagatatccaactgatctctttgatcgtttctgggaagcagcccaatgctactcctatccctggctcaacctgaccaccaaccaaacagtgaacaagctcccaggaaatgacaacttccaggtgccaacactcatcgtccagaaggcatccaccatcaacagcggtttttcatggctcaacatcagcataacggccggtgataacctgaatggccagagcctggagcttctcccgatcttccactttgctgagatagaaaagaaccgcccaaatcggacgttccaaatctatagtgatggcaacgagctgcaccaggccttctcaccgtcctacttgcaggtggacagcgtgtacctgagggaccggtacctacatgagtcaggtacaactttcaccctgtgcaagacaaacagctcggagctcccaccactcatcaacgcctttgaggcttactcgcttgttcggatggaaaacctcaccactgacaccatcgatgtcagttccatgaaacaagtaaagacgcagtacaatgtgcaacgaagaagttggaatggagatccatgttctccaaaagagtatacctgggaaggtgtgaaatgcaactactatgatggcaaacagaatcccaggatcatcctagtgaatttatctgcaagcagactgagtggttggataaatccatcgttcagaaacatgtcgctggaaatattggatctatcacacaacaacttgtcaggcactattccatataatcaagtaaactcactgaaatctctaaatctatcatataaccagctcattggatcggttcctgactatcttttcaaaagatataaagctggtttgcttgaactaagattagaaggaaatcccatgtgctcaaatataagtgaaagctactgtgccatgcaagcagataaggcgaagaagaatacagcaacattgctcattgcagtgatagttcctgttgtagctattacacttatgttatttctatggatgctctgctgtaaaggaaaaccaaaagaacatgatgattatgatatgtatgaagaggaaaatcccctgcatagcgacaccagaagattcacatatacagagttgaggactataacgaacaacttccagtctatcattggaaatggaggatttggtacagtttatcatggcatattggggaatggagaggaagtcgcagtcaaggtgcttcgggagacatctagagccctatcaaaggacttcctccctgaggtgcaaacattgtcaaaagttcatcacaagaatctcgtcacatttttaggatattgcctaaacaagaaatgccttgcccttgtgtacgatttcatgtctagaggaaacttacaagaagttttaagaggaggactggagtatctacatgaatcatgcaccccagcaattgttcacagagatgtaaaaacggcaaacatacttctcgatgagaatcttgtggccatgatatctgactttggtctttcacgatcttacactcccgcacacacacacatatcaactattgctgccggtactgttggctaccttgacccagagtaccatgctactttccaactcactgtgaaagcagatgtctacagttttggcattgtccttctagagatcattaccggccaaccttcggttttagtggacccagaaccagtgcatctaccaaactgggtacgccaaaagattgctagaggaagcattcatgatgctgtggacagtagactgatgcatcagtatgatgccacttctgtacagagtgtcatagaccttgccatgaactgtgtgggaaatgtgtccattgataggccgagcatgaccgaaattgttatcaagctcaaagagtgcttactggcaggtacaggtaaaaagcaactggtgtctggctcctataaacagaaggacgccatggacgctggcattgcaaggcagttccagctgctgatttctggagttccaatagatggagatggctgtgcctgtgctacacatagagaagagatgattaaccactgcaatggaaagatgaaa

SEQ ID NO: 622 - protein, 888 aa, Oryza sativa
  LOC_Os01g59550.1
MAVGLPIVFGCHDYSGFTNIDCGFVDGESYTDSTTNLTYVPDHEFVEGGTHHEVVPKLISGSTDEQEKTLRSFPDGQRNCYTIPSTSGKKYLIRTTFTYGNYDGLRSSENGSLFLFGLHIGVNFWTTVNLTKQDSSDTIWKEVLTVAPDEFIYVCLVNFGSGTPFISALELRQLDDPMYPFLNLFVSVSYFTRMRFGAVDDFITRYPTDLFDRFWEAAQCYSYPWLNLTTNQTVNKLPGNDNFQVPTLIVQKASTINSGFSWLNISITAGDNLNGQSLELLPIFHFAEIEKNRPNRTFQIYSDGNELHQAFSPSYLQVDSVYLRDRYLHESGTTFTLCKTNSSELPPLINAFEAYSLVRMENLTTDTIDVSSMKQVKTQYNVQRRSWNGDPCSPKEYTWEGVKCNYYDGKQNPRIILVNLSASRLSGWINPSFRNMSLEILDLSHNNLSGTIPYNQVNSLKSLNLSYNQLIGSVPDYLFKRYKAGLLELRLEGNPMCSNISESYCAMQADKAKKNTATLLIAVIVPVVAITLMLFLWMLCCKGKPKEHDDYDMYEEENPLHSDTRRFTYTELRTITNNFQSIIGNGGFGTVYHGILGNGEEVAVKVLRETSRALSKDFLPEVQTLSKVHHKNLVTFLGYCLNKKCLALVYDFMSRGNLQEVLRGGLEYLHESCTPAIVHRDVKTANILLDENLVAMISDFGLSRSYTPAHTHISTIAAGTVGYLDPEYHATFQLTVKADVYSFGIVLLEIITGQPSVLVDPEPVHLPNWVRQKIARGSIHDAVDSRLMHQYDATSVQSVIDLAMNCVGNVSIDRPSMTEIVIKLKECLLAGTGKKQLVSGSYKQKDAMDAGIARQFQLLISGVPIDGDGCACATHREEMINHCNGKMK

SEQ ID NO: 623 - DNA, 2811 bp, Oryza sativa
  LOC_Os01g59570.1
atgctaaaacagaaggatttgatggtgatcagctacagctgctcggctggtaccaagctgacatggatattgtcgttgctgctcatcctggtcgcggcgacacaagtccatggcgtgtctcctcctgggtttttaaacgtcgactgcggattgacaaatcgtagtacttacaatgacaccgacacaactttgacgtacgtttctgacagagaatttgtcgagagcggcaagagctacgatattatggcacaatacatggcagatgctacaaatgaacaagaaaaaacgttgagaagcttccctgatggccaacggaactgttatacattaccaaccaacagtagcaagaagtatctcatcagagccaccttcacttatggaaactacgatgggctcaactcgtcagagaagggttctttgtttatctttggactccatatcggtgtcaacttctggacgacggtaaacttgacaaagtgggatccatcgagcacggtatggaaagaggtgatcacggttgctccggacaagtccgtatctgtctgtctgataaacatgggatcaggaactcccttcatatctacactagatcttaggcccttgcaagacacaatgtatcccttcgtgaatgcctcaacgtccgtcagctatttttctcggataagatttggatcggttgatgaatacatcacaagattcccaacggatcagtatgatcgcttctgggagggctgggtctttaccatgcacacctttccatgggttaataagagtagcaacggcaaggtggctgaacttcctaatattgacacctttgggcttcctccagccattctgggaagcgcttcaaccataaacggaaacttctcttggctcaacatcagcgttagtgccagtaactctctcgcaacagacctagagcttcttccagtctttcactttgttgaactcggcaataatggttcaaagagaatttttgacatctacaatgtcgatgaaccgcaagcactgttctccaacttcagcccaccgtcattcctgagctccatgttccacaactggttcttgcgcaaaggcagaagggcatattttcagcttcgcaagaccccagactcacagctaccacctcttattaacgcatatgaggtgtactcccgtgtccaggtggagaacttcaccactgcttcaagtgatgttgactccatgaaaacaatcaaagagaagtacatggtaatcaaaaactggaacggggatccatgctcaccaagagagtacatctggaatggtttgacttgcacctaccctaatggtggccagaacccaaggattgttgaaataaatctatctggcagcggtctgcaaggagagttagaaatatcattcatgaaaatgtcatcactgaagaaattggatttatcacacaacaacctgacaggcaccattccagactatcaagtaaattccctcactgttattgacttgtctaataaccagctcaatggatccatccctgattctattcttcaaagatacaaagccggtttgcttgagctaagactagaaggcaatcccatatgctccaaagtcagagctagctactgtggaaataagaagaacacacgcacacgtattttgctcatcagtgtgttagttcctgtgacatctctcctagtggtgctgttcatattctggaggttatgctggaaagggaagtcaagaaaatcagaagaagaagattatgatatgtatgaagaggagactcccctacatatcgacatcagaaggttcacatatgcagagctgaagctcataactaacaatttccaatcaatcattggaaaaggaggttttggtactgtttatcatggcatactggaaaataatgatgaagtagctgttaaggttcttgtggagacatccatagcagagtcaaaagactttctccctgaggtacaaaccttgtcaaaagttcatcacaagaatcttgtcgctttggtagggtattgccaaaacaagaagtgccttgcacttgtttatgatttcatgcctagaggaaatcttcaacagcttttaagaggaggatatgacagtttgaattgggaagagcgacttcacattgcacttgatgctgcacaaggtctggaataccttcatgaatcatgcaccccatcaatagttcacagagatgtgaagacacccaacatccttctggacaagaatctggtggccaagatatctgattttgggctttcacgggcttttaatgctgctcacacgcatatatctactgttgctgctggcactcttggttaccttgaccctgagtaccatgccactttccagcttactgttaagacagacgtttacagttttggaatcgtcctcttggagattgtgactggtcaacccccggtattcatggaccctcaaaccgtccacctgccaaattgggtgcgacaaaagattgctaatgggagcgttcacgatgttgtggacaagaagctgttggatcagtatgatgccacgcacctgcagactgtgatagacctcgccatgaactgcctcgaaaacgcatcgattgacaggccaagcatgaccgaggttgtttccgtgcttaaggtgtgcttgccgatttcaagcgagagacaatcggcaacttcaacccctcgaaagaagaacgtcatggatgcagagattccaagacagttccagttgatgatttctggagcttcaacaacaagctacgagggcagctcctttcagtctggatataccggtggggtatcagaaataagccacatttctgggcgg

SEQ ID NO: 624 - protein, 937 aa, Oryza sativa
  LOC_Os01g59570.1
MLKQKDLMVISYSCSAGTKLTWILSLLLILVAATQVHGVSPPGFLNVDCGLTNRSTYNDTDTTLTYVSDREFVESGKSYDIMAQYMADATNEQEKTLRSFPDGQRNCYTLPTNSSKKYLIRATFTYGNYDGLNSSEKGSLFIFGLHIGVNFWTTVNLTKWDPSSTVWKEVITVAPDKSVSVCLINMGSGTPFISTLDLRPLQDTMYPFVNASTSVSYFSRIRFGSVDEYITRFPTDQYDRFWEGWVFTMHTFPWVNKSSNGKVAELPNIDTFGLPPAILGSASTINGNFSWLNISVSASNSLATDLELLPVFHFVELGNNGSKRIFDIYNVDEPQALFSNFSPPSFLSSMFHNWFLRKGRRAYFQLRKTPDSQLPPLINAYEVYSRVQVENFTTASSDVDSMKTIKEKYMVIKNWNGDPCSPREYIWNGLTCTYPNGGQNPRIVEINLSGSGLQGELEISFMKMSSLKKLDLSHNNLTGTIPDYQVNSLTVIDLSNNQLNGSIPDSILQRYKAGLLELRLEGNPICSKVRASYCGNKKNTRTRILLISVLVPVTSLLVVLFIFWRLCWKGKSRKSEEEDYDMYEEETPLHIDIRRFTYAELKLITNNFQSIIGKGGFGTVYHGILENNDEVAVKVLVETSIAESKDFLPEVQTLSKVHHKNLVALVGYCQNKKCLALVYDFMPRGNLQQLLRGGYDSLNWEERLHIALDAAQGLEYLHESCTPSIVHRDVKTPNILLDKNLVAKISDFGLSRAFNAAHTHISTVAAGTLGYLDPEYHATFQLTVKTDVYSFGIVLLEIVTGQPPVFMDPQTVHLPNWVRQKIANGSVHDVVDKKLLDQYDATHLQTVIDLAMNCLENASIDRPSMTEVVSVLKVCLPISSERQSATSTPRKKNVMDAEIPRQFQLMISGASTTSYEGSSFQSGYTGGVSEISHISGR

SEQ ID NO: 625 - DNA, 2658 bp, Brachypodium distachyon
  Bradi2g19290.1
atggcgtcccggccgtggttaatcctcctgctcggcctcgccggcgtgcttaaagtccccggccagcgctcccccgatagcaccgggttcgtcagcatcgactgcggcctgccgccggagcaaggcggctacttggacgcggccacgaagctgccatacgtcccggacggcgccttcacggacgccggcgccaaccacaacatctccgccgagtacataactccgtccttatccaggcgctacctcaacgtgcgcagcttcccgagctcaccccggagctgctacacgcttccctccaccgtggcccggggctccaagtaccttctccgggccaccttcatctacggcaactacgacgggctcaacaaaccccccgtcttcgacctccacctcggggtcaacttctggcagacggtcaacatcacgagccccggcgccgcgcagatcgccgaggtcgtggccattgtgcccgacgagtccgtccaggtctgcctcgtcgacaccggctccggcacgcccttcatctccgggctcgacctcaggcccctcagggacacgctctacccgcaggcaaacgccacgcaggcgctcgtcctcgtcgaccggaacaacttcggcgtcaatggcttgtcgtccctgatcaggtacccggatgacccgtatgaccgtgtctggatcccgtggagcgacccggataagtggtcggagatcgcgacgacggagaagatccaggacctggctgacccgcggttccaggcgccgcaggccgtgatgcagaccgccatcgcggcacggaacgggtcggcatcgcccggcaccatcgagctctggtgggacgtcgtgccgagccgcgtctacccgggggtgcccgggtgcgtcagcatcttctacttcgcggagctccaggcggtgtccggcggcgcgctgcggcagttcgacatggccatcaacggcacgctctggagcaaggcgccgtacacgccgcggcacctcgcgtcggacgggttcttcaacggcgagccgcaccggggcttcacccggttcaatttcacgctcaatgccacggccaagtccactctgccgcccaccatcaacgccgccgagttcttctctgtcgtctccattgccgacgtcgccacggacgccaaggatgttgcggccattgctgcgatcaaggctaagtatcaggtgaagaagacgaactgggcgggtgacccgtgctctcccaaggctcttgcgtgggatgggttgaactgcagctatgccatttccatgcctccgagaatcacaagactaaatatgtcattgggtggtctgagcggcgatatgtcgtcttacttcggcaacctaaaagtaatcaagtatttggatttgtcgtacaacaatttaacaggatcaattcctaatgtcctgtcagaactgccctttctcgtgatgctagatttgacaggtaaccagcttaatggatccattccctccgggcttatgaaaagaatccaagatggctccctaactctcagatacggcaaaaattcaaacctttgcaacaacggtacctcttgccagcccaccaaaaagaagagcagctctatgcttgccgtctacattgctgttccaattgttgccgttgtggtggcaggagcactagcagcactgcttctcatagcaaggaaaaggcaaggatcagggaagggcagcgtgaagccacagaacgaagcgagcgcgtcacagaacggcgacgggcagcacagcctgctgcagctggagaaccgccggttcacgtacagggagctggaggccatgacgagcaacttccagcgggtgctcggccggggaggcttcggctccgtctacgacggcttcttgccggatggcacccaggtggcagtcaagctgcggtcccagtcctccagccaaggcgtcagagagttcctgacggaggctcagaccttgacgaagattcaccacaagaatctagtgtccatggttggttactgcaaggacggggagtgcatggcgcttgtctacgagcacatgtccgaaggaaacctcgaagacaaacttagagggaaagatcacaacgctgggtctttaacctggagacagaggctccgtattgcactggaatccgcgaaagggcttgagtatctgcacaaagcgtgcagccctgctttcgtgcaccgggacgtgaagacatccaacatcctgctgaatgcgaatctcgaggccaaagttgccgattttggcttgctcaaggctttcagtcaggacggtgatacgcacgtatccacggcgaggctggttggcacgcacggctaccttgcccctgagtatgcggcagctctgcaattgacggtgaagagcgacgtgtatagcttcggcatcgtactattggaggtgatcacggggcagacgcccatcctgcaatgtccagatccgaccaacatcatccagtgggcgcggcaacggcttgcacgtggcaacattgaagacgtggtggacgtgcgcatgcaaggtgaatatgatgtcaacggcgtgtggaaggccgcggatgtcgcgctcaagtgcaccgtgcaagctcctacgcaacgcccaacaatgactgatgtggtgatgcagctgcaagagtgccttgagctagaggagcagcaccatctt

SEQ ID NO: 626 - protein, 886 aa, Brachypodium distachyon
  Bradi2g19290.1
MASRPWLILLLGLAGVLKVPGQRSPDSTGFVSIDCGLPPEQGGYLDAATKLPYVPDGAFTDAGANHNISAEYITPSLSRRYLNVRSFPSSPRSCYTLPSTVARGSKYLLRATFIYGNYDGLNKPPVFDLHLGVNFWQTVNITSPGAAQIAEVVAIVPDESVQVCLVDTGSGTPFISGLDLRPLRDTLYPQANATQALVLVDRNNFGVNGLSSLIRYPDDPYDRVWIPWSDPDKWSEIATTEKIQDLADPRFQAPQAVMQTAIAARNGSASPGTIELWWDVVPSRVYPGVPGCVSIFYFAELQAVSGGALRQFDMAINGTLWSKAPYTPRHLASDGFFNGEPHRGFTRFNFTLNATAKSTLPPTINAAEFFSVVSIADVATDAKDVAAIAAIKAKYQVKKTNWAGDPCSPKALAWDGLNCSYAISMPPRITRLNMSLGGLSGDMSSYFGNLKVIKYLDLSYNNLTGSIPNVLSELPFLVMLDLTGNQLNGSIPSGLMKRIQDGSLTLRYGKNSNLCNNGTSCQPTKKKSSSMLAVYIAVPIVAVVVAGALAALLLIARKRQGSGKGSVKPQNEASASQNGDGQHSLLQLENRRFTYRELEAMTSNFQRVLGRGGFGSVYDGFLPDGTQVAVKLRSQSSSQGVREFLTEAQTLTKIHHKNLVSMVGYCKDGECMALVYEHMSEGNLEDKLRGKDHNAGSLTWRQRLRIALESAKGLEYLHKACSPAFVHRDVKTSNILLNANLEAKVADFGLLKAFSQDGDTHVSTARLVGTHGYLAPEYAAALQLTVKSDVYSFGIVLLEVITGQTPILQCPDPTNIIQWARQRLARGNIEDVVDVRMQGEYDVNGVWKAADVALKCTVQAPTQRPTMTDVVMQLQECLELEEQHHL

SEQ ID NO: 627 - DNA, 2736 bp, Oryza sativa
  LOC_Os05g44990.1
atggcggctcggtggtggctgctgctgctgctcggcctcgccgtcgccggcgtcgttcgcggccagggcggcgcgcctgacacgtccggcttcatcagcatagactgcggcttgccggagaagaccagctacgtggacgacgccacgaagctgaagttcacctccgacgacgccttcaccgacgccggcacaatccacaacgtctcgtcggagttcgccacgccgacgacgaccacggacaggagcctgtacaacgtgcgcagcttccccgccggcgcgcgcaactgctacacggtcccgtccgtcgtgccggggtccaagtacctggtccgtgccaagttcttgtacggcaactacgacggcctcaacaagccgccggtgttcgacctccacctcggggtcaacttctggcagacggtgaccgtgccatccgccgactggctggggaacgccgaggtcatcgccgtcgtgccggatgatttcttgcaggtctgcctggtgaacaccggcgccgggacgccgttcatctccggcctggacctgaggcccctgccgagctcgctctacgcgcccgccaacgcgacgcaggggttggtcctgctcgaccggaggaacttcggcgcgagcgggagcaccgtgatcaggtaccccgacgacacgtacgaccgcgtgtggtggccgtggagcaacccgccggcggagtggtcggacatctccacggcggacaaggtccagaacacgatcgcccccgtgttcgacgtgccgtccgtcgtgatgcagacggccatcacgacgcgcaactcctccattcccatccagttctcctgggacaccaaacccaatcacgtctaccctgatcccgggtcgatttttaccttgtatgtcaccgagctggagctcctggccggcaatgccgttcgccagttcaacgtcaccatcaatggcgtgatttggaccaaagccccatacaagccggtttatctgtccaccgacgccatgtacaacggagatcgaccctaccggggcatcacccggtacaacttttctttgaacgccgcgggaagctccacgctgccgccgatactcaacgccgcggaggctttctccgtcatctccacagccgaccttgcaacagacgctcaggatgtttctgccatcactgcaatcaaggccaagtatcaggtgaacaagaattggacaggtgacccatgcgctccaaagacactggcttgggatgggttaacctgcagctatgccatttcaacccctccaagaatcacaggagtaaatatgtcgtatgccggtttaagtggcgatatatcatcttatttcgccaatctaaaagaaatcaagaatttggacttgtcacacaataacttgacaggatcaattcctaatgtcatttcacagctacaatttctcgcggttctagatttgacaggaaaccagcttaatggatcaattccttctagtcttctgaaaagaagtcaagatggctccttgaccctaaggtacggcaataatccaaacctttgcagtaacagcagttcatgccagctcccacaaaagaagagcaactctatgcttgccgtctatgttgctgttccagtagtggtgataggagcagttgcagtgttcctgattttcttcatcaggaagaagaagaacaaatcaaagggtgctgtgaagccacagattttggggaatggcgtgcagtcacacagtcagaatggcagtggagggagcctgctggaactgcacaaccgtcagttcacgtacaaggacttggcagtcataacgaacaacttccagcgagtccttggcaaaggagggtttggccccgtctacgacggcttcttgaaggatggtactcatgtggcagttaaactacgggatgagtcttccagccaaggatatagtgagttcctgacagaggctcagactttaacgaaaattcatcacaagaatcttgttgcattaatcggttactgcaaagatgagatacatttggcacttgtgtacgagcacatgtcagaaggaactctggaagataagcttagaggcaaagatcgcaaaggtagatctttaacatggagggaaaggctccgtatcgtattagaatctgcccaaggactagagtatctacacaaggcatgcagcccacgcttcgtgcatagggatgtgaagtcatcgaacatcttgctgaatgcaaatcttgaggccaaggttgccgattttggcctgacaacggcttttaaatgcgacggtgacacacatgtatccacagtcagggtggttggcacatatggctaccttgcacccgagtatgccacagccctacaagtttcagagaagattgacgtatacagcttcggtgtggtgttgctagaggtgatcacaggacagccgcccattataaagctcccggaacctactactatcatccaatggacccggcaacgcctagcgcgaggcaacatcgagggtgtggtggatgtaaacatgccagacgaccgctatgacatcaactgtatctggaaggtagcagatgtggctctgaaatgcactgcacatgctcctgggcagcgacccacaatgactgacgtggtgacacagctaaaagagtgtctagagcttgaggaaaccagctttaaaggcgacacgagtagcagttatatgtcagggagcagcatagacccaaactcgagttataacacatataccactgagatgagc

SEQ ID NO: 628 - protein, 912 aa, Oryza sativa
  LOC_Os05g44990.1
MAARWWLLLLLGLAVAGVVRGQGGAPDTSGFISIDCGLPEKTSYVDDATKLKFTSDDAFTDAGTIHNVSSEFATPTTTTDRSLYNVRSFPAGARNCYTVPSVVPGSKYLVRAKFLYGNYDGLNKPPVFDLHLGVNFWQTVTVPSADWLGNAEVIAVVPDDFLQVCLVNTGAGTPFISGLDLRPLPSSLYAPANATQGLVLLDRRNFGASGSTVIRYPDDTYDRVWWPWSNPPAEWSDISTADKVQNTIAPVFDVPSVVMQTAITTRNSSIPIQFSWDTKPNHVYPDPGSIFTLYVTELELLAGNAVRQFNVTINGVIWTKAPYKPVYLSTDAMYNGDRPYRGITRYNFSLNAAGSSTLPPILNAAEAFSVISTADLATDAQDVSAITAIKAKYQVNKNWTGDPCAPKTLAWDGLTCSYAISTPPRITGVNMSYAGLSGDISSYFANLKEIKNLDLSHNNLTGSIPNVISQLQFLAVLDLTGNQLNGSIPSSLLKRSQDGSLTLRYGNNPNLCSNSSSCQLPQKKSNSMLAVYVAVPVVVIGAVAVFLIFFIRKKKNKSKGAVKPQILGNGVQSHSQNGSGGSLLELHNRQFTYKDLAVITNNFQRVLGKGGFGPVYDGFLKDGTHVAVKLRDESSSQGYSEFLTEAQTLTKIHHKNLVALIGYCKDEIHLALVYEHMSEGTLEDKLRGKDRKGRSLTWRERLRIVLESAQGLEYLHKACSPRFVHRDVKSSNILLNANLEAKVADFGLTTAFKCDGDTHVSTVRVVGTYGYLAPEYATALQVSEKIDVYSFGVVLLEVITGQPPIIKLPEPTTIIQWTRQRLARGNIEGVVDVNMPDDRYDINCIWKVADVALKCTAHAPGQRPTMTDVVTQLKECLELEETSFKGDTSSSYMSGSSIDPNSSYNTYTTEMS

SEQ ID NO: 629 - DNA, 2625 bp, Setaria italica
  Si024869m
atggcggcttggtcgtggttgcccctgctcgtcgccgtcgccgccgccgccgccgcacttcgcgttcatggccaggtcgcgcctgacagcacagggttcataagcatagactgcggcatcccggagaagagcagctacgtggacggcgccaccaagctgccctacgtctcggacgccggcttcaccgacgccggcgccaaccacaacgtctcggccgagtacatcaacccgtccttctccaggcgctacctcaacgtgcgcagcttccccggcgcgccgcgcagctgctacaccctcggctccctcacgccggggtccaagtacctcttccgcgctgtgttcatgtacggcaactacgacgggctcaacaagccgccggtcttcgacgtccacctcggcgtcaactactggacgacggtgaacgtcaccgccgcctccgctgcggttctggccgaggccatcgccgtcgtcccggacgactccgtgcaggtctgcctggtggacaccggcgctgggacgccgttcatctccgggctggacctgaggccgctgacgagcgcgctgtacccgcaagtgaacgcgacgcaggggctggccgtgctcggccggcgcaacttcgggccgaccaatgctacgctggtggtcaggtacccggatgacccgtacgaccgcgcctggaccccgtggatcgacacggaggagtggtcggagatctcgacgacggagcaggtgggcgggacggccatggcgccgccgtctgccgtgatgcagaccgccatcacacccctcaacgcctccaagaacatcgagttctcgtgggacgccgtgccgaaccacgtctaccccacgtcagggtacatctgcatcttacatgtcgtggagttgcagagtctagacgcgaaggcgacgcgccagttcttcataacgatcaatggcagaactttctaccatctccccgtaacaccgcactacctcttcaccgataccttctataacacagcgccccactggggtttcaaccagtacaaagtcacaatgaacgccacggcgaactcgacgctgccgccggtcatcagcgccgccgagattttctcaatcatatctacagccaacgttggcacgtatggacaggatgtttctgcaattatggcgatcaaggacaactatcagctaaagaagaactggatgggtgacccctgcgttccgaagactcttgcgtgggatgggttgagctgcagctatgacacttccggtcctcctagaatcataactgtaaatctttcatccagtggcttaagtggtgctacatcattgtacttctccaaactcacaacaatccagtacttggatttgtcgcacaataacttgacaggctcaattcctgacgtcctttcacaactgtcctctctgaaggttatagatttgacagacaatcagcttaatggatcgattccatccgggcttctgaaaaggattcaaaatggctccctgaagctgaggtatggagacaacccaaacctttgcagcaatggagattcttgccagctcacaagaaagaagatcaatgcggtatatattgctgttccaatagtgatacttgtggtgattgcagcactggtactattgctttggttactgagaagaaagaaagagaacagtgtgaagccacagaatgaggcgaccgacgcgcggtcacgctcccagagtggtaatggacatgggttgccgcagcttgagaaccgccggttcacgtacaaggagctggagatgatcacgaataacttccagcgcgtgcttggccgaggaggattcgggtctgtctacgatggcttcttggatgatggcacccaggtcgcagtcaagctgcggtctgaatcttccaatcaaggtgtcagagagttcctgacagaggctcagaccttaacaaagatccatcacaagaatcttgtctccttgatcggttactgcaaggatggagagtacttggcacttgtctatgagtatatgtcagaaggaaccctggaggacaaacttagagggaaagatggcaacgctggacctctaacctggagacagaggctccgcattgcactggagtccgcacaagggcttgagtatctgcacaaggcgtgcagcccagctttcgtacacagggacgtgaagacgtcgaacatcctgctaaatgcaaacctcgaggccaagatcgccgatttcggcctgctcaaggccttccgccgcgaagacgacacccatgtgtccacagacagggtggtcggcacacatggctaccttgcccctgagtacgcggcggccttgcagctgacggagaagagcgacgtgtacagcttcggcgtcgtgctgctggaggtgatcacggggaagccgccgatcctgcggtgtccggagcccatcaacatcgtgcagtgggtgcggcagcgccttgcgcgcgggaacatcgaggacgtggtggacgcgggcctgcgtggcggctgctacgacgccaacgccgcgtggaaggccgccgacgtcgcgctcaagtgcaccacgcaggtgcccgcgcagcggcccaccatgaccgacgtggtggcgcagctgcaggagtgcctcgagctcgaggaaggccgc

SEQ ID NO: 630 - protein, 875 aa, Setaria italica
  Si024869m
MAAWSWLPLLVAVAAAAAALRVHGQVAPDSTGFISIDCGIPEKSSYVDGATKLPYVSDAGFTDAGANHNVSAEYINPSFSRRYLNVRSFPGAPRSCYTLGSLTPGSKYLFRAVFMYGNYDGLNKPPVFDVHLGVNYWTTVNVTAASAAVLAEAIAVVPDDSVQVCLVDTGAGTPFISGLDLRPLTSALYPQVNATQGLAVLGRRNFGPTNATLVVRYPDDPYDRAWTPWIDTEEWSEISTTEQVGGTAMAPPSAVMQTAITPLNASKNIEFSWDAVPNHVYPTSGYICILHVVELQSLDAKATRQFFITINGRTFYHLPVTPHYLFTDTFYNTAPHWGFNQYKVTMNATANSTLPPVISAAEIFSIISTANVGTYGQDVSAIMAIKDNYQLKKNWMGDPCVPKTLAWDGLSCSYDTSGPPRIITVNLSSSGLSGATSLYFSKLTTIQYLDLSHNNLTGSIPDVLSQLSSLKVIDLTDNQLNGSIPSGLLKRIQNGSLKLRYGDNPNLCSNGDSCQLTRKKINAVYIAVPIVILVVIAALVLLLWLLRRKKENSVKPQNEATDARSRSQSGNGHGLPQLENRRFTYKELEMITNNFQRVLGRGGFGSVYDGFLDDGTQVAVKLRSESSNQGVREFLTEAQTLTKIHHKNLVSLIGYCKDGEYLALVYEYMSEGTLEDKLRGKDGNAGPLTWRQRLRIALESAQGLEYLHKACSPAFVHRDVKTSNILLNANLEAKIADFGLLKAFRREDDTHVSTDRVVGTHGYLAPEYAAALQLTEKSDVYSFGVVLLEVITGKPPILRCPEPINIVQWVRQRLARGNIEDVVDAGLRGGCYDANAAWKAADVALKCTTQVPAQRPTMTDVVAQLQECLELEEGR

SEQ ID NO: 631 - DNA, 2754 bp, Brachypodium distachyon
  Bradi2g19297.2
atggctgccacgccgtggctgctgctgctgcttctctgcctcgccgccggcggcgttctccaagctcgcgcccagcctgacagcaaaggattcataagcatagactgcggcttgccggggctgaagggctacgcgaacgaaaccaccaagctctcctacgccacggacgccggcttcaccgacgccggcaccaaccacaacatctcggccgagtacgtcacgccgtcgatggccaggagctggtacaacgtgcgcagcttccccgacggcgcgaggaactgctacacgctgcggtccatcgagccggggctcaagtacctggtccgggcaaggttcaagtacggcaactacgacggcctggacagaccccccgtgttcgacctctacgtgggggtcaacttctggacggtggtcaacatgacgacgcgcggcctgacgttgatcgaggaggccatcgtggttgtgcccgacgactacgtccaggtctgcctcatcaacaccggcgccgggacgcccttcatctccgggatcgacctcaggccgctcaagaagacgctctacccgcaggccaccgccgcgcagggccttgtcctgcttgccaggttcaactttggccccaccgacgagaccgccatcgtcaggtaccctgacgatccacacgaccgggtatggttcccatgggtggacgcggcgaacttggccgagataacgacgaagaacagagtgcagaacgtggacaacgacttgttcgaggcgccgacggcggtgatgcagacggcggtgaggccgcggaatgcttctagaaacatcgagttctactgggaagcggaggcccagcctaacgacccgtcgcccgggtacatcgccatcatgcacttctccgagctgcagctcctcccagacaaggccgtgcgcgagttctacgtgaaccttaacggcaagccgtggtaccctgagggctactcgccgcagtacctctacaccggggccacctacaacaccgtcccctccaggcacagccgctacaacatctccatcaacgccaccgccaactccacgctgccgccgatcatcaacgccgtcgagatcttctctgtcatccccaccaccatcatcgccaccgattccaaggatgtatctgccatcatggcgatcaaggccaagtatcaggtgaagaagaactggatgggtgacccctgtgttcccaagactatggcgtgggatagcttgacctgcagctacgccgttgccagcgctccaaggatcataagcgtaaacctgtcctccagtggtctcagtggtgatatatcgtcttctttcgcgaatctcaaggctgtccagtacttggatctgtcaaagaataagttgatgagctcaattccagaatcactttcatcgttaccttcattggcagttctagatttgtcaggaaaccagctcaatggatcaatcccttctggacttctcaaaagagttcaagatggctccctcactctgagatatggtaacaatccaaacctttgcaccaacgaaaattcatgtcaacctactaaaaccaagaggaacagcaagcgggccatctacattgctgtccctgtggttctgcttgtggtgatagtgtcagtgacagtactgctcttgtgtttgctaaaacgaaaacggcacggatcaatgaacaactccgtgaagccgcagaacgagacgacaacaagctatgcgctgggaagtgatgttggtggtgacagttcgctgcgacttgagaaccgccggttcacgtacaaggatcttgagaggataaccaacaacttccagctagtgctcggccggggagggtttgggtatgtctacgatggcttcctggaggacggcacccaggtggcggtgaagttgcggtctcattcttcgagtcaaggtgtcaaggagttcctcgctgaggcacaaattttgacccggattcatcacaaaaatcttgtctccatgattggttactgcaaggatggggaatacatggcacttgtctacgaatacatgtcagaggggaccctgcaagagcatatttcagggctagagtacctacacaaggggtgcaacccgcctttgattcacagggacgtcaaggccacaaacatcttgttgaactcgagattggaggccaagattgccgactttggcttgtccaaagccttcaatggcgatagtgacacccatgtgtccacaaactacatcgttggtacacctgggtatgtggacccggagtaccaggcaacaatgcagccgacggccaagagcgacgtgtatagcttcggagtcgtcctgttggagctagtcacgggcaagccggccatcttgcgagagccagtgcatgtcagcatcatccaatgggcgcgccagcaactggcacggggaaacatcgaggacgtggtggatgcacgcatgtgtggtgattacgatgttaacggggtgtggaaggctgcggacatcgcgctcaagtgcactgcacaggcttcattgcagcggcccaccatgaccgacgtggtggcgcagctgcacgagtgtgtagagctagagaagggacatgttggaggcgacacaaacagtagttcatacaccagcggcaacgtcaacagctcgaccttgagctatggtgcttatgccactaatcaatctgctgatgtgagccaaaacagcgatgcgtttgagatgcagcataacttcaacagggtgccaactatgcccaccggtcctgctgcacgt

SEQ ID NO: 632 - protein, 918 aa, Brachypodium distachyon
  Bradi2g19297.2
MAATPWLLLLLLCLAAGGVLQARAQPDSKGFISIDCGLPGLKGYANETTKLSYATDAGFTDAGTNHNISAEYVTPSMARSWYNVRSFPDGARNCYTLRSIEPGLKYLVRARFKYGNYDGLDRPPVFDLYVGVNFWTVVNMTTRGLTLIEEAIVVVPDDYVQVCLINTGAGTPFISGIDLRPLKKTLYPQATAAQGLVLLARFNFGPTDETAIVRYPDDPHDRVWFPWVDAANLAEITTKNRVQNVDNDLFEAPTAVMQTAVRPRNASRNIEFYWEAEAQPNDPSPGYIAIMHFSELQLLPDKAVREFYVNLNGKPWYPEGYSPQYLYTGATYNTVPSRHSRYNISINATANSTLPPIINAVEIFSVIPTTIIATDSKDVSAIMAIKAKYQVKKNWMGDPCVPKTMAWDSLTCSYAVASAPRIISVNLSSSGLSGDISSSFANLKAVQYLDLSKNKLMSSIPESLSSLPSLAVLDLSGNQLNGSIPSGLLKRVQDGSLTLRYGNNPNLCTNENSCQPTKTKRNSKRAIYIAVPVVLLVVIVSVTVLLLCLLKRKRHGSMNNSVKPQNETTTSYALGSDVGGDSSLRLENRRFTYKDLERITNNFQLVLGRGGFGYVYDGFLEDGTQVAVKLRSHSSSQGVKEFLAEAQILTRIHHKNLVSMIGYCKDGEYMALVYEYMSEGTLQEHISGLEYLHKGCNPPLIHRDVKATNILLNSRLEAKIADFGLSKAFNGDSDTHVSTNYIVGTPGYVDPEYQATMQPTAKSDVYSFGVVLLELVTGKPAILREPVHVSIIQWARQQLARGNIEDVVDARMCGDYDVNGVWKAADIALKCTAQASLQRPTMTDVVAQLHECVELEKGHVGGDTNSSSYTSGNVNSSTLSYGAYATNQSADVSQNSDAFEMQHNFNRVPTMPTGPAAR

SEQ ID NO: 633 - DNA, 2931 bp, Brachypodium distachyon
  Bradi2g38910.1
atggcgcccagctggcccttgctgctgcttcttcttctctgcctcgccggcggcggcatactccaacctcgcgcccagcctgacagcaaaggtttcataagcatagattgcgggtacccaggggagacgagctacatggatgataccacgatgctatcctactccccggatattggcttcatcgactccggcaccaaccacaacatctccggtgagtacgtccggccactgctctcacggcgtgcccacaacctgcggagcttccctgacggcgcacgcaactgctacacactcacctccctggtgtccgggctcaagtacctcatccgtgccagcttcgtctacggcaactacgatggcctcaatcgaccgcccgtgttgttcgacctctacatcggtgtcaacttttggatggcggtgaacatgtcgtcttggtcggacccggcgggtggcgtggtgacagcggaggccattgtcatggtcctagacgactttgtgcaggtgtgcttggtgaacaccggtgccggaaccccgttcatctccgggctggacctgaggccgctcaagacgacactctacccgcaggtcacggcggcgcaggggctggtgatgcttgccaggctcaacgccgccccgactaacaaaacatacattgccaggtaccctgatgacccacatgaccgaatatggttcccatggtacgacgccgtgaactgggctgagatgtcgaccactcagacggtacagaacattgaaaacgacctctttgaggcaccgtcggcggtgatgcagacagcgatcacgccacagaacgcctccaagaacatcgagttctattgggacgcggagcccaagcccaacgacccatcgccagggtacattgccatcatgtacttctccgagctgcagctcctcaatggcaacgatgtgcgccagttctacgtcaacctcaacggcaatccctggtatccgacgggcttcacgccgcaatacctctccaacggtgccacctacaatagctacccctcccatcacagccgttacaacatctccatcaacgccacctccaattcgactctgccgccaatcatcaacgccgttgaggtgttctccgtcgttcccaccaccaacataggaactgactcgcaggatgcaaccgctgtcatggcgatcaaggccaagtatcaggtgcagaagaattggatgggcgacccatgccttccgaagaatatggcatgggatatgatgaattgtagttatgccactcccaacccatcaaggatcacaagcataaacatgtcatctagtggtctgaccggtgatatatcgtcttcttttgcgaagctcaaggctctcctatacttggatctgtcgaacaataatttgacaggctcaattccggatgctctttcacagttaccttcggtgacagttatagatttgtctggcaacaagctgaatggatcaattccccctggacttctcaaaagaattcaagatggctctttggatctaagacatggcaacaatccagacctttgcacaggcagcaactcatgcttgctggccactaaaaggaagaacaaagtggccatctacgttgctgtccctatccttgtcattctagtgatagtatcagcggcaatactagtctttttcttgctaagacgccggaatcagcagcaaggtgagtgcgaggctttctgccattatcaagctcaagcacacataacaaactgtactcatatccgtaccagatctaagaattcaccaaattgcctttctgcatataaaggatcaatgaacaccatgactgccgtaaaaccgcagaacgaggaggcaatgtcgacgacaagctatggcggcggtgatggtgattcactgaggatagttgagaaccgccggttcacatacaaggagcttgagatgataaccaatggcttccagagggtgctcggccagggagggttcggtcgtgtctatgatggcttccttgaagatggcactcaggtggcggtcaagctgcggtctcatgcttccaatcaaggcaccaaggagtttctcgcagaggctcaaattttaacacggattcaccacaagaatcttgtgtccatgattggctactgtaaggatggagagtacatggcacttgtctatgagtacatggcacatggaaccttgcgggagcacattgcaggaagcgatcgcaacggagcatgtttaccttggagacagagactccaaattgcacttgaatctgcacaaggattagagtacctacacaagggttgcaacccgcctctcatccatagagatgtcaaggcgaccaacatcctgctgaatgccaaactcgaggccaggattgccgattttggcttgtcgagggcattcaaccatgacaccgaccccgtttccacgaatactcttgttggtactcctggatacgtggatccagagtaccagatgacgatgcagccaacgaccaagagtgatgtgtacagcttcggcgtggtgctactggaactggtcaccgggaagccagccatcctttcgaatcctgagcccacaaacattatccattgggcacgacagcggctggcgcggggcaacatcgagggcgtggcggacgcacgcatgaatagtggttacgacgtcaacagcgtgtggaaggtggcggagatcgccctcaagtgcaccgctcaggcatcagcgcagcggcccaccatggccgacgtggtggcacagctacaggagtgcgtcgaacttgagaacggccgcgccgtctacaccggcggcggtagcagcagcgttgatgacccgaactggagtcacggtgcttacactagtgggcaatccagtaacgtgagcgacaacactgcatttgagatggagcatagggtgcccacagtggtcaccggtcctgccgtacgt

SEQ ID NO: 634 - protein, 977 aa, Brachypodium distachyon
  Bradi2g38910.1
MAPSWPLLLLLLLCLAGGGILQPRAQPDSKGFISIDCGYPGETSYMDDTTMLSYSPDIGFIDSGTNHNISGEYVRPLLSRRAHNLRSFPDGARNCYTLTSLVSGLKYLIRASFVYGNYDGLNRPPVLFDLYIGVNFWMAVNMSSWSDPAGGVVTAEAIVMVLDDFVQVCLVNTGAGTPFISGLDLRPLKTTLYPQVTAAQGLVMLARLNAAPTNKTYIARYPDDPHDRIWFPWYDAVNWAEMSTTQTVQNIENDLFEAPSAVMQTAITPQNASKNIEFYWDAEPKPNDPSPGYIAIMYFSELQLLNGNDVRQFYVNLNGNPWYPTGFTPQYLSNGATYNSYPSHHSRYNISINATSNSTLPPIINAVEVFSVVPTTNIGTDSQDATAVMAIKAKYQVQKNWMGDPCLPKNMAWDMMNCSYATPNPSRITSINMSSSGLTGDISSSFAKLKALLYLDLSNNNLTGSIPDALSQLPSVTVIDLSGNKLNGSIPPGLLKRIQDGSLDLRHGNNPDLCTGSNSCLLATKRKNKVAIYVAVPILVILVIVSAAILVFFLLRRRNQQQGECEAFCHYQAQAHITNCTHIRTRSKNSPNCLSAYKGSMNTMTAVKPQNEEAMSTTSYGGGDGDSLRIVENRRFTYKELEMITNGFQRVLGQGGFGRVYDGFLEDGTQVAVKLRSHASNQGTKEFLAEAQILTRIHHKNLVSMIGYCKDGEYMALVYEYMAHGTLREHIAGSDRNGACLPWRQRLQIALESAQGLEYLHKGCNPPLIHRDVKATNILLNAKLEARIADFGLSRAFNHDTDPVSTNTLVGTPGYVDPEYQMTMQPTTKSDVYSFGVVLLELVTGKPAILSNPEPTNIIHWARQRLARGNIEGVADARMNSGYDVNSVWKVAEIALKCTAQASAQRPTMADVVAQLQECVELENGRAVYTGGGSSSVDDPNWSHGAYTSGQSSNVSDNTAFEMEHRVPTVVTGPAVR

SEQ ID NO: 635 - DNA, 2838 bp, Brachypodium distachyon
  Bradi2g38947.1
atggcgccgcccagcagctggccgccgtggctgctgctgcttcttcttctctgcctcgccgccggcggcatacttcaatctgacgcccagcctgacagcaaaggtttcataagcatagattgtgggtacacgggaacaagctacgtggatgactccacgacgctatcctactcccctgatgctggcttcaacgacgccggcaccaaccacaacatctccggcgagtacaaccggccactactctcgcggcgctcccaaaacctgcggagcttccctgacggcacccgcaactgctacacgctccgctccctggtgtccgggctcaagtacctcatccgcgccaccttcttctacggcaactatgacggcctcaaccagccacccgtgtcgttcgacctctacatcggcgtcaacttctgggcgtcgccgaacatgtcgtcatggtcggacccgacaggcggcctcgtgacggcagaggccattgtcgtcgttccagatgacttcgtgcaggtgtgcctggtgaacaccggtgccgggacaccgttcatctctgggttggacctgaggccgctcaagaggacgctctacccgcaggccacggcggcgcaggggctggtgatgtttggcaggctcaacgccgccccgactaacaaaacatacattgcgaggtatcccgatgacccacatgaccggatatggtacccatggtacgacgccgagaaatgggccgagatgtcgacgactgagagggtacaaaacattgaaaacgacctctttgaggcaccgtcggcagtgatgcagacggcgatcacaccacggaacgcctccaataacatcgagttctactgggacgcgaagcccaagcccaacgacccgttgccagggtacatcgccatcatgtacttcaccgagctgcaactcctcaacggcaacgatgtgcgccagttctacgtcaacctcaatggcaatccctggttcccagcgggcgtcacgccgcaatacctctccaatagtgccacctataatagctccccctcccgtctcaaccgctacaacatctccatcaacgccacctccaactcaactctgccgcccatcctcaacgccgtcgaggtgttctccgtcatccccaccaccaacatcggaactgactcgcaggatgcatctgcctccatgtcgatcaaggccaagtatcaggtgcagaagaactggatgggcgacccatgccttcccaagaatatggcgtgggataggttgacttgcagctacgccattgacaatccttcaaggatcacaagcataaacatgtcatccagtggtctaaccggtgatatatcgtcttcttttgcgaagctcaaggccctcctatacttggatctgtcaaacaatagcttgacaggctcaattccagatgctctttcgcagttaccttcggtgacagttatagatttgtctggcaaccagctgagtggatcgattccccctgggcttctaaaaagaattgaagatggctctctggatctaagacatggcaacaatccagacctttgcacaggcagcaactcatgccatctggccgctaaaatgaagaacaaagtggccatctacgttgctgtccctatccttgtcattctagtgatagtatcagcggcaatattagtctttttcttgctaagacgccgaaatcagcagcaaggatcaatgaacaacatgaccgcggtaaagccgcaggacctggaggcgatgtcgacggcaagctatggcggcggtgacgatgattcactgaggatagtcgacaaccggcggttcacgtacaaggagctcgagatgataaccaatggcttccagcggatgctcggccagggagggttcggccgtgtatatgatggcttcctggaagatggtactcaggttgcggtgaagctgcgatctcatgcttccagtcaaggcgtcaaggagttcctcgcagaggctcgggtcttaacccgtattcaccacaagaatcttgtgtcgatgattgggtactgcaaggatggggagtatatggcactcgtctatgagtacatggcacaaggaaccctacgggagcatattgcaggaactgatcgcaacagagcgtgtttaccttggagacagagacttcaaatcgcacttgaatctgcgcaagggttggaatacttacacagaggatgcaacccgcctctcatccatagagatgtcaaggccaccaacatcctgttgaatgccagactagaggccaagatcgctgattttggcttatcgagagccttcaaccatgacaccgaccctattcccacaaatacgctcgttggcacccccggatacgtggatccggagtaccaggcgacgatgcagccaacgaccaagagcgacgtgtacagctttggcgtggtgctgttagagctggtcacggggatgccggccgtcctttcagatcctgagcctacaagcatcatccactgggcacgacagcggctggcgcggggcaacatcgagggcgtggtcgatgcgtgcatgcgtggggcttacgacgtcaactgtgtgtggaaggtggcggagatcgccctcgagtgcaccactcaggcatcagcgcaacggcctaccatggctgacgtggtggcgcagctacaggagtgcatagaactcgagaaggaccgtgccgccggattctacaccggcggcagcagcagcagtgtcgatgacccgagttggagttacggtggttacgccagtgggcaattcacttacgtgagcaacagcactgcatttgagatggagcggagggtgccaacagtggtcactggtccggctgcacgt

SEQ ID NO: 636 - protein, 946 aa, Brachypodium distachyon
  Bradi2g38947.1
MAPPSSWPPWLLLLLLLCLAAGGILQSDAQPDSKGFISIDCGYTGTSYVDDSTTLSYSPDAGFNDAGTNHNISGEYNRPLLSRRSQNLRSFPDGTRNCYTLRSLVSGLKYLIRATFFYGNYDGLNQPPVSFDLYIGVNFWASPNMSSWSDPTGGLVTAEAIVVVPDDFVQVCLVNTGAGTPFISGLDLRPLKRTLYPQATAAQGLVMFGRLNAAPTNKTYIARYPDDPHDRIWYPWYDAEKWAEMSTTERVQNIENDLFEAPSAVMQTAITPRNASNNIEFYWDAKPKPNDPLPGYIAIMYFTELQLLNGNDVRQFYVNLNGNPWFPAGVTPQYLSNSATYNSSPSRLNRYNISINATSNSTLPPILNAVEVFSVIPTTNIGTDSQDASASMSIKAKYQVQKNWMGDPCLPKNMAWDRLTCSYAIDNPSRITSINMSSSGLTGDISSSFAKLKALLYLDLSNNSLTGSIPDALSQLPSVTVIDLSGNQLSGSIPPGLLKRIEDGSLDLRHGNNPDLCTGSNSCHLAAKMKNKVAIYVAVPILVILVIVSAAILVFFLLRRRNQQQGSMNNMTAVKPQDLEAMSTASYGGGDDDSLRIVDNRRFTYKELEMITNGFQRMLGQGGFGRVYDGFLEDGTQVAVKLRSHASSQGVKEFLAEARVLTRIHHKNLVSMIGYCKDGEYMALVYEYMAQGTLREHIAGTDRNRACLPWRQRLQIALESAQGLEYLHRGCNPPLIHRDVKATNILLNARLEAKIADFGLSRAFNHDTDPIPTNTLVGTPGYVDPEYQATMQPTTKSDVYSFGVVLLELVTGMPAVLSDPEPTSIIHWARQRLARGNIEGVVDACMRGAYDVNCVWKVAEIALECTTQASAQRPTMADVVAQLQECIELEKDRAAGFYTGGSSSSVDDPSWSYGGYASGQFTYVSNSTAFEMERRVPTVVTGPAAR

SEQ ID NO: 637 - DNA, 2892 bp, Oryza sativa
  LOC_Os01g03370.1
atggagcgttcactgctgccgtggttgcttcttcttctctgcttcgccgacggcgtattccaatctcgtgcacagccagacagcaaaggtttcattagcatagactgtggtatccagccgaacacgagctacgtgcacaacacgaccaagatatcctacgtcgccgacgacgacttcaccgacggcggctccaactacaacgtttcgccggagtacatcaaaccgcagctctcgcagcggtactacaacttgcgtgccttccccgacggtgcgcgcaactgctacacggcccggtcgctggcgcctgggatcaagtacctcatccgcgcctctttcttgtatggcaactacgacggcctcaacaagctgccggtgtttcatctctacattggcgtcaacttctggaccatggtgaacatcacgagcctcggcctcggcggctctcgttatgaggaggccatcgtggtggtgcccgatgactttgtgcaggtctgcctgatcaacactggcaccggcacgcccttcatctcctcgctggagctgaggcctctggacaaaaggctctatccgcaggtgaacgccacgctgggcctcctccagctcaaccgcctcaactttggcccgactgataacagcctcgtcaggtacccagatgacccacatgacagattttggggaaactgggacagctatacatcgagcttatggaaggagatatccacggcgtcgagggtagataacttagacggagacatattcgatgcgccgacggcggtgatgcagacggcagtgacgccgcgcaacgcgtcaggtaacatctacttcttttgggagccttggccgcagccaaacgacccgacgccgccgtacactgtcatcttccacttctccgagctggagatcctcaccaacaacgcctcgcgccagttctacatcaatctcaacggcgaaccgttgatcgatactgcttacgagccgacataccttacagcgagatacttatatggcttggagccccttgaaagaacctccaggtacaatatcaccatcaacgctaccgccaactcgacgctgccgccgctcatcaacgccgccgagattttctcgatcatctccaccgcagtcatcggcacggactcgcaggatgcatcttccatgatggcgatcaaggacaagtaccaagtcaagaagaattggatgggtgacccgtgtatgccaaagacatttgcgtgggacaagctgacctgcagctatcccaattcgagcggtgcaagaatcataagcttaaatctgtcctccagtggtttgagtgctgacatatcatccgcttttgggaatctcaaggctcttcaatacttggatctatcaaacaacagtttgaccggctcaattccggatgtcctctcacaattaccttccttgagagttttagatctgacaggaaatcaactcagtggatcaattccatctggaattctcaagaggattcaagatggctccttaaatgtaagatatggaaataatccaaacctatgcatcaacggcaattcatgcaaggcagctaaaaagaagagcaagctagccatctacacagttattcctgcagttctggttgtattgatagcatcagttacaacactcttttgcctgctgagacgaaaaaagcaaggaccaatgaacaattctctagagcagcaaaacgagatgtcgacatcaacaagccacgtgctgataaatagtggatatggtgacaatgtatcgctgcggcttgagaaccgtcggtttacatataaagaactagagaagataaccaacaaattcaaacgagtgctcggacggggagggttcggatatgtctaccatggcttcttggaggatggcacagaagtggcggtcaagttgcgatctgaatcctcaagccaaggtgctaaggagttcctcatagaggctcaaattttgacccggattcaccataagaatcttgtatctatgatcagttactgcaaggatgggatatacatggctcttgtctacgagtacatgccagaaggaaccctagaagaacatattgtaggggaaaacaaaaaagggaaaatacttaacatggagagagaggctcaatatcgcattggaatctgcacaaggtgtataattctcactataccaatggatccatatgcactgcaacaaacccttttagggctagagtacctacataaagggtgcaatccgcctattattcacagggatgtgaaggcgaccaacatcctactaaacacaaggttggaggcaaagattgccgattttggcttgtccaaggcatccagctatgacaacatcacccatgtatccacgaacgctctcgttggcacacttggatatgtcgatccagagtaccagatgacaatgcaagcaacaacaaagagcgatgtctatagctttggcgtcgtcttattggagctggtcactgggaagccggctatcttgcatgaaccaaaccccatcagcgtcatccactggacacgacaacgtctagcacggggtaacatcgaggatgttgtggacacatgcatgcctagtgattatgatgtaaatggtgtgtggaaggctatggacattgcgttcacgtgcactgcacaagcatcgacacaacgactcactatgactgaagtggtgatgcagttgcaagagtgtctcgagcttgaggatgcacgttgtgctattggcgatgcacacaacgagttctaccctgaccctcggagcgaccacaatttaagttataacacgtatgtctcggaccggtccaacgatgtgagtcaaaatagtggcgtgtctatgatggagcataattttgggagggtgcctacaatggcctccggtcctgctgcacga

SEQ ID NO: 638 - protein, 964 aa, Oryza sativa
  LOC_Os01g03370.1
MERSLLPWLLLLLCFADGVFQSRAQPDSKGFISIDCGIQPNTSYVHNTTKISYVADDDFTDGGSNYNVSPEYIKPQLSQRYYNLRAFPDGARNCYTARSLAPGIKYLIRASFLYGNYDGLNKLPVFHLYIGVNFWTMVNITSLGLGGSRYEEAIVVVPDDFVQVCLINTGTGTPFISSLELRPLDKRLYPQVNATLGLLQLNRLNFGPTDNSLVRYPDDPHDRFWGNWDSYTSSLWKEISTASRVDNLDGDIFDAPTAVMQTAVTPRNASGNIYFFWEPWPQPNDPTPPYTVIFHFSELEILTNNASRQFYINLNGEPLIDTAYEPTYLTARYLYGLEPLERTSRYNITINATANSTLPPLINAAEIFSIISTAVIGTDSQDASSMMAIKDKYQVKKNWMGDPCMPKTFAWDKLTCSYPNSSGARIISLNLSSSGLSADISSAFGNLKALQYLDLSNNSLTGSIPDVLSQLPSLRVLDLTGNQLSGSIPSGILKRIQDGSLNVRYGNNPNLCINGNSCKAAKKKSKLAIYTVIPAVLVVLIASVTTLFCLLRRKKQGPMNNSLEQQNEMSTSTSHVLINSGYGDNVSLRLENRRFTYKELEKITNKFKRVLGRGGFGYVYHGFLEDGTEVAVKLRSESSSQGAKEFLIEAQILTRIHHKNLVSMISYCKDGIYMALVYEYMPEGTLEEHIVGENKKGKILNMEREAQYRIGICTRCIILTIPMDPYALQQTLLGLEYLHKGCNPPIIHRDVKATNILLNTRLEAKIADFGLSKASSYDNITHVSTNALVGTLGYVDPEYQMTMQATTKSDVYSFGVVLLELVTGKPAILHEPNPISVIHWTRQRLARGNIEDVVDTCMPSDYDVNGVWKAMDIAFTCTAQASTQRLTMTEVVMQLQECLELEDARCAIGDAHNEFYPDPRSDHNLSYNTYVSDRSNDVSQNSGVSMMEHNFGRVPTMASGPAAR

SEQ ID NO: 639 - DNA, 2841 bp, Oryza sativa
  LOC_Os05g44930.1
atggagcgttcaacgccgggaacaatggcggcacggtcgtggttgcttctcctctgcttcgtcgccgtcgccaccgccggagtgctccaagctcgtgcccaacctgacagcaacggtttcatcagcgtagactgtggcctcccggggaagacgggcttcgtggacgacaagaccaagatatcctacgcggcggacgacggcttcaccgacggcggcgcgtgccacaacatctcggcggagtacatcacgccggggctcgccaagcgctaccacaccctgcgcagcttcccggacggcaagcgcaactgctacacgctccggtcactcgtcgccgggctcaagtaccttttccgcaccaccttcttttacggcaactacgacggcctcaacaagctacccgtgtttgatctctacgtcggcgtcaactactggacgatggtgaacatcacgggccccggcgacgcggtgatcgtggaggccatcgtcgtcgtgccggatgacttcgtgcaggtctgcctggtgaacaccggcgccgggacgccgttcatctccgggttggacctgaggcctctcaagaacacgctctacccgcagtcgaacgccacgcagggccttgtcctcctcggccggctcaacttcggcccgaccgattacaccgacgtcataaggtacccggatgatccgcacgacaggatatggttcccgtgggtggactcgaccaaatggagccagatatcatcgacgaagaaagtgcaggatctagacaacgacatgtacgagacgccgacggcggtgatgcagacggcgatcacgccgcggaacgcctccaggaacatcgagttctcctgggaccccgtgccgctgcccaacgacccgacgcccgggtacatcgccatcttccacttctccgagctgcagctcctccccggcaacgccgtgcgcgagttctacatcaacctcaacggcaagccgtggtccctgaccgccttcaagccggagtacctctacaacgacgccaccttcaaccggaacccattcctacggtacccgcagtacaacatctccatcaacgccaccgccaactcgacgctgccgccgctcatcaacgccgtcgaggtgttctccgtcatccccactgccaccattggcactgacccagaggacgtggctgcaatcacggcgatcaaggagaagtatcaggtggtgaagaactggatgggtgacccatgtgttccgaagatgcttgcgtgggacaagttgacctgcagctatgccatttctaaccctgcaagaatcattggcctaaacctgtcctccagtggtttgagcggtgaggtatcgtcctatttcgggaatcttaaggctattcaaaacttggatttgtcaaataataaattgacaggtccaattccagacgccctttcacagttaccttcattgacatttctagatttgacaggaaatcaactcagtggatcgatcccgtctggtcttctcaagagaattcaagatggctctctaaatctaagatatggaaataatccaaacctctgcactaatggcgattcatgccagccagcaaaaaagaagagcaagctagctatctacatagttattccaatagttatagttctggttgtggtgataatatcagtggcagtactactttgttgcctgttgagacggaaaaagcaagcaatgagcaattctgtgaagccacaaaatgagacagtgagcaatgtgtcgtcaaatggcggatacgggcatagttcatcactacaacttaagaatcgtcgatttacgtacaatgaacttgagaagataacgaacaacttccagcgggtgcttggccgtggagggtttgggtacgtttacgacggcttcttggaggatggcactcaagtggcagtgaaattgcggtctgaatcttccaatcaaggtgctaaggagttcctcgcggaggctcaaattttaacccggattcatcacaagaatcttgtctctatgattggttactgtaaggatggggaatacatggcacttgtatatgagtacatgtcagaaggaacactacaagaacacattgcaggtaaaaacaacaacaggatatatttaacctggagagagaggcttcgaatagcactagaatctgcacaagggctagaatacctacacaaggcgtgcaacccaccacttattcatagggatgtgaaggcgaccaacatcctattgaacacaaggcttgaggcgaagattgctgactttggcctatccaagacattcaatcacgttaatgacacccatgtatctacgaacacgcttgttggcacacctggatatgtggatccagagtaccaagcaacaatgcaaccaaccaccaagagcgacgtctatagctttggtgttgtcttattggagttgatcacagggaagccgtctattctacgtgaaccagggcccattagcatcatccagtgggcacggcaacgtttggcacgaggtaacatcgaaggtgtggtggatgcacacatgcatggtgaccatgatgtgaatggtgtgtggaaggccgcagacattgcccttaaatgcaccgcacagacatcgacacaacgacccactatgaccgatgtggtagctcagctgcaggagtgcctagagctcgaggataggcgatgtggcatggaagatacatataacaacttctatgccggcaacaacaatgatcccaactcaagttataacatgtacaacacggaccagtccactgatgtgagtcaaaacaacacgatggagcataattttgaaagagtgccaaccatggctacagggccagttgcacga

SEQ ID NO: 640 - protein, 947 aa, Oryza sativa
  LOC_Os05g44930.1
MERSTPGTMAARSWLLLLCFVAVATAGVLQARAQPDSNGFISVDCGLPGKTGFVDDKTKISYAADDGFTDGGACHNISAEYITPGLAKRYHTLRSFPDGKRNCYTLRSLVAGLKYLFRTTFFYGNYDGLNKLPVFDLYVGVNYWTMVNITGPGDAVIVEAIVVVPDDFVQVCLVNTGAGTPFISGLDLRPLKNTLYPQSNATQGLVLLGRLNFGPTDYTDVIRYPDDPHDRIWFPWVDSTKWSQISSTKKVQDLDNDMYETPTAVMQTAITPRNASRNIEFSWDPVPLPNDPTPGYIAIFHFSELQLLPGNAVREFYINLNGKPWSLTAFKPEYLYNDATFNRNPFLRYPQYNISINATANSTLPPLINAVEVFSVIPTATIGTDPEDVAAITAIKEKYQVVKNWMGDPCVPKMLAWDKLTCSYAISNPARIIGLNLSSSGLSGEVSSYFGNLKAIQNLDLSNNKLTGPIPDALSQLPSLTFLDLTGNQLSGSIPSGLLKRIQDGSLNLRYGNNPNLCTNGDSCQPAKKKSKLAIYIVIPIVIVLVVVIISVAVLLCCLLRRKKQAMSNSVKPQNETVSNVSSNGGYGHSSSLQLKNRRFTYNELEKITNNFQRVLGRGGFGYVYDGFLEDGTQVAVKLRSESSNQGAKEFLAEAQILTRIHHKNLVSMIGYCKDGEYMALVYEYMSEGTLQEHIAGKNNNRIYLTWRERLRIALESAQGLEYLHKACNPPLIHRDVKATNILLNTRLEAKIADFGLSKTFNHVNDTHVSTNTLVGTPGYVDPEYQATMQPTTKSDVYSFGVVLLELITGKPSILREPGPISIIQWARQRLARGNIEGVVDAHMHGDHDVNGVWKAADIALKCTAQTSTQRPTMTDVVAQLQECLELEDRRCGMEDTYNNFYAGNNNDPNSSYNMYNTDQSTDVSQNNTMEHNFERVPTMATGPVAR

SEQ ID NO: 641 - DNA, 2895 bp, Oryza sativa
  LOC_Os05g44940.1
atggcggcacggtcgtcgttgtttcttctctgcctcgccaccgccaccgccggcgtactccaagctcgtgcccagcctgacagcaaaggtttcatcagcgtagactgcgggctcccggggaagacgagctacattgacgacaagaccaagatatcctacgcctcggacgacggattcaccgacggcggcaagcactacaacgtctcgccggagtacatcaagccggcggtcacggcgcgctactacaacgtgcgcagcttccccgacggcgcgcgcaactgctacacgctccggtcgctcgtggccggcctcaagtatctcatccgcgccaccttcatgtacggcaactacgacggcctcaacaagctgcccgtgtcgtttgacctccacatcggcgtcaacttctggacggtggtgaacatcacggacccgatccagccggtgaaccgggaggccatcgtcgtcgtgcccgacgactccgtgcaagtctgcctggtgaacaccggcgccgggacaccgttcatctccgggttggacctcaggcctcttatgaacaagctctacccgcaggtgaacgccactcagggcctactccaactcgccaggctcaacttcggcccatctgacgaaacctccatcaggtatccggatgatccgcacgacagagtatggtttccttggtttgatgcggccaagtggaacgagatatcaacgacaaacagggttcagaacatagacaacgacctgttcgaggcgccgacggcggtgatgcagacagcggtcacgccaatcaacgcctccaacaacatcgacttcttctggaactcacagccgcagcccaacgacccagcgccagggtacatcgccatctttcacttctccgagcttgagaacctccccaacaacgccacacggcaattctatatcaacatcaacggcatattgttcgacgatggtttcacaccatcgtttctctacgccgaggcctcctacagctccaaaccctttgtgcgacacccgcagtacaacatcaccattaacgccaccgccaactcgacgatgccgccgctcatcaacgccgtcgaggtgtactctgtcatctccaccgctaacattggcaccgactcacaagatgtatcagcaatcatgacgatcaaggcgaagtaccaggtgaaaaagaattggatgggtgacccgtgcctccctagaaatcttgcgtgggataatttgacctgcagctatgccatttctaaccctgcaagaatcacgagcttaaacctgtcaaaaattggtttgagtggtgagatatcgtcctcttttgggaatctcaaggccctccaatatttggatctatcaaacaacaacttgacaggctcgattccaaatgccctttcacagttgtcttcattgacaatcttcactggtggtgaggacgacgacgggtggctgatggtggacaacaacgatggcgcagctggtggtagacaacgacagcgatggcggacggttgaaggcgcggcgcgcgcggttgagggccgaaggagaagggagcagcgagatttgacaggaaaccaactaaatggaacaattccgcctggacttctcaagagaattcaggatggctttttaaatctaagatatggaaataacccaaatctttgcaccaatggcaactcatgtcaaccaccaaaaaacaagagcaagctagctatctacattgttgttcctatagttctggtcctcgcgatagtatcagtgacgacactactctattgcctactgagaagaaaaaaacaaggatcaatgaacaattctgtaaagcgacaaaacgagacaatgagatatgggccaacaaataatggctccgggcataattcatcactgcggcttgagaaccgctggtttacatataatgaactggagaagataacgaacaaattccagcgagttcttggacaaggaggctttggaaaagtctatgatggcttcttggaggatggcactgaagtggcagtcaaagtgaggactgaatcttccaaccaaggtgataaggagtttcttgtagaggctcaaattttaacccggattcatcacaagaaccttgtctctatgatcggctattgtaaggatgagaaatatatggcacttgtgtatgagtacatgtcagaaggaacccttcaagaacacattgcaggaaaaggaaatgatgggagatacttaacctggaaagagaggcttcgaattgcgctggaatctgctcaagggctagagtacctacacaaagggtgcaaccctcctcttattcaccgtgatgtgaagggaaccaacattttgttgaacacgaggctagaggccaagattgctgattttggtttgtccaaggttttcaatcctgagaacggcacccatgtatctacgaacaaacttgttggcacacctggatatgtggatccagaagaaatactaattgtaagacttattgggactgaccaaatgcgtaggtaccaatcaacaatgcaaccaacgactaagagtgatgtctatagctttggtgttgtcctgttggagttggtaacagggaagccagctatcttgcgtgatccagagcccatcagcatcatccattgggcacaacaacgcttagcacggggtaacattgagggtgtggtgaatgcaagcatgcatggtgactacgatgtgaatggcctatggaaggttgcagacattgcactcaagtgtacggcgctttcgtcagcacaccgccccactatgaccgacgtggtggcacagttgcaagagtgcctcgagctagaggataagcaccaggtcagtgatataaacaatggcttttataatggcaatagtggcgatctaaactctaacttctacaccact

SEQ ID NO: 642 - protein, 965 aa, Oryza sativa
  LOC_Os05g44940.1
MAARSSLFLLCLATATAGVLQARAQPDSKGFISVDCGLPGKTSYIDDKTKISYASDDGFTDGGKHYNVSPEYIKPAVTARYYNVRSFPDGARNCYTLRSLVAGLKYLIRATFMYGNYDGLNKLPVSFDLHIGVNFWTVVNITDPIQPVNREAIVVVPDDSVQVCLVNTGAGTPFISGLDLRPLMNKLYPQVNATQGLLQLARLNFGPSDETSIRYPDDPHDRVWFPWFDAAKWNEISTTNRVQNIDNDLFEAPTAVMQTAVTPINASNNIDFFWNSQPQPNDPAPGYIAIFHFSELENLPNNATRQFYININGILFDDGFTPSFLYAEASYSSKPFVRHPQYNITINATANSTMPPLINAVEVYSVISTANIGTDSQDVSAIMTIKAKYQVKKNWMGDPCLPRNLAWDNLTCSYAISNPARITSLNLSKIGLSGEISSSFGNLKALQYLDLSNNNLTGSIPNALSQLSSLTIFTGGEDDDGWLMVDNNDGAAGGRQRQRWRTVEGAARAVEGRRRREQRDLTGNQLNGTIPPGLLKRIQDGFLNLRYGNNPNLCTNGNSCQPPKNKSKLAIYIVVPIVLVLAIVSVTTLLYCLLRRKKQGSMNNSVKRQNETMRYGPTNNGSGHNSSLRLENRWFTYNELEKITNKFQRVLGQGGFGKVYDGFLEDGTEVAVKVRTESSNQGDKEFLVEAQILTRIHHKNLVSMIGYCKDEKYMALVYEYMSEGTLQEHIAGKGNDGRYLTWKERLRIALESAQGLEYLHKGCNPPLIHRDVKGTNILLNTRLEAKIADFGLSKVFNPENGTHVSTNKLVGTPGYVDPEEILIVRLIGTDQMRRYQSTMQPTTKSDVYSFGVVLLELVTGKPAILRDPEPISIIHWAQQRLARGNIEGVVNASMHGDYDVNGLWKVADIALKCTALSSAHRPTMTDVVAQLQECLELEDKHQVSDINNGFYNGNSGDLNSNFYTT

SEQ ID NO: 643 - DNA, 2826 bp, Oryza sativa
  LOC_Os05g44970.1
atggcggcatggtcgtggttaattctactatgcctcgtcgccgccgccaccgccggcgtgctccaagctcgtgcccagcctgatagcaaaggtttcattagcgtagactgcggcctcccggggaagacgagctacgtggacgacaagaccaagatatcctacgcggcggacgacggcttcaccgacggcggctcgttccacaacatctcggcggagtacatcacgccggcgctctcggcgcgctaccacaacgtgcgcagcttccccgacggcgcgcgcaactgctacacgctccggtcgctcgtggccggcctcaagtacctcatccgcgccaccttcatgtacggcaactacgacggcctcagcaagctgccaatcttcgacgtctacatcggcgtcaacttctggatgatggtcaacatctcggacccctccggcgcgacgctcctggaggccatcgtcgtcgtgccggacgacttcgtgcaggtttgcctcgtgaacaccggcaccgggacaccgttcatctccgggctggacctcaggcctctcgagaagaagctctacccgcaggcgaacgacaagcggggcctgtccttgttcggcagatggaactttggcccaattagtactaccgagttcatcaggtaccccgacgatccacacgacagaatatggatgccttgggtctcgccatcatattgggtcgaggtatcgacgacgaggccggtgcagcacacggacgaggacgtattcgacgcgccgacgaaggtgatgcagacggcgattgcgccgctcaacgcctcgagcaacatcgagttcgcctgggtaccctacacgcagcccaaggacccggcgccggggtacatcaccgtcatgcacttctccgagctgcagctccgctccagcaacgccacgcgccagttctacatcaacctcaacggcaacatggtgtttagccagggctacacgccggcgtacctctacgccgacgccatcttcaacagcaacccgttcctacgatacccgcagtacaacatctccatcaacgccaccgccaactcgacgctgccaccgatcatcaacgccatcgaggtgttctccgtcttctccaccgccaccgttggcacagatggtcaggatgcttccgccatgatggtgatcaaggaaaagtatcaggtgaagaagaactggatgggtgatccgtgcgttccaaagacgcttgcgtgggataagttgacatgcagctatgacagctccaaacctgcaagaatcacagacataaatctgtcatccggtggtttaagtggtgagatatcgtccgcttttgcgaatctcaaggctcttcaaaacttggatctgtcaaacaacaatttgacaggttcgattccagatgcactttcacagttgccttcgttggcagtattagatttgacaggaaatcaactcaatggttcaattccatctggacttctcaaaagaattcaagatggtaccctaaatataaaatacggaaataacccaaacctctgcaccaacgacaattcatgtcagccagcaaaacacaagagcaagcttgccatctatgtagctgttcctgtagttctggttttggtgatagtatcagtcacaatactgctcttttgccttctgggacgaaaaaagaagcaaggatcaatgaacacttccgtaaagccgcagaatgagacagcgagctatgtgccgacaaatggcagccatgggcatggctcatcaatgcagcttgagaaccgacggtttacttacaatgatttagagaagataacaaacaactttcagcgagtgctcggcgaaggagggtttgggaaggtctacgatggcttcttggaagatggcactcaagtggcagtcaaattaaggtctgaatcttccaaccaaggggataaggaatttctcgcagaggctcagattttaactcggattcaccacaagagccttgtatctatgatcggttattgcaaggatgggaaatacatggcacttgtctatgagtacatgtcagaaggaacccttcgagaacatatttcaggtaaaagaaacaacgggagatacttaacctggagagagaggcttcgaatcgcgctggaatccgctcaagggctagagtacctacacaagtggtgcaatccgcctcttattcacagagatgtgaaggctaccaacattctattgaatgcgaagctagaggctaagattgctgattttggcttatccaagacgttcaatcttgagaatggcacacatgtatctacgaacacgcttgttggcacacctggatacgtggatccagagtaccaggcaacaatgcaaccaacgaccaagagtgacgtctatagctttggtgttgtcctattggagctggtcacagggaagccggctgtcctacgtgatccagagcccataagtatcattcattgggcgcaacagcgcctagcacagggtaatattgagggagtggtggatgcacgtatgcatggtgaccatgatgtaaatggtgtatggaaggctacggacatcgcactcaagtgtaccacacaagtatcggcacaacggcccactatgaccgatgtggtggcacaactgcaagagtgcctcgagctcgaggaggggcgttgtgccatcagcaatgcgaacaacaatttctataccgacaataacagcaactctaactcaagttatgacatgtatgccactgaccactctattgatgtaagtcagaacagcgctgcatttgagacggagcgtaattttggaaggatgccatcaacggccaccggtccagctgcacga

SEQ ID NO: 644 - protein, 942 aa, Oryza sativa
  LOC_Os05g44970.1
MAAWSWLILLCLVAAATAGVLQARAQPDSKGFISVDCGLPGKTSYVDDKTKISYAADDGFTDGGSFHNISAEYITPALSARYHNVRSFPDGARNCYTLRSLVAGLKYLIRATFMYGNYDGLSKLPIFDVYIGVNFWMMVNISDPSGATLLEAIVVVPDDFVQVCLVNTGTGTPFISGLDLRPLEKKLYPQANDKRGLSLFGRWNFGPISTTEFIRYPDDPHDRIWMPWVSPSYWVEVSTTRPVQHTDEDVFDAPTKVMQTAIAPLNASSNIEFAWVPYTQPKDPAPGYITVMHFSELQLRSSNATRQFYINLNGNMVFSQGYTPAYLYADAIFNSNPFLRYPQYNISINATANSTLPPIINAIEVFSVFSTATVGTDGQDASAMMVIKEKYQVKKNWMGDPCVPKTLAWDKLTCSYDSSKPARITDINLSSGGLSGEISSAFANLKALQNLDLSNNNLTGSIPDALSQLPSLAVLDLTGNQLNGSIPSGLLKRIQDGTLNIKYGNNPNLCTNDNSCQPAKHKSKLAIYVAVPVVLVLVIVSVTILLFCLLGRKKKQGSMNTSVKPQNETASYVPTNGSHGHGSSMQLENRRFTYNDLEKITNNFQRVLGEGGFGKVYDGFLEDGTQVAVKLRSESSNQGDKEFLAEAQILTRIHHKSLVSMIGYCKDGKYMALVYEYMSEGTLREHISGKRNNGRYLTWRERLRIALESAQGLEYLHKWCNPPLIHRDVKATNILLNAKLEAKIADFGLSKTFNLENGTHVSTNTLVGTPGYVDPEYQATMQPTTKSDVYSFGVVLLELVTGKPAVLRDPEPISIIHWAQQRLAQGNIEGVVDARMHGDHDVNGVWKATDIALKCTTQVSAQRPTMTDVVAQLQECLELEEGRCAISNANNNFYTDNNSNSNSSYDMYATDHSIDVSQNSAAFETERNFGRMPSTATGPAAR

SEQ ID NO: 645 - DNA, 2079 bp, Zea mays
  GRMZM2G701201_T01
atgattattgacgccatcgactggctggtgctatccacgacggaaaaggtgcggaacatatatgatgacctcttcgaggtgccgtcgaaggtgatgcagacggcgatcacgccgcgtgacgctaccagcagcatcaacttctattggaactccaagggctcgtcgcttgggtacataccggtcttccacttctccgaggtgctgcaggcgggcgccggcgttgttcgccagttcaacatcaacatcaacggcaagcggttcacctcccatgattattacacaccacggcacctcgaaagtggctacgtatacggtaccagaccttacaccaaccagatccggtataacgtctccatcgttaagacagacacgtcaacgctcccgcctatcatcaacgccgacgagattttcatcgtcatctctacgaccaacgttggcacggactcggaggacgtctctgctatgaaggctatcaaggcgaagtatcaggtgaagaagaactggatgggagacccgtgcgttgctgggacttttaggtgggatggactgacgtgcagctatgccatttctgatcctccaaaaattactgccctaaacatgtccttcagtggtctgaccggtgacatatcatctgctttcgcaaatctcaaggctgtccaatccttggatttgtcacacaacaacctgacgggctcaatccctagctccctgtcacaactgccgtcactgacaactctagatttgacggggaatcagctcagcggaccaataccctctagtcttctcaaaagaatccaagacggctccttaaacctaatctatgccgataatccagacctttgcaccaacgccggggattcatgtcagacggcgccgcaaggaaagagcaagctagtcatctactacgtcgctgttcctatggctctgatcgtggtggcgttggcagtactgctgtgttgtcttctgcggcggcgaaagacgcgagggctagcggacgtctctgtgaagccccgggacaagactccgacgagccttgcttcaatggcggccgacgaacacagacttagctcgctgcggcttgagaaccgccggttcacatacgaggacctagagatgatcaccgacagcttcaagcgtgtcattggccggggcggctttggatacgtctacgagggcttcttggaggatggcactcaggtggcggtgaagatgaggtctcagtcgtccaatcagggtgccaaggagttcctcacggaggcacagatcttgacacggatccatcacaagaaccttgtctccatggtcggctactgcaaagatggggtgtacatggcgcttgtctacgagtacatgtcagaaggatccctgcaggagcacattgcaggaaaacgcttgacttgggggcagaggcttcgaatcgcattggaatcagcgcaagggctagagtatctgcacaggggctgcaacccgcctctgattcacagggacgtgaagaccagcaacatcctactgaacgcgaaactggaggccaaggttgctgatttcggcatgtcaaaggctctagaccgcgacacctatgcgtccacgaacactcttgttggcacaccaggatacgtcgacccagagtacctggaaacaatgcagccaagcaccaagagcgacgtgtacagtttcggcgtggtgctcctggaactggtcacagggagacctcctatcctgcacagcccacagcccaccagcgtgatccagtgggcacggcagcacctggcgcgcggcgacatcgaggtcgtggtggacgcgtccatgggaggcaaccacgacgtcaacagcgtgtggaaagccgcggaggtcgcgctccagtgcaccgagcaggcgtcggcgcagcgccccaccatgggcgacgtggtggcgcagctcctggagtgcctcgacctcgagaagggccgctccgccaacgaaagtttctgcgacggagacgacagcggctccgcgaccgcgagcttgagccacagcagcgcatttgtgacggggcgtatttttgggacggtgccaatggtggagacaggccctgccacgagg

SEQ ID NO: 646 - protein, 693 aa, Zea mays
  GRMZM2G701201_T01
MIIDAIDWLVLSTTEKVRNIYDDLFEVPSKVMQTAITPRDATSSINFYWNSKGSSLGYIPVFHFSEVLQAGAGVVRQFNININGKRFTSHDYYTPRHLESGYVYGTRPYTNQIRYNVSIVKTDTSTLPPIINADEIFIVISTTNVGTDSEDVSAMKAIKAKYQVKKNWMGDPCVAGTFRWDGLTCSYAISDPPKITALNMSFSGLTGDISSAFANLKAVQSLDLSHNNLTGSIPSSLSQLPSLTTLDLTGNQLSGPIPSSLLKRIQDGSLNLIYADNPDLCTNAGDSCQTAPQGKSKLVIYYVAVPMALIVVALAVLLCCLLRRRKTRGLADVSVKPRDKTPTSLASMAADEHRLSSLRLENRRFTYEDLEMITDSFKRVIGRGGFGYVYEGFLEDGTQVAVKMRSQSSNQGAKEFLTEAQILTRIHHKNLVSMVGYCKDGVYMALVYEYMSEGSLQEHIAGKRLTWGQRLRIALESAQGLEYLHRGCNPPLIHRDVKTSNILLNAKLEAKVADFGMSKALDRDTYASTNTLVGTPGYVDPEYLETMQPSTKSDVYSFGVVLLELVTGRPPILHSPQPTSVIQWARQHLARGDIEVVVDASMGGNHDVNSVWKAAEVALQCTEQASAQRPTMGDVVAQLLECLDLEKGRSANESFCDGDDSGSATASLSHSSAFVTGRIFGTVPMVETGPATR

SEQ ID NO: 647 - DNA, 2805 bp, Setaria italica
  Si021124m
atggtagcaaaaccgtggctgctgcttacctgtctcgccgccgctgccaccgccggagtactccaagctcgagcgcagcccgacagcataggtttcatcagcatagactgtggcctcccggggacggcgggctacgtggacgacaccaccaagctgtcgaccgtcccggacgccggcttcacggacaccggctccaaccacaacatctccgccgagtacatcacgcaggtgccctccaggcgctaccacaacgtgcgcagcttccccgacggggctcggaactgctacacgctccgctccctcgtcgccgggttcaagtacctcgtccgcgccgcgttcatatacggcaactacgacggcctcggccagctgcccatcttcgacctctacatcggcgtcaacttctggggcatggtgaacgtctcgagcccagatggttatgaggtcatggaggccatcgtcgtcgtgcccgacgacttcgttcaggtttgcttggtgaacaccggcaccgggacgccgttcatctcgttgctggacctgaggcctctcaagaactcgctctaccctcaagcaaacgcgatgcagggcttggttcttctcggcaggaccaactttggccctggtacagacggcgtcaggtaccccgacgatccacacgacagagtatggtacccttggatcgacgccgccacctacgacgtgatatcaacgacggagaaggtgcgaaacatagacaacgatctcttcgaggcgccgtcgaaggtgatgcagacggcgatcacgcctcgcaacgccaccaggggcatctacttctactgggacagcaagccgcagcccaaggacccgacgccacaatacaccgccgtcatgcacttctccgagctgcagctcctccccaacaactccgtgcgcgagttctccatccacatcaacggcgagctgtggtccccgggcggcatcacgccggactacctccgcagcaacgccgcctacagtgatgttcccttgccggcgggctccgcccggtacaacgtcaccatcaacgccacggccaactcaacgctgccgcctttcatcaacggcgtcgaggttttctccatcatctcgaccaccaacgctggcacatactcccaggacgtatctgccatcacggcgatcaagacgaagtaccgcgttcagaagaactggaggggtgacccgtgtggtcccaagtcttttgcgtgggacggattgacttgcagctatggtgtatccattcctccaaaaatcaccggcgtgaacatatcattcagtggtttggacggtgatatatcgtcttcattcgcaaatttcaaggccattcgatatttgaatctatcatataacaacttgacaggctcaattcctgatgtcatttcacagctaccttcactaacagttctagatttgacaggcaaccagctcagcggatcaatcccttctggacttctcaaaagagttgaagaaggctccctaaatctacaatatggtaataacccaaacctttgcaccgacgccgagtcatgtaagccgccaaaggggaagagcaagcatgccgtctacattgcagtccctgtagttctgattgtggttataggactactggcggcattattcttttgcttcatgagacggaaaaggcaaggatcaactaccaacactgtgaagcctcagaacgagacgccggcgacgcacccgcagagctcgctgcagcttgagaaccgtcaattcacgtacagggaattagaggtcataacgaacaagttcgagcgtgtgctcggacaaggagggttcggaaaagtctacagtggctctttggcggatggtactccggtggcggtcaagctgcggtctcagacttctaatcagggtgtcaaggagttcctcgcagaggcacagatcttaacacggattcatcacaagaatctcgtgtccatgattggctactgcaaggacgggcaccacatgggacttgtctacgagtacatgtcagagggcaccctgcatgagcagattgcaggaaacggcagtagtagaagatgcttaacctggacgcagaggcttcgaatcgcactcgaatcagcacaagggctggagtatttgcacagggggtgcaatccacctctcattcacagggatgtgaaggcgaccaacatcctgctaaatgaaaaactagaggccaaaattgctgactttggattgtcgaaaacttttaatcacgacagtggcatgcaagtctccacatactcacttgtcggtacacacggataccttgatccagaatactatgcaacacaaaagccgacaacaaagagcgacgtatacagctttggcgttgtgcttctagagctggtcacaggaaaaccggccatcgtgcgtgacccagagcccaccaacataatcgattgggcgcgccggcgcctggcacgcggcaacattgagggcgtcgtggacgcacgcatgcatggcaactacgacgtcaatagcgtgtggaaggtcacggacatcgcgctcaagtgcaccatgcaggcgtcctcgcagcggccttccatgaccgaagtggtagggcagctgcatgagtgccttcagctggaggaggtgcacaccggcgatgccgcaaccggaagcttctacaccggcaccagccgcgacccgaactcaggttacaacgcgtacgccgctgacggcgcccagtccattggcgcgcaccagagcagcaccaccgcatttgagatggaacatgatattgggagggagctaagaatggacacaggtcctgtcgcacga

SEQ ID NO: 648 - protein, 935 aa, Setaria italica
  Si021124m
MVAKPWLLLTCLAAAATAGVLQARAQPDSIGFISIDCGLPGTAGYVDDTTKLSTVPDAGFTDTGSNHNISAEYITQVPSRRYHNVRSFPDGARNCYTLRSLVAGFKYLVRAAFIYGNYDGLGQLPIFDLYIGVNFWGMVNVSSPDGYEVMEAIVVVPDDFVQVCLVNTGTGTPFISLLDLRPLKNSLYPQANAMQGLVLLGRTNFGPGTDGVRYPDDPHDRVWYPWIDAATYDVISTTEKVRNIDNDLFEAPSKVMQTAITPRNATRGIYFYWDSKPQPKDPTPQYTAVMHFSELQLLPNNSVREFSIHINGELWSPGGITPDYLRSNAAYSDVPLPAGSARYNVTINATANSTLPPFINGVEVFSIISTTNAGTYSQDVSAITAIKTKYRVQKNWRGDPCGPKSFAWDGLTCSYGVSIPPKITGVNISFSGLDGDISSSFANFKAIRYLNLSYNNLTGSIPDVISQLPSLTVLDLTGNQLSGSIPSGLLKRVEEGSLNLQYGNNPNLCTDAESCKPPKGKSKHAVYIAVPVVLIVVIGLLAALFFCFMRRKRQGSTTNTVKPQNETPATHPQSSLQLENRQFTYRELEVITNKFERVLGQGGFGKVYSGSLADGTPVAVKLRSQTSNQGVKEFLAEAQILTRIHHKNLVSMIGYCKDGHHMGLVYEYMSEGTLHEQIAGNGSSRRCLTWTQRLRIALESAQGLEYLHRGCNPPLIHRDVKATNILLNEKLEAKIADFGLSKTFNHDSGMQVSTYSLVGTHGYLDPEYYATQKPTTKSDVYSFGVVLLELVTGKPAIVRDPEPTNIIDWARRRLARGNIEGVVDARMHGNYDVNSVWKVTDIALKCTMQASSQRPSMTEVVGQLHECLQLEEVHTGDAATGSFYTGTSRDPNSGYNAYAADGAQSIGAHQSSTTAFEMEHDIGRELRMDTGPVAR

SEQ ID NO: 649 - DNA, 2847 bp, Setaria italica
  Si024174m
atggtggcaacgtcgtggctgctgcttatcggtctcgctgccgctgccatcgctggggtacttcaagctcgagcacagcccgacaacattggtttcatcagcatagactgtggcctgccggggacggcgaactccgtggacgacgccaccaagctgtcgtacgccccggacgccgccttcaccgacgctggttcgaaccagaacatctcggtcgagtacgtcacgtcgactctcgccaagcgctacctcaacgtgcgcagcttccccgacggcgcgcgcaactgctacacgctccgctccctcgtggcggggctcaagtacctcctccgcgccgagttcaggtacggcaactacgacggcctcaacaggccgcccatcttcgacctctacgccggcgtcaacttctggagcagggtgaacgtctcgagcccggaaaccgtgcacaggctggaggccatcgtcgtcgtgccggacgagtacgtgcacgtttgcctggtgaacaccggttcaggaacgccgttcatctccgtgctggagctgaggccgctcaagagctcgctctacccgcaagcgaacgcgacgcagggcctggtcttgttcgcgaggatcaacttcgggcacaccaatgctactgacattgtcaggtatcctgatgatccgcgggacaggttatggctccctttgttcgacgccaccctctgggacgtgatgtcgacgacggacagggtgcagaacctgaacaacgacaaattcgaggcgccgtccaaggtgatgcagacagcgatcatcccgcgcaacgcatccaacaacatcacgttcttctggggctccacgccgcagcccagggacccgacgccggggtacatcgtcatcatgcacttctccgagctccatctcctgaccgggaacgccgtgcgcgagttcttcctcgagaccaacgacgtggtctggaggtcctcgcttggtttcaggccagactaccttttgtctgacgccttctacaccacagctcccttgccagccgccgctcggtacaccgtcaacatcaacgccaccgccaactcgacgctcccgcctttcatcaacgccgtcgaggtttactccgtcatctccaccgccaacgccgcaacggactcctcggacgtatctgccatcacggccatcaaggccaagtatcgggtgaagaagaactgggcgggtgacccgtgtggtccgaagactttcgcctgggatgggttgacttgcagttatggcatatccagtcattcgagaatcaccggcgtaaatatatcctttagcggcctggatggcgatatatcatcttctttcgcaaatctcaaggccgtccaatatttggatctgtcacataacaacttgaccggctcaattccggacgcgctttcacaattaccatcactaacagttctagatttcacaagcaaccagctgagtggatcaattcccattggacttctcaaaagaattcaagatggctccctaactctacgatatggcaataacccaaacctttgcaccaacgccgattcatgtaagccgccaaaggggaagagcaaactttccatctacattgctgtccctgtagttctggttctggtgatagtatcaggggtagcactattctttctcttcatgagacgaaaaaagcaaggatctacgtcgacgaaaaacaccgtgaggcctcaaaacgaaccaccgatgagctatgcaccagcaccactgccaccaggtgatgtgcacgagcagagctcgttgcaccttgagaaccgcaggttcacgtacaaggagctggagatgatcacaaataacttccagcacgtgcttggtcgaggagggttcgggaaagtttataatggcttcttggaggatggcactcaagtggccgtcaagctgcgttctcagtcttctaaccagggtgtcaaagagtttctctcggaggctcagatcttaacacggattcatcacaagaacctcgtttccatgatcggttactgcaaggatgggcagtacatggcacttgtatacgagtacatgtcagaaggcaccctacgacagcagattgcaggaaatggccgccacggaaaacgcttaacctggaggcagaggcttcgaatttcactggactcagctcaagggttggagtatcttcacaaggggtgcaacccacctctcattcatagggacgtgaaggcaactaacattctattgaatgcgaaactggaggccaagattgctgacttcggcttgtccaaggttttcaatcatgacgatgaaactcggatatccatgaacactctcgttggtacacccggatacgtcgatccagagtaccaggcaactgtgcaaccaacaaccaagagtgatgtttacagctttggtgttgtgctgttggagctggtcacaggcaggcaggccatcttgtccgacccggatcctaccagcatcatccaatgggtgcggcgtcgcttggcacgaggcaacattgaggacgttgttgacacgcgaatgcatggagagtatgatgtcaatagtgtgtggaaggtcgctgatattgcactcaagtgcaccatgcaagcaccagtgcaacgacctacaatgaccgacgtggtggcgcaattgcaggaatgcctcgagctcgaggaggggcaccgcactggaggtggtagaaggggcagcttctataccggcagcaacagtgacttcgacttgggctataatgcgtacactactgatagccagtcaactgacgtgagccagaccagcatcgcatttgagatggatcataactttgggaagacgtcaagaatgggtggaggtcctgttgcacga

SEQ ID NO: 650 - protein, 949 aa, Setaria italica
  Si024174m
MVATSWLLLIGLAAAAIAGVLQARAQPDNIGFISIDCGLPGTANSVDDATKLSYAPDAAFTDAGSNQNISVEYVTSTLAKRYLNVRSFPDGARNCYTLRSLVAGLKYLLRAEFRYGNYDGLNRPPIFDLYAGVNFWSRVNVSSPETVHRLEAIVVVPDEYVHVCLVNTGSGTPFISVLELRPLKSSLYPQANATQGLVLFARINFGHTNATDIVRYPDDPRDRLWLPLFDATLWDVMSTTDRVQNLNNDKFEAPSKVMQTAIIPRNASNNITFFWGSTPQPRDPTPGYIVIMHFSELHLLTGNAVREFFLETNDVVWRSSLGFRPDYLLSDAFYTTAPLPAAARYTVNINATANSTLPPFINAVEVYSVISTANAATDSSDVSAITAIKAKYRVKKNWAGDPCGPKTFAWDGLTCSYGISSHSRITGVNISFSGLDGDISSSFANLKAVQYLDLSHNNLTGSIPDALSQLPSLTVLDFTSNQLSGSIPIGLLKRIQDGSLTLRYGNNPNLCTNADSCKPPKGKSKLSIYIAVPVVLVLVIVSGVALFFLFMRRKKQGSTSTKNTVRPQNEPPMSYAPAPLPPGDVHEQSSLHLENRRFTYKELEMITNNFQHVLGRGGFGKVYNGFLEDGTQVAVKLRSQSSNQGVKEFLSEAQILTRIHHKNLVSMIGYCKDGQYMALVYEYMSEGTLRQQIAGNGRHGKRLTWRQRLRISLDSAQGLEYLHKGCNPPLIHRDVKATNILLNAKLEAKIADFGLSKVFNHDDETRISMNTLVGTPGYVDPEYQATVQPTTKSDVYSFGVVLLELVTGRQAILSDPDPTSIIQWVRRRLARGNIEDVVDTRMHGEYDVNSVWKVADIALKCTMQAPVQRPTMTDVVAQLQECLELEEGHRTGGGRRGSFYTGSNSDFDLGYNAYTTDSQSTDVSQTSIAFEMDHNFGKTSRMGGGPVAR

SEQ ID NO: 651 - DNA, 2847 bp, Setaria italica
  Si024720m
atggcaccagcagcggcaaggtcgcggctgctgcttctctacctcgccgtcgccgccaccgccggcgtcctccaagctcgtgcgcagcctgacagcatcggtttcatcagcatcgactgtggcctgccggggacggcgagctacgtggacgacaccaccaagctggcgtacgtcccggacgccgccttcgtcgacaccggctcgaaccagaacatctcggccgagtacatcacgccgacgctcgccaagcgctaccacaacgtgcgcagcttccccgacggcgtgcgcaactgctacacgctccgctccatcgtggcggggctcaagtacctcctccgcgccaccttcaagtacggaaactacgacaagctcggccggccgcccatcttcgacctctacatcggcgtcaacttctggaccatggtgaacatcacggacgccgacagccctgtgcccctcgaggccattgtcctcgtgccggacgatttcgtgcaggtctgcctggtgaacaccggctcagggacgccgttcatctccgggctggacctgaggccgctcaagaccacgctctacccgcaggtgaacgcgacgcagggcctcgtcctctacaacaggttgaacttcggcccgaccaatagcacggcaatcatcaggtaccctgatgatccacacgaccgtgtttggataccttgggtcaacaccgccatctggaactctgtgtcgacgacactgagggtggaggacctagaagacggcgacattttcgaggtgccgaccaaggtgatgcagacggcgatcacgccgcggaacgtgtcccagaacatcgagttctcctgggacccggacccgcagcccaaggatccgacgccgggctacgtcgccaacatgcacttctccgagctgcagcgcctgcccgccaacgccgggcgccagttctacatcaacctcaatggcaagccgtggtacccaaaggcctacaagccaatatacctcatctccgatgccatctacaaccacaaccccgcccggggcttcccccactacaacatctccatcaactccaccgccaactccacgttgccgccgatgatcaacgccgtcgaggtcttctctgtcatctccaccaccaacgttggcacggactcccaagacgtatctgccatcacggcgatcagggccaagtatggggtgaagaagaactggatgggtgacccgtgcgtacccaagactctcgcgtgggatgggttggcatgcagctatgccatttccagtcctccaaggatcaccagcgtaaacctgtccttcagcggcttggacggtgatatatcgtcttctttcgcaaatctcaaggccgtccaatacatggatctgtcacacaacaacttggcaggctcagttcctgactccctttcacaattatcttcactgacatttctagatttgacaggcaacaagctcagtggatcaattccctcgggacttctcaaaagaattcaagacggctccctaaatctaagatatggcgataatccaaacctctgcaccaatggcaactcatgtcagacgacaaaaaggaagaccaagcttgccatctacattgctgttcctgtagttctggttgtggtgacagtatcagtggtagtgctgctcctctgcttctgtagacgtaaaaagcaaggatccacaagcaactctgtgaagcctcagaatgagacgccgatgagccacgcgccagcaggtggcggctcatacccgcagagcacgttgcagcttgagaaccgccgcttcacgtacaaggagctggagatgatcacgaacaacttccagcgcgtgctcggccggggaggcttcggctacgtctacgacggcttcttggaggatggcacgcaggtggctgtgaagctgcggtcagattcttccaaccagggcgtcaaggagttcctcgctgaggcccagaccttgacaaggattcatcacaagaatctggtttcgatgatcggttactgcaaggacggggactacatggcacttgtctacgagtacatgtccgaaggaaccctgcaagagcacatttcaggaaatggccgcaacactgggttcttaagctggagacagaggctcaagattgcactggagtcagcccaagggctggagtatctacacaaggggtgcaacccgcctctcattcacagggatgtgaaggcggccaacatcctactgaatgcaaaactggaggccaagatcgccgattttggcttgacaaaggcttatcatgacaacgatacccatgtatctacaaacacacttgttggtacactcggatacgttgatccagagtaccatacgacgatgcagccaacgaccaaaagcgacgtgtacagcttcggcgtcgtgctgctggagctggtcacggggaggccggccatcctgcgggacccggagccgacgaccatcatccagtgggcgcggcagcgcctcgcgcggggcaacatcgagggcgtcgcggacccacggatgcgcggcgaccacgacgtcaacagcgtgtggaaggccgcggacatcgctctcaagtgcaccgcgcagtcgtcggcgcagcggcccaccatggccgacgtcgtggcgcagctgcaggagtgcctcgagctcgaggaggctcgcgccggcggtggtggtgacgcgaacggcggctacgactacaccggcagcagcagcgacccctactcgggttacaatgcgcacgccgctgatggccattccaccgacgacgtgagccagaccagcaccgggtttgaggtggagcaccactttggaagggtgccaacaatgccgacgggtcctgctgcacgt

SEQ ID NO: 652 - protein, 949 aa, Setaria italica
  Si024720m
MAPAAARSRLLLLYLAVAATAGVLQARAQPDSIGFISIDCGLPGTASYVDDTTKLAYVPDAAFVDTGSNQNISAEYITPTLAKRYHNVRSFPDGVRNCYTLRSIVAGLKYLLRATFKYGNYDKLGRPPIFDLYIGVNFWTMVNITDADSPVPLEAIVLVPDDFVQVCLVNTGSGTPFISGLDLRPLKTTLYPQVNATQGLVLYNRLNFGPTNSTAIIRYPDDPHDRVWIPWVNTAIWNSVSTTLRVEDLEDGDIFEVPTKVMQTAITPRNVSQNIEFSWDPDPQPKDPTPGYVANMHFSELQRLPANAGRQFYINLNGKPWYPKAYKPIYLISDAIYNHNPARGFPHYNISINSTANSTLPPMINAVEVFSVISTTNVGTDSQDVSAITAIRAKYGVKKNWMGDPCVPKTLAWDGLACSYAISSPPRITSVNLSFSGLDGDISSSFANLKAVQYMDLSHNNLAGSVPDSLSQLSSLTFLDLTGNKLSGSIPSGLLKRIQDGSLNLRYGDNPNLCTNGNSCQTTKRKTKLAIYIAVPVVLVVVTVSVVVLLLCFCRRKKQGSTSNSVKPQNETPMSHAPAGGGSYPQSTLQLENRRFTYKELEMITNNFQRVLGRGGFGYVYDGFLEDGTQVAVKLRSDSSNQGVKEFLAEAQTLTRIHHKNLVSMIGYCKDGDYMALVYEYMSEGTLQEHISGNGRNTGFLSWRQRLKIALESAQGLEYLHKGCNPPLIHRDVKAANILLNAKLEAKIADFGLTKAYHDNDTHVSTNTLVGTLGYVDPEYHTTMQPTTKSDVYSFGVVLLELVTGRPAILRDPEPTTIIQWARQRLARGNIEGVADPRMRGDHDVNSVWKAADIALKCTAQSSAQRPTMADVVAQLQECLELEEARAGGGGDANGGYDYTGSSSDPYSGYNAHAADGHSTDDVSQTSTGFEVEHHFGRVPTMPTGPAAR

SEQ ID NO: 653 - DNA, 2910 bp, Oryza sativa
  LOC_Os12g37980.1
atggaggaagccgccgcagcagttcaccggcggtggcggcggcggctgctgccgaagctgatgctactcctgtgcgccgtcgtccatggccagcagccggacagcctcggcttcatcagcatcgactgcggcatccccgacggcggcggctactccgacgagtccacccgcggcctccgctacgtccccgacgccggcttcctcgacgccggcgcgggcctcagcgccggcatcaacccgccctacaccgaccgcgacctcgccgcccgctacctcaccgtccgctacttccccggcgccgcctccgccgccggcgagcggggcggctgctacacgctccggcagctctcgccgggagggaggtacctcgtgagggccaccttctactacggcaactacgacggcgccatcgccatgctccccgtcgtcttcgacctccacctcggcgccaaccggtggaccgccgtcaacgtcaccgccgccgacgccatctacatcttcgaggccgtcgtgtcgccgccggcggacttcctccaggtgtgcctcgtgaacatagggaagggaacgccgttcatctccgggctggacctgaggccgctgaaaccggagctgtatccggaggcgacggcgaaccagtcgctgcttctgctcaaccacgaccgcccgccggcgaggttcgccttcaaccgctaccagttctggcgcccggcgagctactacaaactattcaggtacccattcgatccgtacgaccggctgtggcagccgtacggcgacgacccgtcgtggacgaacatcaccgtcgccgccgccgtcgacgtcaccaacatcagccgctccgacgacccctccccgatcctccgcagcgccgccacgccggcgaacgccaccgtccgccgcctcgacttcccctggagctccgacgacgccgccaccaccacctacctcctgctgctctacttcgccgagctgcagcggctgccggccggcgcagcgcggcggttcgacgtcctcgtcgatggcgacgcctccgccggcggcgggcggcgagggtacacgccccggtacctcgcggcggaggtcgtgaggtcgacggtgcgggcggcgcggccggggcagcggcacgtcgtgtcgctcgtcgccgcgccggactccgcgctgccgcccatcgtcaacgggctcgagatctactcggtgcagccgatgcctgaactcgcgacgaacgacagagacgcgaaggcgatgatggaaattcgcgataactatgaactgaagaagaattggatgggggatccatgtgctccaaaggcatttgcctgggttggattgaactgtggttattcttcatctgatcctgcattggtaacagctttgaatttgtcatcaagcgtgttgattggtccagttaatctttcttttggtgatctgaagtccctgcaatacttggatttgtccaataacagcttatctggcccaatacctgattttctagtgcaaatgccagcactcaagttccttgatttgtcaagcaataaactcagtggatcgattccttctgacttacttcaaaagagagaaaatggatcacttgtattaaggattggcaacaatgcaaatctctgctataatggggctaataatacctgtgctccggagagtaagcaaagcaagagaatccttgtgattgcaatagctgttccaatagttgcagcaactctgctgtttgtggcagcaaaatttatccttcacaggaggaggaataaacaagatacctggatcacaaacaatgcaagacttattagccctcacgaaaggtcgaacgtattcgagaaccggcaattcacctacagggaattgaaactcatgacatcaaacttcaaagaggaaatagggaaaggaggattcggcactgtcttcctaggatatttggaggatggaactccagttgctgtcaagatgtgctcaaaaacatcttctgaaggggataaaaagtttttagctgaggctcagcacctgactagagttcatcacagaaaccttgtttccttgattggatattgcaaggataagaaacatctggcacttgtttatgagtacatgcaaggaggaaacctggaggatcgtttaagaggagaggcctccattgctgcaccactcacctggcatcaacgtctgaagatcgctctcgactctgctcaaggattggagtacctgcacaagtcatgccagcctccattgatccacagggacgtcaagactcgcaacatcctcctctccggcgacctcgacgccaagatcgccgacttcggcctgaccaaggtgttcgccggcgacgtcgtgacccacgtcaccacgcagccggccggcacgctgggctacctcgacccggagtactaccacacctcgcgcctcagcgagaagagcgacgtctacagcttcggcgtcgtcctcctcgagctcgtcaccggccgcccaccggccgtccccctcggcgacggcgacggcggcggcggcgagagcgtccacctcgccgtgtgggcgaggcagcggctggccgagggcgacatcgagagcgtcgcggacgcggccatgggaggctgcttcgaggtgaactcggcgtggaaggtggcggagctggcgctgcggtgcaaggagcggccgtcgcgggagcggccggccatggcggacgtcgtcgccgagctgaaggagtgcctcgagctggaggcgtcacgcgcgctgggacgcggctacagctgctacagcagcggcagcggcggcggcagctcggtggcgacgacgacgacgacgagcggcgccgccaatatcagcgcggcggcgtcggcggcgagtgtcagtgacgcccagatcggcgagctgaggcaggagagcgtgctcgagctgggaccaaga

SEQ ID NO: 654 - protein, 970 aa, Oryza sativa
  LOC_Os12g37980.1
MEEAAAAVHRRWRRRLLPKLMLLLCAVVHGQQPDSLGFISIDCGIPDGGGYSDESTRGLRYVPDAGFLDAGAGLSAGINPPYTDRDLAARYLTVRYFPGAASAAGERGGCYTLRQLSPGGRYLVRATFYYGNYDGAIAMLPVVFDLHLGANRWTAVNVTAADAIYIFEAVVSPPADFLQVCLVNIGKGTPFISGLDLRPLKPELYPEATANQSLLLLNHDRPPARFAFNRYQFWRPASYYKLFRYPFDPYDRLWQPYGDDPSWTNITVAAAVDVTNISRSDDPSPILRSAATPANATVRRLDFPWSSDDAATTTYLLLLYFAELQRLPAGAARRFDVLVDGDASAGGGRRGYTPRYLAAEVVRSTVRAARPGQRHVVSLVAAPDSALPPIVNGLEIYSVQPMPELATNDRDAKAMMEIRDNYELKKNWMGDPCAPKAFAWVGLNCGYSSSDPALVTALNLSSSVLIGPVNLSFGDLKSLQYLDLSNNSLSGPIPDFLVQMPALKFLDLSSNKLSGSIPSDLLQKRENGSLVLRIGNNANLCYNGANNTCAPESKQSKRILVIAIAVPIVAATLLFVAAKFILHRRRNKQDTWITNNARLISPHERSNVFENRQFTYRELKLMTSNFKEEIGKGGFGTVFLGYLEDGTPVAVKMCSKTSSEGDKKFLAEAQHLTRVHHRNLVSLIGYCKDKKHLALVYEYMQGGNLEDRLRGEASIAAPLTWHQRLKIALDSAQGLEYLHKSCQPPLIHRDVKTRNILLSGDLDAKIADFGLTKVFAGDVVTHVTTQPAGTLGYLDPEYYHTSRLSEKSDVYSFGVVLLELVTGRPPAVPLGDGDGGGGESVHLAVWARQRLAEGDIESVADAAMGGCFEVNSAWKVAELALRCKERPSRERPAMADVVAELKECLELEASRALGRGYSCYSSGSGGGSSVATTTTTSGAANISAAASAASVSDAQIGELRQESVLELGPR

SEQ ID NO: 655 - DNA, 2664 bp, Zea mays
  GRMZM2G332280_T01
atgagctcgatgccaattgcatcagcgcccagtcattgggatcgcctgggtggtttcggtttcatcagcatcgactgcggcgtagcggaggcctaccaggacccggacccggacaggggcctcacctacgtctccgacgccggcttcgtcgacgctggcgaggggctcaacgcccccgtgcggccaccgtacgtcgacaagggtctggcccagcggtacctcaacgtccgctacttccccgtcgtcacgggtgccggtgccggcggcggcggcgcggcgcgcacgcgcacgcgcagctgctacacgctccggccggtcgcgcagggaagcaggaacctcgtccgggccaccttctactacggcaactacgacgggttgaactcgcgccccgccttcgacctccacctcggcgtcagtcgctgggccaccgtcaacgtcacctccaacaccggcgtctacatctttgaggcggtgaccgtgtcgccggccgacttcatgcaggtgtgcttggtgaatacggggctgggtacaccgttcatctctgggcttgagctcaggccgctgagtgcgaccatgtaccaggaggctacggccactcagtctctgtttctgctcagcatgtcccgcccatcagccagattctatttcaatcggtaccagttcaagccagacaattccttcccaccattcaggtaccccgatgattcgtacgaccggctgtggcaaaggtacggccgcaacgccgcatggaccaccatgaacacgacgaaggaagtcgacgtctccaacgtcaccggcagcttcgacaagccgtcggagatactgcagaacgccgccactccggtggcgaacggagctaaccggatggacttctcatggagctcagatccctcactggagcaggacgcgaacgccgacggcaacgcaacaacctaccttttgatcctctacttcgcggagcttcagagggtgccgagcgacgggctgagacagttcgacatcctcatcaacaatgcgacagggaatgacggcagcagccagggctttacccccaggtacctctccgcggcggctgtaaagcggacggtgcaggggcctgggcagcacaacgtctcgcttgtcgccacaccggcggccacgcttccccccattctgaacgcgtttgagatatatgcagtgaagccgatgactgagatgccgacggatgatgtcgatgcaaaagctatgatggcaattcgagaatgctatgcactggaggaaaactggaagggtgatccttgtgcaccaagagcatttgcatgggatggcttgaactgcacctatccaccatctattcctgcacagataacagctctgaacttatcatcgagtaggttgactggtgcaatcaattcttcttttggagatctaaaatccctccaacggctagatctgtcaaagaatagcctatctggtccagtgccaggtttcctggcgcaaatgccatcactgttattcctgatggataacaacgcaaatttgtgcgacaatggtccttccacatgtgatcaggagaagaaaagaaacagaacacttatcattgcaacagttgttccaatagttgtagcagctctactgttcgttgcaggattacttatcctacgtagaatgagaaatagacaagatacatggatgccaaacaactcaaggtttactagccctcaagccagttcacacatatttgagaacagaaagttcacctacaaggagctgaagctcatgacagctaacttcagagaagaaatagggaggggagggtttggtgccgtcttcctaggatacttggagaatggaaatccagttgccgtcaagatgcgttcaaagacatcctctcaaggggataaagagtttctagctgaggttcagcatttgactagagttcatcacaaaaatctggtctccttgattggatattgcaaggacaagaaacatctggcccttgtctatgaatacatgcagggaggaagcctagaggactgtctaagaggagaagcctctgctgctacacccctcacttggcatcaacgtctcaagatcgctctcaactctgctcaagggttggagtacctacacaaatcatgccagccaccactgatccacagggacgtgaagacgaagaacattcttctatccgctgatctcgaggccaagatagcggacttcgggctcatgaaggcgttcgctgacgagttcaggacccatccaccagcggtccccgtaagcgacgccgagagcgtccacgtcgcgctgtgggtgcgccggaggctctcggagggcgacatcgcgagcgtcgctgacccgaggatgggaggggcgtacgacgtcaactccgtctggaaagtcgcggagctgggactcaggtgcaaggaacagccgtcgagggagcggccggcgatgaccgacatcgtggcggagctcagggagagcttgcagctggaggtgtcctatgcgatgggctactacagcagctcggtctctaccagcgcaatcgatctcagcacagcaagtgctggtttgcaaagcgatgagaaacccagcgaccgtctggggcaaaaagctgcacttgagttgcaacagcaacatgtagacagtgaatcatcggcaactgtaggtcctgcaccaaga

SEQ ID NO: 656 - protein, 888 aa, Zea mays
  GRMZM2G332280_T01
MSSMPIASAPSHWDRLGGFGFISIDCGVAEAYQDPDPDRGLTYVSDAGFVDAGEGLNAPVRPPYVDKGLAQRYLNVRYFPVVTGAGAGGGGAARTRTRSCYTLRPVAQGSRNLVRATFYYGNYDGLNSRPAFDLHLGVSRWATVNVTSNTGVYIFEAVTVSPADFMQVCLVNTGLGTPFISGLELRPLSATMYQEATATQSLFLLSMSRPSARFYFNRYQFKPDNSFPPFRYPDDSYDRLWQRYGRNAAWTTMNTTKEVDVSNVTGSFDKPSEILQNAATPVANGANRMDFSWSSDPSLEQDANADGNATTYLLILYFAELQRVPSDGLRQFDILINNATGNDGSSQGFTPRYLSAAAVKRTVQGPGQHNVSLVATPAATLPPILNAFEIYAVKPMTEMPTDDVDAKAMMAIRECYALEENWKGDPCAPRAFAWDGLNCTYPPSIPAQITALNLSSSRLTGAINSSFGDLKSLQRLDLSKNSLSGPVPGFLAQMPSLLFLMDNNANLCDNGPSTCDQEKKRNRTLIIATVVPIVVAALLFVAGLLILRRMRNRQDTWMPNNSRFTSPQASSHIFENRKFTYKELKLMTANFREEIGRGGFGAVFLGYLENGNPVAVKMRSKTSSQGDKEFLAEVQHLTRVHHKNLVSLIGYCKDKKHLALVYEYMQGGSLEDCLRGEASAATPLTWHQRLKIALNSAQGLEYLHKSCQPPLIHRDVKTKNILLSADLEAKIADFGLMKAFADEFRTHPPAVPVSDAESVHVALWVRRRLSEGDIASVADPRMGGAYDVNSVWKVAELGLRCKEQPSRERPAMTDIVAELRESLQLEVSYAMGYYSSSVSTSAIDLSTASAGLQSDEKPSDRLGQKAALELQQQHVDSESSATVGPAPR

SEQ ID NO: 657 - DNA, 2712 bp, Oryza sativa
  LOC_Os02g05730.1
atggtcattactggccgtctccggccagcggcctcatctgagcgccgacttcgatgcctcgacgtcgtcggaggtggaagggggacgcccccagccacgcgacgcgacgggcccctgagcggctgcgctgggtccccgaagtcgccgcgcgcgtcgtcgccttcgtcaggttcaggtttcataagcatcgattgcggcattccagagaaatcgtcctatcaagatcccacatcaagtataatatatgtttcggactatggtttcatcagcacaggagcaaaccataacatctcctcagcatacattaaaccatcactggcacagcgcaattacaatgtccgattctttccagatggcacacggaactgctacaccctgaggtccttgcaggagggaaacaagtactttgttcgagctgtcttctactatgcaaattacgatagcctgaacaagcttcctgtctttgatctgtacctgggggcaaactactggcatgaggttaagtttagtaatgccgatgcagttaattggatggacatcatagttgtggctcctgctgattacctgcaagtctgtttggtgaacaaagggacgggaactccgtttatatctgggcttgatttgaggccactgaagagtactctttacccagaggcaaatacaactcaatctttggtgctgatcaattccaatcggttcaacatgggacccacagacaattcaataaccagatacccacttgatccccacgaccggctttggtcaacatatgatacgatcccagactggactgagatatctgcaacatcagtagttcagaattacctcactgatgtctatgatgtaccatcagctgtcatgcaaagtgcagcaacagttaatagctcgagaattaatttcacttgggatccatctgacccatcggtgaacatcagctccaaatacttctttgtgctctacttctccgagttacagtctgtaccgagcaatgggctgagacagtttgatattattgtcaataacaatacatggaacacacaaccttatactccaccattcctatttgccgattccttgtctggcaccgtacaggggctggcaagttatagtgtctcacttgttgctacgaaaaatgcaactcttccacctatcctcaatgccatggagatgtacttggtgaaaccgctaactgagtttgcaactgatcctagagacgctagagccatgatggaagtccaacaaaattatgatgtgaagaaaaactggatgggcgatccatgtgctccaaaagcttttgcatgggaaggattaaactgttcctatcctccagctgattcctctaaaataacatcactaaacttgtcttccagtgggttggctggatctattgctacttattttggagatctcaaatcactccagtacctggacctgtccagcaatgatctcagtggaccaattccttacaatcttcttcaaaaatcacaaaatggttctttgtcactaagggttggttataatgcaaaactatgtggcaacgatactgaatgcggatcaggtcaaaagaaaattaaagggtcacttctttctgcaataattattacaatagttgccactgttgcactaattgttgtcttatttcttcttctgcgccgaatgctcaaggcaaaagacaagagaagagctgctggtcctacatatgaatcagcattacttgagaacagagaattctcttacagagaactgaagcatattacgaataactttagccagcaggttggtaagggtgggtttggagctgtgttccttggttacttggaaaatggtaacccagttgctgtgaaagtgcgatccgagtcatcttcacaggggggtaaagagtttctagctgaggcccaacatttgacaaggattcatcacaagaatttggtttccttgattggttattgcaaggacaaaaatcatttggcccttgtgtatgagtacatgccggaagggaaccttcaggatcatctgagagctactactaataagccactcacttgggagcagcgtcttcacatcgcccttgatgctgcacaaggattggagtatctgcatgtcgcgtgtaagccagcactgattcacagggacgtgaagagtaggaacatcctcttgaccacaaatcttggagctaagatcgctgattttggactgaccaagttctaccaagtaactgaacttccatgtcatattctgcccatcttgttcaggtactaccgcaattatcatatcagcgagaagagcgacgtgtacagcttcggtgtcgtcctcctggagctgatcacaggccgccctcccgtcatccccatcgacgagagcgtgagcatccacattggtgagtttgtgcatcagagcctcgaccacggcagcatcgagagcattgtggatgcaaggatgggaggagggggaggctacgacatcaactcggtctggaaagtcgctgacttggcgctgcattgcaagcgagaggtctccagggagcggcctacgatgacagaggtggtggcacagcttaaggagagcttggagctcgagagccatggcgataggaagcacttggtgactggtgatgatgacgtgagcgtgagcaatcttggagaggagactgcacttgaggtagaagagcaatctggggagatatcaagagtttctcctgggcctgcagtaaga

SEQ ID NO: 658 - protein, 904 aa, Oryza sativa
  LOC_Os02g05730.1
MVITGRLRPAASSERRLRCLDVVGGGRGTPPATRRDGPLSGCAGSPKSPRASSPSSGSGFISIDCGIPEKSSYQDPTSSIIYVSDYGFISTGANHNISSAYIKPSLAQRNYNVRFFPDGTRNCYTLRSLQEGNKYFVRAVFYYANYDSLNKLPVFDLYLGANYWHEVKFSNADAVNWMDIIVVAPADYLQVCLVNKGTGTPFISGLDLRPLKSTLYPEANTTQSLVLINSNRFNMGPTDNSITRYPLDPHDRLWSTYDTIPDWTEISATSVVQNYLTDVYDVPSAVMQSAATVNSSRINFTWDPSDPSVNISSKYFFVLYFSELQSVPSNGLRQFDIIVNNNTWNTQPYTPPFLFADSLSGTVQGLASYSVSLVATKNATLPPILNAMEMYLVKPLTEFATDPRDARAMMEVQQNYDVKKNWMGDPCAPKAFAWEGLNCSYPPADSSKITSLNLSSSGLAGSIATYFGDLKSLQYLDLSSNDLSGPIPYNLLQKSQNGSLSLRVGYNAKLCGNDTECGSGQKKIKGSLLSAIIITIVATVALIVVLFLLLRRMLKAKDKRRAAGPTYESALLENREFSYRELKHITNNFSQQVGKGGFGAVFLGYLENGNPVAVKVRSESSSQGGKEFLAEAQHLTRIHHKNLVSLIGYCKDKNHLALVYEYMPEGNLQDHLRATTNKPLTWEQRLHIALDAAQGLEYLHVACKPALIHRDVKSRNILLTTNLGAKIADFGLTKFYQVTELPCHILPILFRYYRNYHISEKSDVYSFGVVLLELITGRPPVIPIDESVSIHIGEFVHQSLDHGSIESIVDARMGGGGGYDINSVWKVADLALHCKREVSRERPTMTEVVAQLKESLELESHGDRKHLVTGDDDVSVSNLGEETALEVEEQSGEISRVSPGPAVR

SEQ ID NO: 659 - DNA, 2679 bp, Zea mays
  GRMZM2G093490_T01
atgaagctgagtgctgctgttctcttcttctccatcttgttgcagtactgcaccagcagcggccagccagatagccgaggtttcataagcatcgactgcggcatcccggagaactccacgtaccaggacctcacctccaccatactctacgtctccgaccgcggcttcgtcacctccggcgagaaccgcaacatctccgccggctacatcagcccgtccctcgcgcagcgctactacaccgtccgcgccttcgcgtccggcgttcggaactgctacaccctcccctccctggtcgccgggaacaagtacctcgtccgcgccgccttctactacgcggactacgacggcctgagcacgccgcccgtcttcgacctgtacctgggcgcgagcctctggcacgaggtcaggttcagggacgcggccgcgatcaactggatggacgtcgtggccgtggctcccaccgacttcctgcaggtctgcctggtgaacaagggcaccggcaccccgttcatctccggcctggacctcaggccgctgcggagcactctttacccggaggcgaacgctagccagtcccttgtcatggtcaacgccaaccggtgcaacgtgggacccacggacaagtctgtggttcgcccaaccaaagcacatttctctggcccaacaagcaggtacccgctggacccccacgaccggatctggctggcgtacggcgccgtcccggcctggaccgaggcgtccgccacgtccgtcgtccggaactacctcgccgacccctacgacgcgccgtccgccgtcatgcagagcgccgcgacgccatccgacggctcggtgctcagtttctcgtgggacacgtccgacgaccgctccgtggacgccagcagcgccacgtacctcctcgtcctctacttcgccgagctgcagcgcgtgtcggcgagcggcgagctgcggcggcagttcgacatcgccgtcgacggcaccgcgtggaacagggaaccttactctccgccgtacctcttcgccgactccttctccggcacggtgcaggggcaggcgaggcatagcgtctcgcttactgcgacgaggaacgcgacgctcccgcctcttctcaacgccatggaggtgtacttggtgaggccggtggatgaagctgcaaccgaccctggagatgctaaagccatgatcgcaatccaagaagcttatgttgtgagcaaaaactggatgggtgatccatgtgctccaaaggcttttgcatgggaaggactggactgtactactgatcctccaactggtactccaagaataacagcattccttttatttcctgaactcggacatgaaattaagctgacaaatagtaccactgaaacattcgagctatttcttacaagaactgttacatataccagggacttgtcacacaataacttgtctggctccattccagattgtcttggacagcttccattcctagtgttcctggatctctccagcaatgacctccgtggaccagttccttacactcttcttcaaaaatcccacaatgggactctatcgctaaggcttagtaacaacccaaatttgtctgggaacggatcgggtccaaagaagttgaatggggccgcacttctctccgcgataatcatcccaacagttgccgccactgccttgtctgttaccttcattgctctgctgctccgagcactcaaggaacaagctagaagacgggctgttgatccaactccgagagatgagacggcgttgcttgagaaccgagaattctcttacagagaactgaagcacatcacgaagaactttagcctggagattggcagaggtgggtttggagctgtcttccttgggtacctggggaacggaaacccggtagctgtgaaaatccggtcggagtcgtcttcgcaagggggtaaagagtttctggctgaggctcaacatctgacgagggtacaccacaagaacctggtatccttgattggctactgtaaggacaaagaccatttcgcccttgtctacgagtacatgcctgaagggaacctgcaggatcatctgagactgagaggtctggagtacctgcatgtggcatgcaaaccagcgctgatccacagagacgtgaagagcaggaacatcctcctgaccacgggccttggggctaagatcgccgactttggtctgaccaaggctttcagcgactcggagacacacatcaccactgaaccagctggaacaatgggctacttggatccagagtacgtctcaggccagtccccggtcgtcccggtggacgacagcgtgagcgtccacgtcggcgagtgggtgcagcagagcctcgaccggggcggcggcgtcgagagcgtcgtggatccgagcatgggacggtgcgagcgcggcgactacgacgtcaactccgtctggaaagtcgccgacctcgcgctgcgctgccggcgggaggcctccagggagcggcctacgatgacggacgtggtcgcgcagatcagggagagcgtggagctcgaggcggcccgccggagctcggcgtcgggtgctgctgctgctggtggtggtgggggtctgaggagttgtgccggcgagagggacgcgtttgaggtggtggaaggaagcgttggggagacggcgggggccgcgcctggtccggcgatgatc

SEQ ID NO: 660 - protein, 893 aa, Zea mays
  GRMZM2G093490_T01
MKLSAAVLFFSILLQYCTSSGQPDSRGFISIDCGIPENSTYQDLTSTILYVSDRGFVTSGENRNISAGYISPSLAQRYYTVRAFASGVRNCYTLPSLVAGNKYLVRAAFYYADYDGLSTPPVFDLYLGASLWHEVRFRDAAAINWMDVVAVAPTDFLQVCLVNKGTGTPFISGLDLRPLRSTLYPEANASQSLVMVNANRCNVGPTDKSVVRPTKAHFSGPTSRYPLDPHDRIWLAYGAVPAWTEASATSVVRNYLADPYDAPSAVMQSAATPSDGSVLSFSWDTSDDRSVDASSATYLLVLYFAELQRVSASGELRRQFDIAVDGTAWNREPYSPPYLFADSFSGTVQGQARHSVSLTATRNATLPPLLNAMEVYLVRPVDEAATDPGDAKAMIAIQEAYVVSKNWMGDPCAPKAFAWEGLDCTTDPPTGTPRITAFLLFPELGHEIKLTNSTTETFELFLTRTVTYTRDLSHNNLSGSIPDCLGQLPFLVFLDLSSNDLRGPVPYTLLQKSHNGTLSLRLSNNPNLSGNGSGPKKLNGAALLSAIIIPTVAATALSVTFIALLLRALKEQARRRAVDPTPRDETALLENREFSYRELKHITKNFSLEIGRGGFGAVFLGYLGNGNPVAVKIRSESSSQGGKEFLAEAQHLTRVHHKNLVSLIGYCKDKDHFALVYEYMPEGNLQDHLRLRGLEYLHVACKPALIHRDVKSRNILLTTGLGAKIADFGLTKAFSDSETHITTEPAGTMGYLDPEYVSGQSPVVPVDDSVSVHVGEWVQQSLDRGGGVESVVDPSMGRCERGDYDVNSVWKVADLALRCRREASRERPTMTDVVAQIRESVELEAARRSSASGAAAAGGGGGLRSCAGERDAFEVVEGSVGETAGAAPGPAMI

SEQ ID NO: 661 - DNA, 2619 bp, Setaria italica
  Si016287m
atgaagctatgtgttgcagttctcctattctgcatcttgaagcataccagtggccagcctgatagccgaggtttcataagcattgattgtggcatccgggagaactcttcgtaccaagatctcgcttcaagcatagtatatgtctcagaccatgattttatcagctcaggacaaaaccgcaacatctcttcaaactacatcaaaccatcgctagcatggcgcaattataatgtccgcttctttccagatggcacgaggaattgctacaccttgagatccttggttgcaggaaacaagtactttgttcgtgcaaccttctactatggaaactacgatggcctgaacaagcttcctgtatttgatctgtacctggggacaaattattggcatgaagttcagttcagtggtccaacttcagttaattggatggacatcatagttgcagctcctgctgattacctgcaagtttgtttggtgaacaaagggatgggaactccatttatatctgggctggatttgaggccattgaagagtactctttatccagagtcaaattctagtcaatctcttgtgctgatcaattctaatcggtttaacatggggcccacagacaattccatagtccggtacccgttggatccccacgatcgcctctggtccacatatgacacaatcccaagctggaaagagacatccgcaacatctgttgttcagaattacctaactgatgcctacgatgtgccatcagctgtcatgcaaaatgccgcaacacctgtcaatggctcaagaattgatttctcatgggatccatctgatccctcagtcaatatcagctccagatacttctttgttttctactttgctgagttgcagagtgtagcaagcaatacactgcgacagtttgatatcattgtcaataacagcacatggaacacaaaaccttacactccacctttcctctttgccgattccatttctggcattgttcaggggcaggaaacgtataacatctcacttgttgctacaaaaaatgcaacgctcccacctattctcaatgccatggagatgtatttgatgaaaccaataactgagactgcaaccaatcctggagatgctagagccatgatggcaatacaagaaacttttggtgtgagcaaaaactggatgggtgacccatgtgctccaaaagcttttgcatgggaaggattgaactgtacctatcctcgagctggtctctcaagaataacagcattaaacttgtcttcgaatgggttggctggctccattactacttattttggagatctaaaagcactccagtacctggatctctccagcaatgatcttagtggaccaattccttacagtcttcttaaaaaatcgcaaaatgggactctatcaataaggctcggtaataatgcaaacttatgtgggaatggtaccacctgtggatcaggtcgaaagaaaattaatggggcaattcttactgccataatcattccaacagttgccgttattgccttatttgttatctcaatttttctgctgtgccgaatactcaaggaaaaagctaagagaagggctagtagtcccaaagatgaaacagcattacttgaaaaccgtgaattctcttacagagaactaaagcatattacgaataattttagacaagagatcggcaaaggtgggtttggagctgtcttccttggttacttggagaatggaaacccagttgctgtgaaagtgcgctcagagtcatcttcacaagggggtaaagagtttctggctgaggctcagcatttgacaaggatacatcataagaacttggtgtccttgattggctattgcaaggacaaaaatcatttggcccttgtctacgagtacatgcctgaagggaacctgcaggatcatctgagagacacttctactagtaaatcactcacttgggagcaacgtcttcaaatcgcccttgatgctgctcaaggtctggagtacctgcacgttggatgtaagccagcattgatccacagagatgtgaagagtaggaacatcctcttgaccacagaccttggtgctaaaattgctgattttggtctgaccaaggctttcagtgactcaaaaacacatatcactactcaaccagctggtacaatgggctacttagatcctgagtattaccgaagttaccacatcagcgagaagagtgacgtctacagctttggtgttgttctcctggagctcatcaccggccattcccccgtcgtgccaataaacgacagcgtgagcatccacattggcgagtgggtgcaccaaaacctggatcaaggcagcatcgagagcatcatagactcatcgatgggaggcgattacgacatcaactccatctggaaagttgccgacctggcactgcattgcaagcaagaagtgttcagggagcggcctacgatgacagacgttgtggtgcggatcaaggagatcatggagctcgaggcccgccgtgatcgagagatgaacccagcgttggctgggggtgatcagagctatgccggcgagacaagtgtgtctgaggtagaaggaagcgttgggatatcagaggcttcgcctggtccggctatgaga

SEQ ID NO: 662 - protein, 873 aa, Setaria italica
  Si016287m
MKLCVAVLLFCILKHTSGQPDSRGFISIDCGIRENSSYQDLASSIVYVSDHDFISSGQNRNISSNYIKPSLAWRNYNVRFFPDGTRNCYTLRSLVAGNKYFVRATFYYGNYDGLNKLPVFDLYLGTNYWHEVQFSGPTSVNWMDIIVAAPADYLQVCLVNKGMGTPFISGLDLRPLKSTLYPESNSSQSLVLINSNRFNMGPTDNSIVRYPLDPHDRLWSTYDTIPSWKETSATSVVQNYLTDAYDVPSAVMQNAATPVNGSRIDFSWDPSDPSVNISSRYFFVFYFAELQSVASNTLRQFDIIVNNSTWNTKPYTPPFLFADSISGIVQGQETYNISLVATKNATLPPILNAMEMYLMKPITETATNPGDARAMMAIQETFGVSKNWMGDPCAPKAFAWEGLNCTYPRAGLSRITALNLSSNGLAGSITTYFGDLKALQYLDLSSNDLSGPIPYSLLKKSQNGTLSIRLGNNANLCGNGTTCGSGRKKINGAILTAIIIPTVAVIALFVISIFLLCRILKEKAKRRASSPKDETALLENREFSYRELKHITNNFRQEIGKGGFGAVFLGYLENGNPVAVKVRSESSSQGGKEFLAEAQHLTRIHHKNLVSLIGYCKDKNHLALVYEYMPEGNLQDHLRDTSTSKSLTWEQRLQIALDAAQGLEYLHVGCKPALIHRDVKSRNILLTTDLGAKIADFGLTKAFSDSKTHITTQPAGTMGYLDPEYYRSYHISEKSDVYSFGVVLLELITGHSPVVPINDSVSIHIGEWVHQNLDQGSIESIIDSSMGGDYDINSIWKVADLALHCKQEVFRERPTMTDVVVRIKEIMELEARRDREMNPALAGGDQSYAGETSVSEVEGSVGISEASPGPAMR

SEQ ID NO: 663 - DNA, 2565 bp, Glycine max
  Glyma07g01620.1
caggatcaatcaggattcactagcattgattgtggtctacctgaagcttcaagctataatgagaagaccacaggcatattttacatttcagatgccaaatttatagatgctggtgtaagcaagagtatttcacctgcacagaagagtactcatctacaacagctagcatatgtgaggagttttcctagtggggagagaaactgttacagaataaatgtaacaagtggtactaagtatttgatcagagctactttcttttatggaaactatgatggtctcaatcagcccccacaatttgatcttcatcttggagctaatatatgggacacagtgaacttccccaatgcttcactcagtgaaatcagtgagatcattcacactccatcactagattacatacaaccatgtctggttaacacaggcaaagggactccattcatttcagctatagaattgaggactttgaacaatgctttctatgtcactgcctcagctgaatcattggcatactatcagcgatatgatttaggttccatcaccaacttaggatacaggtacaactatgatgtttatgaccgcatctgggtgcctcacggattgaaccagtggacacaattaagcagcacactccatcttcttgatatattccagaatgattataaactaccagaagttgtcatgagcactgctgctacaccaataaatgctagtgctccttttcagttctattggggtccagataatgtggatgataaattctacatctacatgcactttagtgaggttgaaattctggcagaaaatgaaactagaacattcaatatcttcatgaatggaaagttattctatggacctctaactcctggatatctgacgacaaataccatatatgcaaaatcagctttgactggagctacaaggtacctattttctcttgctaagacagggacttctactcttccacccatcattaatgccatggagatttataaagtgatagattttccacaatcagaaactgaacaagatgatgttgatgctatcacaaacattaaaaacgcttatggggtggatagaaattggcaaggagatccatgtggcccagtagcatacatttgggaaggtctaaattgtagttatgataacaccccaagaatcacatccttggatttatccaacaatagtttaagcgggtcattacctgattttctgacacaactgcaatcacttaaagtcttaaacttggtaaataacaaccttactggtccagttcctggaggacttgttgaaagatcaaaggaaggttcactatcattgagcctggggcaaaatccaaatctatgtgaatctgatccatgcatccagcagtcaaataacaagcagccagatgctgctaatcagaataagaacaaaaataatatagttattccggcagcaacatccgttgctggaattttggtgctcgtaataattgtagtaacagctataatctgcggccttaaaaagagaaaaccacaagcatctgtgaacattgatgttcagaccaatactccaagtggatcacaatttgcatcgaagcaacggcaatattcattcaatgagcttgttaagatcaccgatgactttaccagaattcttggtagaggtgcatttggaaaagtttatcacggaattattgacgacactcaagtagctgtaaagatgctttctccatcagcagtacgaggatatgaacaatttctagcagaggttaaacttctgatgagagttcatcacagaaatctgacttctcttgttgggtattgcaatgaagaaaacaatatggggctcatctatgaatatatggcaaatggaaacttggatgaaattctttcaggaaaaagtagcagggcaaagttcttgacatgggaagacagactccaaatagcactggatgcagcccaagaatttgatttgatggcattaggactggaatatctgcataacggttgtaagccaccaataatccacagagatgtgaaatgtgcaaatattttattaaatgaaaacttccaagcaaaattggctgattttgggctatccaaaagctttcccacagatgggggctcttatatgtccactgttgttgctggaactcccggttatttggatcctgagtacagcatatcaagcaggttgacagagaaaagtgatgtttacagcttcggagttgttcttttggagatggtcacaggtaaaccagctattgcaaaaacacctgagaagactcacataagtcagtgggttaaattcatgcttcctaatggggatataaagaatattgctgactcaaggttacaagaagattttgacacaagctcagtctggagagttgttgaaataggaatggcttctgtgtccattagtcctgtcaaaagaccaagtatgagcaatatagtgaacgaactaaaggagtgtctgactacagaattagctcgaaaatatagtggtcgtgacactgaaaacaatgactccattgagttggtcactctgaatttcacaactgaacttggtcccccagctagg

SEQ ID NO: 664 - protein, 855 aa, Glycine max
  Glyma07g01620.1
QDQSGFTSIDCGLPEASSYNEKTTGIFYISDAKFIDAGVSKSISPAQKSTHLQQLAYVRSFPSGERNCYRINVTSGTKYLIRATFFYGNYDGLNQPPQFDLHLGANIWDTVNFPNASLSEISEIIHTPSLDYIQPCLVNTGKGTPFISAIELRTLNNAFYVTASAESLAYYQRYDLGSITNLGYRYNYDVYDRIWVPHGLNQWTQLSSTLHLLDIFQNDYKLPEVVMSTAATPINASAPFQFYWGPDNVDDKFYIYMHFSEVEILAENETRTFNIFMNGKLFYGPLTPGYLTTNTIYAKSALTGATRYLFSLAKTGTSTLPPIINAMEIYKVIDFPQSETEQDDVDAITNIKNAYGVDRNWQGDPCGPVAYIWEGLNCSYDNTPRITSLDLSNNSLSGSLPDFLTQLQSLKVLNLVNNNLTGPVPGGLVERSKEGSLSLSLGQNPNLCESDPCIQQSNNKQPDAANQNKNKNNIVIPAATSVAGILVLVIIVVTAIICGLKKRKPQASVNIDVQTNTPSGSQFASKQRQYSFNELVKITDDFTRILGRGAFGKVYHGIIDDTQVAVKMLSPSAVRGYEQFLAEVKLLMRVHHRNLTSLVGYCNEENNMGLIYEYMANGNLDEILSGKSSRAKFLTWEDRLQIALDAAQEFDLMALGLEYLHNGCKPPIIHRDVKCANILLNENFQAKLADFGLSKSFPTDGGSYMSTVVAGTPGYLDPEYSISSRLTEKSDVYSFGVVLLEMVTGKPAIAKTPEKTHISQWVKFMLPNGDIKNIADSRLQEDFDTSSVWRVVEIGMASVSISPVKRPSMSNIVNELKECLTTELARKYSGRDTENNDSIELVTLNFTTELGPPAR

SEQ ID NO: 665 - DNA, 2463 bp, Glycine max
  Glyma08g21190.1
agagtatttcaccagcagaggaagagtactcatctacaacagctagcatatgtgaggagttttcctagtggagagagaaactgttacagaataaatgtaaccagtggtactaaatatttgatcagagctactttcttttatggaaactatgatggcctcaatcagccaccacaatttgatcttcatcttggacctaatttatgggacacagtgagcttccccaatgcatcactcagcgaaatcagtgagatcatttacaccccatcactagattacatacatccatgtcttgttaacaaaggtcaaggggctccattcatttcaaccatagaattgaggactttgaaaaatgcttcctatgtcacagcgtcagctgaatcattggcatactatcggcgatatgatttaggttccatcaccaacttagtatacaggtacaactatgatgtttatgaccgcatctgggtgccacatggattcaaccagtggacacaattaagcagcacacttaatcatgatatattccagaatgattacaaattaccagaagttgtcatgagcactgctgctacaccaataaatgctagtgctccatttcagttctattgggatccagataatgtgaatgagaaattctacatctacatgcactttaacgaggttaaaattctggcagaaaatgaaactagaacattcaatatcttcatgaatggcaagttattctatggacctctgactcctggatatctgacgaaaaatatcatatatagtacatcagctttgaccggagctacaaggtatctattttctcttgctaagacagggacttctacccttccacccatcatgaatgccatggagatttataaagtaatagattttgctcaatcagaaactgaacaagatgatgttgatgctatcacaaacatcaaaaacgcttatggggtggatagaaattggcaaggagatccatgtggcccagtagcatacatttgggaaggtctaaattgtagttatgataacaccccaagaatcacatccttgaatttgtcttcaagtggactgaccggacagatattatctttcatctccgagctcactatgttacagtatttggatttatcaaacaatagtttaagcgggtcagtacctgattttctgacacaactgcaatcacttaaagtcttaaacttggcgaaaaacaaccttactggtccagttcccggaggacttgttgaaagatcaaagcaaggttcactatcattgagcctggatcaaaatccaaatctatgtgaatctgatccatgcatccagcagacaaataacaagcagccagatggtgatcaacagaagaacaaaaataatatagttatcccggtagtagcatcagttgctggggttttggtgctcctaataattgtagcagcagctataatctgtggccttaaaaggaaaaaaccacaagcatctgatgtaaacatttatgttgagacgaacactccaaatggatcacaatttgcatccaagcaacggcaatatacattcaatgagcttgttaagatcaccaacaactttaccagaattcttggtagaggtggatttggaaaagtttatcatggatttattgatgacactcaagtagctgtaaagatgctttctccgtcagcagttaaacttctgatgagagttcatcatagaaatctgacttctcttgttgggtattgcaatgaagaaaacaacatagggctcatctatgaatatatggcaaatggaaacttggatgaaattgtttcaggaaaaagtagtagggcaaagttcttgacatgggaagacagactccaaatagcattggatgcagcccaaggactggaatatctgcataacggttgtaagccaccaataatccacagagatgtgaaatgtgcaaatattttattaaatgaaaacttccaagcaaaattggctgattttgggctatccaaaagctttcccacagatgggggatcttatatgtccactgttgttgctggaactcccggttatttggatcccgagtacagcatatcaagcagattgacagagaaaagtgatgtttacagcttcggagttgttcttttggagatggtcacaggtcagccagctattgcaaaaacacctgataagactcacataagtcagtgggttaaatccatgctttccaatggggatataaaaaatattgctgactcaaggtttaaggaagattttgacactagctcagtctggagaattgttgaaatcggaatggcttctgtgtccattagtcctttcaaaaggccaagtatgagctatatagtgaacgagctaaaggagtgtttgacgacagaattagctcgaaaatatagtggtcgtgacactgaaaacagtgactcaattgagttggtcactctgaatttcacaactgaacttggtcccccagctagg

SEQ ID NO: 666 - protein, 821 aa, Glycine max
  Glyma08g21190.1
RVFHQQRKSTHLQQLAYVRSFPSGERNCYRINVTSGTKYLIRATFFYGNYDGLNQPPQFDLHLGPNLWDTVSFPNASLSEISEIIYTPSLDYIHPCLVNKGQGAPFISTIELRTLKNASYVTASAESLAYYRRYDLGSITNLVYRYNYDVYDRIWVPHGFNQWTQLSSTLNHDIFQNDYKLPEVVMSTAATPINASAPFQFYWDPDNVNEKFYIYMHFNEVKILAENETRTFNIFMNGKLFYGPLTPGYLTKNIIYSTSALTGATRYLFSLAKTGTSTLPPIMNAMEIYKVIDFAQSETEQDDVDAITNIKNAYGVDRNWQGDPCGPVAYIWEGLNCSYDNTPRITSLNLSSSGLTGQILSFISELTMLQYLDLSNNSLSGSVPDFLTQLQSLKVLNLAKNNLTGPVPGGLVERSKQGSLSLSLDQNPNLCESDPCIQQTNNKQPDGDQQKNKNNIVIPVVASVAGVLVLLIIVAAAIICGLKRKKPQASDVNIYVETNTPNGSQFASKQRQYTFNELVKITNNFTRILGRGGFGKVYHGFIDDTQVAVKMLSPSAVKLLMRVHHRNLTSLVGYCNEENNIGLIYEYMANGNLDEIVSGKSSRAKFLTWEDRLQIALDAAQGLEYLHNGCKPPIIHRDVKCANILLNENFQAKLADFGLSKSFPTDGGSYMSTVVAGTPGYLDPEYSISSRLTEKSDVYSFGVVLLEMVTGQPAIAKTPDKTHISQWVKSMLSNGDIKNIADSRFKEDFDTSSVWRIVEIGMASVSISPFKRPSMSYIVNELKECLTTELARKYSGRDTENSDSIELVTLNFTTELGPPAR

SEQ ID NO: 667 - DNA, 2835 bp, Glycine max
  Glyma13g42930.1
atgggaatgtcgaggagtttccttgttggttttataggaggtctagttcttgcagttctgattcaagctcaagaccaatcaggattcatcagcatagattgcggagctcctgcaggtgtgagctatactgagttgaccaggacaggcataaattatatttcagatgcaaatttcattgatactggtgtgagtaggaaaatagtatctgaactcaaaagtgtctatcaacaacagctgtgggatgtcagaagttttccagaaggaaaaaggaactgctacaaaataagcatcacaagaggttctacttatctcatccggactagttttttgtatggaaattatgatgggcttaatacggaaccgcagtttgatattcatctcggggctaaccggtgggctacagtgattatttacaatgcaaccatttactatgccaaggagatcatacatgtaccttcacaggattatgtacaaatctgtctggttaacactggtcatgggataccatttatatcagctatagaattgaggactttgaaaaatgatacatacgtcacccaatttggatcactggaaacttacaacgattacgagcggtgcgatttaggttcaaacacaggaggctacaggtacaaggatgatgtttatgatcgtttctggaatacttgtgattttgacgaagattggacaccagtgctaaatgcttcgattccagctgattctttagagcagaacgattacgaacccccagctattgtcctgagcaccgcagttacaccagcaaatgttagtgttccgttggtaataaaatgggtgccacaagatccaactgaccaattctatgtttacatgcacttcttggagattcaagtgttagcaacgaaccagaccagacaattcagcatcacagaaaatggaaagacatggtttccaaacttgtctccaactaaccagtctgtcgacactatatatagcctgagagccgtcagcggggaacaaatcaaatattcatttgagatgacagagaattcaaccctgcctcccatcatcagtgccattgaaatttacagagtaatagacttccagcaatcagatacattccaaggagatgccatcaagtcagtttatggggtgacaagagattggcaaggtgatccatgcgcccctatagactacttgtgggatggtctgaattgtacttatcccggaaatgactccccaagaatcacaactttgaatttatcttcgagtggattgtcaggcaagatagacccttcaattttaaatctcaccatgctggagaatttggatttatcaaataatagcttaaaggatgaagttcccgattttctgtctcaattacaacacttgaagatcctgaacttggagaagaataacctctccggttcaattccctcaacactagttgaaaaatctaaggaaggttccctagcactaagtgtgggccaaaatccatatctatgtgaatctggtcaatgtaaccagaaggaaaaagaaaaagaaaagggaaaggacgagaagagcattgttacacccgtagtagcatcagttggtggggctgtgatccttctggtggtcttagtagctatattgtggaccctgaaaaggagaaaatcgaaagctccgatggtagagaaggatcaaagtcagatctcattgcaatacacagatcaagatgattcattcctgcaatccaaaaaacaaatatattcatactctgatgtccttaaaatcaccaacaatttcaatgcaattctcggtaaaggaggatttggaacagtttatctgggctatattgatgacactccagttgcagtgaaaatgctttccccatcgtctgttcatggttatcaacaatttcaagcagaggttaaacttctaatgagagttcatcacaaatgtttaacctcccttgttggttattgcaatgaaggaaacgataagtgtctcatatatgagtacatggctaatggaaacttacaagaacatctcactggtaaacgcagcaaaacaaaattctttacctgggaagaaagacttcgtatagcagtggatgcagctttaggattggagtatctgcaaaatggttgcaagccacctataatccacagagacgtaaaatctacaaacatcttgttgaatgaacacttccaagcaaaattatctgattttggtctatccaaaattatcccaacagatggggtaactcacgtgtcaactgttgttgctggtactcctggttatttggaccctgagtatttcataaccaatagattaaccgagaaaagcgatgtttatagctttggtgttgttcttttggagataatcacaagtcagccagtgatagcaaggaaagaagaaagcattcacataagcgaatgggttagctccttgattgctaaaggggatatcgaggccattgttgacccaaggttagaaggagattttgatagtaactcagtttggaaagcagtagaaatagcaacagcttgtttatctccaaatatgaacaagaggccaatcacaagtgtgatagtgattgaactgaaggagtctttagcaatggaattagctcgaactaaatatagtggtgttgaaacaagagattcagttaaaacggtcaccatgaatctgaataccgaatttagtccccaggccagttacgtatgtttgaagaaggagataaatagggtgggtggctttcctcttgcaatgccagaaggagatcaagccacacaattagtgaatatgggctttaatttgattgtatgttttccaagtgagactgtgtgctttaagaaatgtgtcgcgtct

SEQ ID NO: 668 - protein, 945 aa, Glycine max
  Glyma13g42930.1
MGMSRSFLVGFIGGLVLAVLIQAQDQSGFISIDCGAPAGVSYTELTRTGINYISDANFIDTGVSRKIVSELKSVYQQQLWDVRSFPEGKRNCYKISITRGSTYLIRTSFLYGNYDGLNTEPQFDIHLGANRWATVIIYNATIYYAKEIIHVPSQDYVQICLVNTGHGIPFISAIELRTLKNDTYVTQFGSLETYNDYERCDLGSNTGGYRYKDDVYDRFWNTCDFDEDWTPVLNASIPADSLEQNDYEPPAIVLSTAVTPANVSVPLVIKWVPQDPTDQFYVYMHFLEIQVLATNQTRQFSITENGKTWFPNLSPTNQSVDTIYSLRAVSGEQIKYSFEMTENSTLPPIISAIEIYRVIDFQQSDTFQGDAIKSVYGVTRDWQGDPCAPIDYLWDGLNCTYPGNDSPRITTLNLSSSGLSGKIDPSILNLTMLENLDLSNNSLKDEVPDFLSQLQHLKILNLEKNNLSGSIPSTLVEKSKEGSLALSVGQNPYLCESGQCNQKEKEKEKGKDEKSIVTPVVASVGGAVILLVVLVAILWTLKRRKSKAPMVEKDQSQISLQYTDQDDSFLQSKKQIYSYSDVLKITNNFNAILGKGGFGTVYLGYIDDTPVAVKMLSPSSVHGYQQFQAEVKLLMRVHHKCLTSLVGYCNEGNDKCLIYEYMANGNLQEHLTGKRSKTKFFTWEERLRIAVDAALGLEYLQNGCKPPIIHRDVKSTNILLNEHFQAKLSDFGLSKIIPTDGVTHVSTVVAGTPGYLDPEYFITNRLTEKSDVYSFGVVLLEIITSQPVIARKEESIHISEWVSSLIAKGDIEAIVDPRLEGDFDSNSVWKAVEIATACLSPNMNKRPITSVIVIELKESLAMELARTKYSGVETRDSVKTVTMNLNTEFSPQASYVCLKKEINRVGGFPLAMPEGDQATQLVNMGFNLIVCFPSETVCFKKCVAS

SEQ ID NO: 669 - DNA, 2568 bp, Glycine max
  Glyma15g02520.1
atgggaatgtcgatgagtttccatgttgttttgctagtaagtctagttctggccgttctgattcaagctcaagaccaatcaggattcatcagcatagattgcggagctcctgatgtgaactatactgagtcgacaacaggaataaattacacttcagatgcaaatttcataaatacgggcgtgagtaggataatagcatctgaactcaaaaatggctatcagaaacaagcgtggtatgtcagaagcttcccagaaggagtaaggaactgctacaaaataaacatcacaagaggctctacttatttgatacgggcaagttttttgtacggaaattatgatggcctaaatatgttaccacagtttgatcttcttcttggggctaaccggtgggctacagtgacaatatacaatgcatcccttgaccaattcaatgagatcatacatgttccttcactggattccgtacaactctgtctggttaacacaggccatgggacaccatttatatcagctgtagaattgaggactttgaaaaatgatacttatgtcactcgatttggatcgctggaaacttacaaccggtgggatttaggttcaaaccaagcctacaggtacaactatgatgtatatgatcgtgcctggtttacctatggcaacaacaatgattggacacagttaaatgtttctatttctgttgattctttaagccagagcgatttcaaaccaccagcaattgtcatgagcaccgcagttacaccagtgaatgctagtgctccattggtaataagctgggagccgcaagatcaaactgagttatactatgtttacatgcacttcacggaggttgaagttttagagaagaatcagacaagagaattcaacatcaaccagaatggaaagccatggtatcaaaatttgtctccacggtaccagaaagccgacactatatatagcggtataggcaccagtggggaaaaaattaaatattcacttgagatgaccgagaattcaaacctacctcccatcatcaatgccattgaaatttatagacttaaagacttccagcaatcagatacgtaccagggagatgttgatgtgattacaaccatcaagtcggtttataaagtgacaagagattggcaaggtgatccatgcggccctgtagcctacttgtggcatggtctgaattgtacttatgccgcaaatcagtccccaagaatcacaactttgaatttatcttcaagtggattgttagggaagatagacccttcaatctcaaagctcgccatgttggagaagttggatttatcaaacaatagcttaaacggtgaagttcctgattttctgtctcaattacaacacttgaaaatcttgaacttggagaagaataacctctccggttcaattccctcgacacttgttgaaaaatctaaagaaggttccctatccctaagtgtgggccaaaattcatttctatgtgaatctgatcaatgcaacgagaagcaaaaggaaaagaaaaagaataacattgttacacccttagtagcatcagttagtggggttgtgatccttctggtggttatggcagctatattgtggactcttaaaaggagaaaatcgaaagcttcgatggtagagaaggatcaaagtcagatctcaccgcaatacacagaacaagatgattcattactgcaattcaaaaaacaaatatattcattctctgatgtccttaaaatcaccaacaatttcaatacaactcttggtaaaggaggatttggaacagtttatctgggccatatcaacgacactccagttgcagtgaaaatgctttccccatcgtctgttcatggttatcaacaatttcaagcagaggttaaacttctaatgagagttcatcacaaaaatttgacctcccttgttggttattgtaatgaaggaaccagtaagggtctcatatatgagtacatggctaatggaaacttactagaacatctctctgtcacgaaaaaacagtatgtgcagaaatatctgcaaaatggttgcaagccacctataatccacagagacgtaaaatctacaaacatcttgttgaatgaactcttccaagcaaaattatctgattttggtctatccaaagttatcccaacagaaggggtaactcacgtgtcaactgttgttgctggtactcctggttatctggaccctgagtacttcataaccaatagattaacagagaagagcgatgtatatagttttggtgttgttcttttggagataatcacaagtcaaccagtgatagcgaggaatcaagaaaatattcacataagtgaatgggttagctccttgattatgaaaggggatatcaaggccattgttgactcaaggttagaaggagcttatgataccaattcagtttggaaagcagtagaaatagcaacagcttgtgtgtctccaaatctcaacaaaaggccaatcacaagtgtgatagtggttgaactgaaggaatctttagcaatggaattagctcgaactaaaaatagaggtaccaatacaagagattcagttact

SEQ ID NO: 670 - protein, 857 aa, Glycine max
  Glyma15g02520.1
MGMSMSFHVVLLVSLVLAVLIQAQDQSGFISIDCGAPDVNYTESTTGINYTSDANFINTGVSRIIASELKNGYQKQAWYVRSFPEGVRNCYKINITRGSTYLIRASFLYGNYDGLNMLPQFDLLLGANRWATVTIYNASLDQFNEIIHVPSLDSVQLCLVNTGHGTPFISAVELRTLKNDTYVTRFGSLETYNRWDLGSNQAYRYNYDVYDRAWFTYGNNNDWTQLNVSISVDSLSQSDFKPPAIVMSTAVTPVNASAPLVISWEPQDQTELYYVYMHFTEVEVLEKNQTREFNINQNGKPWYQNLSPRYQKADTIYSGIGTSGEKIKYSLEMTENSNLPPIINAIEIYRLKDFQQSDTYQGDVDVITTIKSVYKVTRDWQGDPCGPVAYLWHGLNCTYAANQSPRITTLNLSSSGLLGKIDPSISKLAMLEKLDLSNNSLNGEVPDFLSQLQHLKILNLEKNNLSGSIPSTLVEKSKEGSLSLSVGQNSFLCESDQCNEKQKEKKKNNIVTPLVASVSGVVILLVVMAAILWTLKRRKSKASMVEKDQSQISPQYTEQDDSLLQFKKQIYSFSDVLKITNNFNTTLGKGGFGTVYLGHINDTPVAVKMLSPSSVHGYQQFQAEVKLLMRVHHKNLTSLVGYCNEGTSKGLIYEYMANGNLLEHLSVTKKQYVQKYLQNGCKPPIIHRDVKSTNILLNELFQAKLSDFGLSKVIPTEGVTHVSTVVAGTPGYLDPEYFITNRLTEKSDVYSFGVVLLEIITSQPVIARNQENIHISEWVSSLIMKGDIKAIVDSRLEGAYDTNSVWKAVEIATACVSPNLNKRPITSVIVVELKESLAMELARTKNRGTNTRDSVTS

SEQ ID NO: 671 - DNA, 2199 bp, Glycine max
  Glyma13g42940.1
atgccgatgactttcttcgttgtgtttttgggtggtctacttactcaagctcaggatcaatcaggatttatcagcatagattgcggagctcctgcagatatccactatgttgagaagaaaacaggcataaattacatttcagatgccaatttcgtaaatacggatgtaagtaaagaaataatgactggattgaaaagttcctatcgagaaccgatgtggaatatgatgaatgtgagaagcttcccggaaggaaaaaggaactgctacaaaataaacatcacaagaggttctacttatctcatccggactaattttttgtatggaaattatgatgggcttaataaggcaccgcagtttgatattcatctcggggctaaccggtggtatacagtgactatatccaatgcatccactccccaagccaatgagatcatatatgtaccttcactggattacctacaaatctgtctggtcgacacagaccatgggacaccatttatatcagctatagaattgaggactttgaaaaattatacatacgtcactcaatttggatccttggaatattacaaccggtgggatttaggttcaaacaacagctacaggtacaatcatgatgtttatgatcgtttctggtatatctatggtgacaacaaggattggaaacaattaagtgcttctattcctgccgattccttaaaccagaacgattacaaaccgccagagattatcttgagtaccgcagttacaccagtaaatgcttctgcaccattggtaataagctgggagccaccagatcaaactgagctatactatgtgtacatgcacttcactgagattcaagtgttagctaagaatcaaacaagagaattcaacattgcccagaatggaaagccatggtgtccaaatatgtctccgccataccagaatgtcaccacaatatatagcaggttaggcaccagtggaaaaaaaattgaatattcacttgagaaaacaaaggattcaagcctacctcccatcataaatgccattgaaatttacagagtaataaacttccagcaatcagatacacaccaaggagatgttgacgcgattgcaaccatcaagtcagtttatgggatgacaagagattggcaaggtgatccatgctcccctgtagcctacttgtggaatggtttgaattgtacttaccgcggaaatgagaacccgagaatcacaactttgaatttatcttcaagcgaattgtcaggaatgatagatccttccatttcatatctcaccatgttggagaagttggatttatcaaacaataacttaaatggtgaagttcctgattttctatctagattacagcacttgaagatcataaatttagataacaacaacctcacgggttcaattccatcagaactagttaaaaaatctaaggaaggtttcctatcactaagtgtgggccaaaatctgtatctatgtgaatctggtcaatgcaacgagaagaaaaagaaaaagaacattgttactcccttgttagcgtcagttagtggggttttgatccttgtggtggctgtggcagctatatcgtggactcttaaaaagagaaagccgaaagaacaagatgattcattacatcaattcaaaaaacaaatatactcacactctgatgtccttagaatcacgaacaatttcaatacaattgttggtaaaggtgggttcggaacagtttatctgggttatatcgatggcactccagttgcagtgaaaatgctttctacctcttcagttcatggttatcaacaatttcaggcagaagttaaacttctaatgagagttcatcatgcgaatctcacctcccttgttggttattgtaatgaaggagacaataagggtctcatatatgagtacatggctaatggaaacttacatgaacatctgtctggtaaacacatcaaatcaaaattcctgacctgggaagacagacttcgtatagcagtggatgcagccttaggattggagtaccttcaaactggttgcaagcctcctataatccacagagacgtaaaatctacaaacatcttgttggatgaaaagttacaagcaaagttatctgattttggtctatccaaaattatcccaattgatgggggaactcatgtgtcaactgttgttgctggtactccaggtactacatatccaatagat

SEQ ID NO: 672 - protein, 733 aa, Glycine max
  Glyma13g42940.1
MPMTFFVVFLGGLLTQAQDQSGFISIDCGAPADIHYVEKKTGINYISDANFVNTDVSKEIMTGLKSSYREPMWNMMNVRSFPEGKRNCYKINITRGSTYLIRTNFLYGNYDGLNKAPQFDIHLGANRWYTVTISNASTPQANEIIYVPSLDYLQICLVDTDHGTPFISAIELRTLKNYTYVTQFGSLEYYNRWDLGSNNSYRYNHDVYDRFWYIYGDNKDWKQLSASIPADSLNQNDYKPPEIILSTAVTPVNASAPLVISWEPPDQTELYYVYMHFTEIQVLAKNQTREFNIAQNGKPWCPNMSPPYQNVTTIYSRLGTSGKKIEYSLEKTKDSSLPPIINAIEIYRVINFQQSDTHQGDVDAIATIKSVYGMTRDWQGDPCSPVAYLWNGLNCTYRGNENPRITTLNLSSSELSGMIDPSISYLTMLEKLDLSNNNLNGEVPDFLSRLQHLKIINLDNNNLTGSIPSELVKKSKEGFLSLSVGQNLYLCESGQCNEKKKKKNIVTPLLASVSGVLILVVAVAAISWTLKKRKPKEQDDSLHQFKKQIYSHSDVLRITNNFNTIVGKGGFGTVYLGYIDGTPVAVKMLSTSSVHGYQQFQAEVKLLMRVHHANLTSLVGYCNEGDNKGLIYEYMANGNLHEHLSGKHIKSKFLTWEDRLRIAVDAALGLEYLQTGCKPPIIHRDVKSTNILLDEKLQAKLSDFGLSKIIPIDGGTHVSTVVAGTPGTTYPID

SEQ ID NO: 673 - DNA, 2685 bp, Glycine max
  Glyma15g02450.1
atgtccaggagtttcctagttgcttttctaggatgtctacttcttgccgttccaattcaagctcaggatcaatcaggattcatcagcatagcttgcggagctcctgcaggtgtgaactttactgtgccgaaaacaggcttaaactatacatcagatgcaaatttcataaatactggtgtgagcaggacaatagtacctgaactcagagatcagtttcaaagatacgtgtggaatctcagaagcttcccggaaggaaaaaggaactgctacaaaataaacatcacaagaggctccaagtatctgatcagggcttcttttttgtacggaaattatgatggcttaaatatgttaccacagtttgatcttcttctcggggctaaccggtggcgtacagtgaacataaacaatgcatccgttagtcgagattttgagatcatatatgtaccttcactggattacgtacatatctgtatggttgacacaggccttgggacaccatttatatcagctatagagttgaggtctttgagaaatgacatttatgaaactgaatttggatcattggaaaagtacatccgtcgggatttaggttcaaacaaaggctacaggtacgacgatgatgtttatgatcgttactggagctatgacgatgcagatacatggtatgacaatgtagataaatggagaaagctaaattttccgattgatgctgattctttagtgcagaacaaataccaaccgccagctgttgtcatgagcaccgcagttacaccagcaaatgttagtgctccattggtaataagctgggagccagatgatccaaaagagtcattctatgtttacatgcacttcacagagattcaagtgttagcaaagaatcagacgagagagttcaacatcaccctgaacggaaagctatggtatgaaaatgagtctcctaggtaccacagtgtcaatactatatatagcacttcaggcatcagtgggaaattaattaatttttcatttgtgatgaccgagacttctaccctacctcccatcatcaatgccattgaaatttacagagtgaaagagttcccgcaacaagacacataccaaggagatgttgatgcgattacaaccatcaagtctgtttatggggtgacaagagattggcaaggtgatccatgcagcccgaaagactacttgtgggagggtctgaattgtacgtatcccgtaattgactccccaagaatcataactttgaacttatcttcaagtggattgtcaggaaagatagacccttcaattttaaatctcaccatgttggagaagttggatttatcaaacaatagcttaaacggtgaagttcctgattttctgtctcaattacaatacttgaagatcttgaacttggagaataataacctctccggttcaattccctcaacacttgttgaaaaatctaaggaaggttccctatcattaagtgtgggccaaaatccatatctatgtgaatctggtcaatgcaatttcgagaagaaacaaaagaacattgttacgctcatagtagcatcaattagtggggcgttgattcttctagtagccgtggcaatattgtggacccttaaaaggagaaaatcaaaagaaaaatcaacagctttgatggaagtgaatgatgaaagtgagatctcacgcctgcaatccacaaaaaaagatgattcattactgcaagtcaaaaaacaaatatattcatactctgacgtccttaaaatcaccaacaatttcaatacaattattggtaaaggaggatttggaacagtttacctgggctatatcgatgacagtccagttgcagtgaaagtgctttctccatcgtctgtaaatggctttcaacaatttcaagcagaggttaaacttctagtcaaagttcatcacaaaaacttaacatcccttattggttattgcaatgaaggaaccaataaggctctcatatatgagtatatggctaatgggaacttacaagaacatctctctggtaaacacagcaaatcaatgttcttgagctgggaggacagacttcgtatagcagtggatgcagccttaggattggagtatctgcaaaatggttgcaagcctccaataatccacagagatgtaaaatctacaaacatcttgttgaatgaacacttccaagcaaaattgtctgattttggtctatccaaagctatcccaactgatggggaatctctcgtgtcaactgtccttgctggtactcctggttatctggaccctcactgccacatatccagtagattaacacagaaaagcgatgtttatagctttggagttgttcttttggaaataatcacaaaccaaccagtaatggaaaggaatcaagaaaagggtcacataagagaaagggttaggtccttgattgagaaaggggatatcagggccatagttgactcaaggttagaaggagattatgacattaactcagcttggaaagccttagaaatagcaatggcttgtgtttctcaaaatcccaacgaaaggccaatcatgagtgagattgctattgaactaaaggagacattagcgatcgaagaattagctcgagcaaaacattgtgatgccaatcccagatatttagttgaagcggttagcgtgaatgtggacaccgaattcatgcccctggcgagg

SEQ ID NO: 674 - protein, 895 aa, Glycine max
  Glyma15g02450.1
MSRSFLVAFLGCLLLAVPIQAQDQSGFISIACGAPAGVNFTVPKTGLNYTSDANFINTGVSRTIVPELRDQFQRYVWNLRSFPEGKRNCYKINITRGSKYLIRASFLYGNYDGLNMLPQFDLLLGANRWRTVNINNASVSRDFEIIYVPSLDYVHICMVDTGLGTPFISAIELRSLRNDIYETEFGSLEKYIRRDLGSNKGYRYDDDVYDRYWSYDDADTWYDNVDKWRKLNFPIDADSLVQNKYQPPAVVMSTAVTPANVSAPLVISWEPDDPKESFYVYMHFTEIQVLAKNQTREFNITLNGKLWYENESPRYHSVNTIYSTSGISGKLINFSFVMTETSTLPPIINAIEIYRVKEFPQQDTYQGDVDAITTIKSVYGVTRDWQGDPCSPKDYLWEGLNCTYPVIDSPRIITLNLSSSGLSGKIDPSILNLTMLEKLDLSNNSLNGEVPDFLSQLQYLKILNLENNNLSGSIPSTLVEKSKEGSLSLSVGQNPYLCESGQCNFEKKQKNIVTLIVASISGALILLVAVAILWTLKRRKSKEKSTALMEVNDESEISRLQSTKKDDSLLQVKKQIYSYSDVLKITNNFNTIIGKGGFGTVYLGYIDDSPVAVKVLSPSSVNGFQQFQAEVKLLVKVHHKNLTSLIGYCNEGTNKALIYEYMANGNLQEHLSGKHSKSMFLSWEDRLRIAVDAALGLEYLQNGCKPPIIHRDVKSTNILLNEHFQAKLSDFGLSKAIPTDGESLVSTVLAGTPGYLDPHCHISSRLTQKSDVYSFGVVLLEIITNQPVMERNQEKGHIRERVRSLIEKGDIRAIVDSRLEGDYDINSAWKALEIAMACVSQNPNERPIMSEIAIELKETLAIEELARAKHCDANPRYLVEAVSVNVDTEFMPLAR

SEQ ID NO: 675 - DNA, 2418 bp, Glycine max
  Glyma15g02490.1
atgtatgcattttatgttttaggattcctcagcatagcttgcggagctcctgcaggtgtgaactttactgtgccgataacaggcttaaactatacatcagatgcaaatttcataaatactggtgtgaagagcacaatagtatctgaactcagagatcagtttcaaagacacgtgtggaatctcagaagcttcccggaaggaaaaaggaactgctacaaaataaacatcacaagaggctccaagtatctgatcagggcttcttttttgtacggaaattatgatggcttaaatatgttaccacagtttgatcttcttctcggggctaaccggtggcgtacagtgaacataaaaaatgcatccgttagccgacattttgagatcatatatgtaccttcactggattacgtacatatctgtatggttgacacaggccttggtacaccatttatatcagctatagagttgaggtctttgagaaatgacatttatgaaactgaatttggatcattggaaaagtacatccgtcgggatttaggttcaaacaaaggctacaggtacgacgatgatgtttatgatcgttactggaactatgacgatgcagatacatggtatgacaatgtagataaatggaaacagctaaattttccgattgatgctgattctttagtgcagaaacagtaccaaccgccagctgttgtcatgagcaccgcagttacaccagcaaatgttagtgctccattggtaataagctgggagccatatgatccaaaagattcattctatgtatacatgcacttcacagagattcaagtgttagcaaagaatcagacgagagagttcaacatcaccctgaacggaaagctatgtgggaaattaattaatttttcatttgtgatgaccgagacttctaccctacctcccatcatcaatgccattgaaatttacagagtgaaagagttcccgcaacaagacacataccaaggagatgttgatgcgattacaaccatcaagtctgtttatggggtgacaagagattggcaaggtgatccatgcagcccgaaagactacttgtgggagggtctgaattgtacgtatcccgtaattgactccccaagaatcataactttgaacttatcttcaagtggattgtcaggaaagatagacccttcaattttaaatctcaccaagttggagaaattggatttatcaaacaatagcttaaacggtgaagttccggattttctgtctcaattacaatacttgaagatcttgaacttggagaataataacctctccggttcaattccctcaacacttgttgaaaaatctaaggaagacaataatccaatttggaagtatagacttgtggttgtggaggttggaagcaaagagcaaagctatttctttagtttagtcattgtctcatacttcacagcacaaagtgtttttagagtatttgaccgagttagcatcttacgcctgcgatccacaaaaaaagatgattcattagcgcaagtcaaaaaacaaatatattcatactctgacgtccttaaaatcaccaacaatttcaatacaattattggtaaaggaggatttggaacagtttacctgggctatatcgatgacagtccagttgcagtgaaagtgctttctccatcggctgtacatggctttcaacaatttcaagcagaggttaaacttctaatcagagttcatcacaaaaacttaacatcccttattggttattgcaatgaaggaaccaataaggctctcatatatgagtatatggctaatgggaacttacaagaacatctctctggattggagtatctgcaaaatggttgcaagcctccaataatccacagagatgtaaaatctacaaacatcttgttgaatgaacacttccaagcaaaattgtcagattttggtctatccaaagctatcccaattgatggggaatctcacgtgtcaactgtcgttgctggtactcctggttatctggaccctcactaccacaaattcagtagattaacacagaaaagcgatgtttttagctttggagttgttcttttggaaataatcacaaaccaaccagtaatggaaaggaatcaagaaaagggtcacataagtggaagggttaggtccttgattgagaaaggggatatcagggccatagttgactcaaggttagaaggagattatgacattaactcagcttggaaagccttagaaatagcaatggcttgtgtttctcaaaatcccaacgaaaggccaatcatgagtgagattgctattgaactaaaggagacattagcgatcgaagaattagctcgagcaaaacattgtgatgccaatcccagacatttagttgaagcggttagcgtgaatgtggacaccgaattcatgcccctggcgagg

SEQ ID NO: 676 - protein, 806 aa, Glycine max
  Glyma15g02490.1
MYAFYVLGFLSIACGAPAGVNFTVPITGLNYTSDANFINTGVKSTIVSELRDQFQRHVWNLRSFPEGKRNCYKINITRGSKYLIRASFLYGNYDGLNMLPQFDLLLGANRWRTVNIKNASVSRHFEIIYVPSLDYVHICMVDTGLGTPFISAIELRSLRNDIYETEFGSLEKYIRRDLGSNKGYRYDDDVYDRYWNYDDADTWYDNVDKWKQLNFPIDADSLVQKQYQPPAVVMSTAVTPANVSAPLVISWEPYDPKDSFYVYMHFTEIQVLAKNQTREFNITLNGKLCGKLINFSFVMTETSTLPPIINAIEIYRVKEFPQQDTYQGDVDAITTIKSVYGVTRDWQGDPCSPKDYLWEGLNCTYPVIDSPRIITLNLSSSGLSGKIDPSILNLTKLEKLDLSNNSLNGEVPDFLSQLQYLKILNLENNNLSGSIPSTLVEKSKEDNNPIWKYRLVVVEVGSKEQSYFFSLVIVSYFTAQSVFRVFDRVSILRLRSTKKDDSLAQVKKQIYSYSDVLKITNNFNTIIGKGGFGTVYLGYIDDSPVAVKVLSPSAVHGFQQFQAEVKLLIRVHHKNLTSLIGYCNEGTNKALIYEYMANGNLQEHLSGLEYLQNGCKPPIIHRDVKSTNILLNEHFQAKLSDFGLSKAIPIDGESHVSTVVAGTPGYLDPHYHKFSRLTQKSDVFSFGVVLLEIITNQPVMERNQEKGHISGRVRSLIEKGDIRAIVDSRLEGDYDINSAWKALEIAMACVSQNPNERPIMSEIAIELKETLAIEELARAKHCDANPRHLVEAVSVNVDTEFMPLAR

SEQ ID NO: 677 - DNA, 2400 bp, Glycine max
  Glyma15g02510.1
atgttaccaaagtttgatcttcttctcggggctaaccggtggcttacagtgaacataaacaatgcatccgttagtctagattttgagatcatatatgtaccttcactggattacgtacatatctgtatggttgacacaggccatgggacaccatttatatcagctatagagttgaggactttgagaattgacatttatgaaactcgatttggatcattggaaaccgacttccgtgtggatttaggttcaaacagaggctacaggtacaactatgatgtttatgatcgttactggagcggtgccgatctagatacatggagaccactaaattttccgattgatgctgattctttagtgcagaacgactacaaaccgccagctgttgtcatgagcaccgcaattacaccagcaaatgttagtgctccattggtaataagctggaagccagatgatccaaaagattcattctatgtttacttgcacttcacagagattcaagtgttagcaaagaatcagacgagagagttcaacatcaccctgaacggaaatccatggactgaaaatatatctcctaggtaccacagtgtcaatactatatatagcacttcaggcatcagtggggaaaaaattaatttttcatttgtgatgaccgagacttctaccctacctcccatcatcaatgccattgaaatttacagagtgaaagagttcccgcaaccagatacgtaccaaggagatgttgatgcgattacaaccatcaagtctgtttatggggtgacaagagattggcaaggtgatccatgcagcccgaaagactacttgtgggagggtctgaattgtacgtatcccgtagttgactccccaagaatcataaccttgaacttatcttcaagtggattgtcaggaaagatagacccttcaattttaaatctcaccatgttggagaagttggatttatcaaacaatagcttagacggtgaagttcctgattttctgtctcaattacaacacttgaagatcttgaacttggagaataataacctctccggttcaattccctcaacacttgttgaaaaatctaaggaaggttccctatcactaagtgtgggccaaaatccacatctctgtgaatctggtcaatgcaacgaaaaggaaaaagaaaagggagaggaagaggacaaaaagaacattgttacacccgtagtagcatcagctggtggggttgtgatccttctgctggccgtggcagcaatattgcggacccttaaaaggagaaattccaaagcttctatggtggagaaggatcaaagtcctatctcaccgcaatacacaggacaagatgattccttactgcaatccaaaaaacagatatattcatactctgatgtccttaacatcaccaacaatttcaatacaattgtgggtaaaggaggatctggaacagtttatctgggctatatcgatgacactccagttgcagtgaaaatgctttccccatcgtctgttcatggttatcaacaatttcaagcagaggttaaacttctaatgagagttcatcacaaaaatttgatctcccttgttggttattgtaatgaaggagacaataaggctctcatatacgagtacatgaataatggaaacttacaagaacatatcactggtaaacgcagcaaaacaaaattcttcacctgggaagacagacttcgtatagcagtggatgcagcatcaggattggagtacctgcaaaatggttgcaagccgcctataatccacagagacgtaaaatctacaaacatcttgttgaatgaacacttccaagcgaaattatctgattttggtctatccaaaattatcccaacagacgggagcactcatgtgtcaactgttattgctggtactcctggttatctggaccctgaatactacataaccaatagattaacagagaagagtgatgtttatagctttggtgttgttcttttggagataatcacgagtaaacccgtgataacaaagaatcaagaaaagactcacataagtcaatgggttagctccttggttgcaaaaggtgatatcaagagcattgttgactcaaggttagaaggggattttgataataactcggtttggaaagcagtagaaatagcagcagcatgtgtatctccaaatcccaacagaaggccaatcataagtgtgatagtgactgaactgaaggagtctttagcaatggaattagctcgaactaaatatggtggtcctgattcaagagattcagttaaaccggtcaccatgaatctgaataccgaatttagtccccaggccaggcatatacctttagatactagggtttacgtttctatatctttgaataatttgggattaaaatccttaagacttggt

SEQ ID NO: 678 - protein, 800 aa, Glycine max
  Glyma15g02510.1
MLPKFDLLLGANRWLTVNINNASVSLDFEIIYVPSLDYVHICMVDTGHGTPFISAIELRTLRIDIYETRFGSLETDFRVDLGSNRGYRYNYDVYDRYWSGADLDTWRPLNFPIDADSLVQNDYKPPAVVMSTAITPANVSAPLVISWKPDDPKDSFYVYLHFTEIQVLAKNQTREFNITLNGNPWTENISPRYHSVNTIYSTSGISGEKINFSFVMTETSTLPPIINAIEIYRVKEFPQPDTYQGDVDAITTIKSVYGVTRDWQGDPCSPKDYLWEGLNCTYPVVDSPRIITLNLSSSGLSGKIDPSILNLTMLEKLDLSNNSLDGEVPDFLSQLQHLKILNLENNNLSGSIPSTLVEKSKEGSLSLSVGQNPHLCESGQCNEKEKEKGEEEDKKNIVTPVVASAGGVVILLLAVAAILRTLKRRNSKASMVEKDQSPISPQYTGQDDSLLQSKKQIYSYSDVLNITNNFNTIVGKGGSGTVYLGYIDDTPVAVKMLSPSSVHGYQQFQAEVKLLMRVHHKNLISLVGYCNEGDNKALIYEYMNNGNLQEHITGKRSKTKFFTWEDRLRIAVDAASGLEYLQNGCKPPIIHRDVKSTNILLNEHFQAKLSDFGLSKIIPTDGSTHVSTVIAGTPGYLDPEYYITNRLTEKSDVYSFGVVLLEIITSKPVITKNQEKTHISQWVSSLVAKGDIKSIVDSRLEGDFDNNSVWKAVEIAAACVSPNPNRRPIISVIVTELKESLAMELARTKYGGPDSRDSVKPVTMNLNTEFSPQARHIPLDTRVYVSISLNNLGLKSLRLG

SEQ ID NO: 679 - DNA, 2709 bp, Glycine max
  Glyma15g42040.1
atgggaatgtcttcgatgagtttcctcattgcttttctaggatgtctagttcttgctgctctgattcaagcgcaggaccaatcaggattcatcagcatagattgcggaactcctgaaatgaactacactgagcagtcaacaggcctaaattatacttcagatgcaaatttcataaacactggtgtgagaaagtcaatagcatctcaactaagaaatgggtatctgaaacacatgtggtatgtcagaagctttccggaagaaggaaaaaggaactgttacaaaatagaaatcacaagaggcactaagtatctcatcagggtagagttcttgtatggaaactacgacggtcaaaatatgctgcctcagtttgatcttcttcttggggctagtcagtgggctacagtgactataaaaaatgcaaccattgaccaggctgaggagatcatacatgtaccttcactagattacctacaaatctgtctggttgacacaggccatgggacaccatttatatcatctatagaattgaggactttgagagatgacatttatgtcactcgatttggatcgttgcaaaattacttcagatgggatttaggttctagcagaggttacaggtacaactatgatgtttatgatcgttactggagctacggcaacatcaatgaatggaaaatattaagtgcttctattactgctgattctttagaccagagccaggatgatttcaaagtgccagcaattgttctgagcactgcaattacaccactaaatgctagtgctccattggtaatattgtgggagccagaacatcaaactgagcaattctatgtttacatgcacttcacagagattgaagagttagcaaagaatcagactagagaattcaacatcaccttgaatggaaagtcatggtttacaaatttgtctccacagtaccaaggtgtcaccactatccggagcaagtcaggcaccagtgggaaaataattatattttcacttgagatgactgagaattcaaccctacctcccatcatcaatgccattgaaatctataaagttatagagttccaacaagcagacacataccaaggagatgttattttatccttgaatcagcttgtctcatatctaaaattcatttctctggaacaaacagttgatgcgattacaaccatcaagtctgtttatgaggtgacaagagactggcaaggtgatccatgcgcccctatagactacttgtggcagggtctgaattgtagttatcccgaaaatgattctccaagaatcacaagtttgaatttatcttcaagtggattatcaggaaagatagacctttcgatctcaaagctcaccatgttggagaacttatactttaaagggttaagttatttgtgttccagggatttatcaaacaatagcttaaacggtgaaattcccgaatttctgtctcaactacaacacttgaagatattaaacttggagaagaacaacctctccggttcaattccaccagcactaaatgaaggttctgtctcactaagtgtgggccaaaatccatatctatgtgaatctggtcaatgcaacgagaaggaaaatgaaaaggaacaagaaaagaaaaagaagaatattgttacacccttggtagcatctgttggtggggttgtgatccttctggtggttatggcagctatattgtggactattaaaaggagaagatcaaaagatttgatggtagaaaaggatccaagtcagatctcaccgcaatacacagaacaagatgattcattactggaattcaaaaaacaaatatattcatactctgatgtccttaaaatcaccaacaatttcaatacaattgttggtaaaggaggatttggaacagtttatctgggctatattgatgacactccagttgcagtgaaaatgctttccccatcggccattcaaggttatcaacaatttcaagctgaggttaaacttctaatgagagttcatcacaaaaatttgacctcccttgttggttattgtaatgagggaaccaataaggctctcatatacgagtacatggctaatggaaacttacaagaacatctatctggtaaacgcagcaaaacaaaaagcttgagctgggaagacagacttcgtatagcagtggatgcagcctcaggattggagtatctgcaaaatggttgcaagccacctataatccacagagacgtaaaatctacaaatatcttgttgaatgaacactttcaagcaaaattatctgattttggtctatccaaaattatacctactgacgggggaactcatgtgtcaactgttgttgctggtactcctggttatctagaccctgagtactacaaaaccaatagattaacagacaagagtgatgtctatagctttggtgttgttcttttggagataatcacaagtcaaccagtgatagcgaggaatcaagaaaagattcatataagtcaatgggttaactccttgatggcgaaaggagatatcaaggccattgttgactcaaagttagatggagattttgatagtaactcagtttggaaagcagtggaaatagcaatggtttgtgtgtctccaaatcccgaccgaaggccaatcataagtgtgatactcgaactaaatatagcagtgccgatacaagagattcagttaaacttgtggtttcctcttgacgaatgc

SEQ ID NO: 680 - protein, 903 aa, Glycine max
  Glyma15g42040.1
MGMSSMSFLIAFLGCLVLAALIQAQDQSGFISIDCGTPEMNYTEQSTGLNYTSDANFINTGVRKSIASQLRNGYLKHMWYVRSFPEEGKRNCYKIEITRGTKYLIRVEFLYGNYDGQNMLPQFDLLLGASQWATVTIKNATIDQAEEIIHVPSLDYLQICLVDTGHGTPFISSIELRTLRDDIYVTRFGSLQNYFRWDLGSSRGYRYNYDVYDRYWSYGNINEWKILSASITADSLDQSQDDFKVPAIVLSTAITPLNASAPLVILWEPEHQTEQFYVYMHFTEIEELAKNQTREFNITLNGKSWFTNLSPQYQGVTTIRSKSGTSGKIIIFSLEMTENSTLPPIINAIEIYKVIEFQQADTYQGDVILSLNQLVSYLKFISLEQTVDAITTIKSVYEVTRDWQGDPCAPIDYLWQGLNCSYPENDSPRITSLNLSSSGLSGKIDLSISKLTMLENLYFKGLSYLCSRDLSNNSLNGEIPEFLSQLQHLKILNLEKNNLSGSIPPALNEGSVSLSVGQNPYLCESGQCNEKENEKEQEKKKKNIVTPLVASVGGVVILLVVMAAILWTIKRRRSKDLMVEKDPSQISPQYTEQDDSLLEFKKQIYSYSDVLKITNNFNTIVGKGGFGTVYLGYIDDTPVAVKMLSPSAIQGYQQFQAEVKLLMRVHHKNLTSLVGYCNEGTNKALIYEYMANGNLQEHLSGKRSKTKSLSWEDRLRIAVDAASGLEYLQNGCKPPIIHRDVKSTNILLNEHFQAKLSDFGLSKIIPTDGGTHVSTVVAGTPGYLDPEYYKTNRLTDKSDVYSFGVVLLEIITSQPVIARNQEKIHISQWVNSLMAKGDIKAIVDSKLDGDFDSNSVWKAVEIAMVCVSPNPDRRPIISVILELNIAVPIQEIQLNLWFPLDEC

SEQ ID NO: 681 - DNA, 2574 bp, Citrus clementina
  clementine0.9_028518m
atggaaatgtttcagcgatttgccttattatgtctctgcattttccatcttgcagcccttgtttgtgctcaggatcaagcaggattcattagcttggactgtgggttaccaaaagattctagctacactgaaacctcaacgaaattaagatatacttctgatgcaaattacatagaaaccggcctcccaaagagtatattactgcaatacagaagaatgaagcaacagcaagtgtggagtctcagaagctttcctgatgggataagaaactgttacagattcaatcttactaggaatactaaatatttaatcagagccactttcatgtatggaaattatgatgagcaaaataatttaccagaatttgatgttcatttgggacctaacttgtggggtacaataaaaatagaaaatgtatccgttgattattcagtggagatcatacatgtactctcatcggattatttatccgtctgtatcgtgaataccaacaaagggactccgttcatatcagcattggaattaaggcctctggataataatacttacataactcaaactgattcgctggaactatctattcgcctggatgttggttccacatcaaatgctacattcaggtatatagatgatgcttatgatcgggtctggtggccatatgatttggatgagtgggaaccgttcagcacttcagaagctgttgatgctgatggtagcaaaaatttcaaaccaccacctcgtgccatgaagtccgctgtcagacctgttaatgcgagcaattccttggatttctccataaacgctagtgatcctacatcccaattatatgtctacatgcactttgctgaaattgaagagctgaaagcaaatgagtccagattgttcaacattacttggaatggcaatctttggtatggacctttaaaactgaattatctgtcctccaccacggtgttctcacaatctgccatgagtgggggacaatataacttttcactcatcaaaaccggaaattcaactcatccgccaatcattaatgccattgaaatctacgaggtaaaggaattttcgcagtcacaaacagatgaacaagatgttgatgccatcatgaatatcaagtcattttatggattgaagaaaaactggcaaggagatccatgtgctccccaagattacttgtgggagggtctcaattgcagctatcccgatgatgattcaccaagaataacctccctaaatttatctgcaagtgaattgaccgggggttttgctcattatcttaccaatctcacaatgcttacatctctggacttgtcaaacaataacttgacaggaccggtgcctaaatttctatctcagttgtcatccttgaaattcctaaacttggcacgaaacaagctcactggtccactcccagttgaactacttgaaaaacaggaaaacaatacactagaactgagatttgacggaaatccagatctttgtcgatcggcttcatgcaagaaagaaaagaagaaatttgttgtcccgttagtagcatcagttgcttcagtttttgtcgtcttagccgcattaattggcttatggagccttaaacggaaaaagcaattaccagggaggaaggtggatgctaattgcaacagatcatacgagtccttggacctgagtagtcgacaattcacttactctgaggtcttgaggatgaccaacaactttgagagggttcttggcaagggaggattcggaacagtgtaccatggcaaattggacaatgatgaagtagccgtgaagatgctatctccgtcatcatctcaagggtataagcaatttcaggcagaggtcaagcttcttttgagagttcaccacagaaacttaacaacccttgttgggtattgtgatgagggcacgaacatggcactcatctatgagtacatggctaatggaaacttggaagagcatctttcaggactggaatatctgcaccaaggttgtaagccaccaatcgttcacagagatgtgaagtctacaaacatcttaataaatgagaaattccaagcgaagttagctgattttgggctgtccagagtatttccagttgaaggtggcactcatgtgtcgacaaccattgccggcaccccaggataccttgaccccgagtattatatatcaaataggttgactgaaaaaagtgacgtgtatagtttcggggtcgttctcctggagataataacaggacatcctgtaatttcaaaatcagctgagaatggacacactcacgtagctcaatgggttagttccatgcttgacaaaggagacataagaagcactgttgacccaaggttaaagggcgattttgacatcaacgctgcctggaaagctgtggaaatagcaatggcctgtgtttcttctactgccaacagaagaccatttatgaatcaagtcgtgatggaattgaatgactgtttggcaatggaagcagctcaaaagaaggagagcatcaccacgtccgattcgaataattctgttgaaatgatcactgtgaatctgcatactgaattatccccattagcaagg

SEQ ID NO: 682 - protein, 858 aa, Citrus clementina
  clementine0.9_028518m
MEMFQRFALLCLCIFHLAALVCAQDQAGFISLDCGLPKDSSYTETSTKLRYTSDANYIETGLPKSILLQYRRMKQQQVWSLRSFPDGIRNCYRFNLTRNTKYLIRATFMYGNYDEQNNLPEFDVHLGPNLWGTIKIENVSVDYSVEIIHVLSSDYLSVCIVNTNKGTPFISALELRPLDNNTYITQTDSLELSIRLDVGSTSNATFRYIDDAYDRVWWPYDLDEWEPFSTSEAVDADGSKNFKPPPRAMKSAVRPVNASNSLDFSINASDPTSQLYVYMHFAEIEELKANESRLFNITWNGNLWYGPLKLNYLSSTTVFSQSAMSGGQYNFSLIKTGNSTHPPIINAIEIYEVKEFSQSQTDEQDVDAIMNIKSFYGLKKNWQGDPCAPQDYLWEGLNCSYPDDDSPRITSLNLSASELTGGFAHYLTNLTMLTSLDLSNNNLTGPVPKFLSQLSSLKFLNLARNKLTGPLPVELLEKQENNTLELRFDGNPDLCRSASCKKEKKKFVVPLVASVASVFVVLAALIGLWSLKRKKQLPGRKVDANCNRSYESLDLSSRQFTYSEVLRMTNNFERVLGKGGFGTVYHGKLDNDEVAVKMLSPSSSQGYKQFQAEVKLLLRVHHRNLTTLVGYCDEGTNMALIYEYMANGNLEEHLSGLEYLHQGCKPPIVHRDVKSTNILINEKFQAKLADFGLSRVFPVEGGTHVSTTIAGTPGYLDPEYYISNRLTEKSDVYSFGVVLLEIITGHPVISKSAENGHTHVAQWVSSMLDKGDIRSTVDPRLKGDFDINAAWKAVEIAMACVSSTANRRPFMNQVVMELNDCLAMEAAQKKESITTSDSNNSVEMITVNLHTELSPLAR

SEQ ID NO: 683 - DNA, 2514 bp, Citrus clementina
  clementine0.9_032331m
atgcataagattttgatctgtttctatatttctgtcacgggattcattagcttagattgtggatcaccgaaagattctaactacactgattcactaacgggcttaaattacacttcggattctgcattcataggcacaggcataagcaagagcatttcacctgaattcaaaacagaggacctcaaccaacagctatggaatgtcagaagctttcctgaaggaaaaagaaactgttacaatgtgaaacttccaagagccaaaaataacaagcacttgatcagagcaagacttatgtatggaaattgtgatgctcgaaatgtaacaccgcaatttgacttgcatttacaagctaatttttgggtctcagtgaagctggaaaatgcggacaacatcatatcagaagaaatcatacatgttccatcatccaattatttacaagcctgtcttgtgaatactggcttggggactcctttcatatcagcattagaaataaggtctttgaataataccattgacaagactaagtcctgttcacttcatctcttttcgcggcttgatattgcttcaacaactaaacaaatggtcaggtaccaagatgatgcttattacgatcgtatctggatgccttttaacttggagaattggggcaagataagcacttcattaacaattgatgatggtttttacattgaccttcgaccacctgaagttgtcatgaggacagctgccacgccggcaaatgccagtgagcccttagaattttatttgataactgacgacactctcgaatttaatttctacttttactttgccgaacttacaaagctccaacccaatgagtccagagagttcaacatttctttcaatgggaagcatatctacgggccattgtcacttgaatacttatactcattggctattttcagtgtgttgccaacgatgagtggaggagatatttcggcatcaacaggagacaatcgtttttctatttataaaataaaagattcaacccttcctcccattctcaacgcgattgagatttacactgttaagcagttgttgcaacaccatactgatgaacaagatgttgatgctatcaaaagtataaagtcaatttctggagtgaagaaaaattggcaaggagatccatgtgttcctcgagcttacatttggaatggtcttaattgcagctatgatggttttgatccttctagaatcatgtcgctaaatttatcagcaagtggattgacaggggaaatagcaccttacttttccaatctcccactgttacaatatctggacttatcaaacaatagtttgactggtccagtgcccaattttcttgctaaattgcctgccttgaggatcctctacgcttttgatgagaaaaataaaataagggattacattttctttttatccttctgcagaaacttagaaggaaacatgcttacaggcttagttccaattgaactcattgaaagatcaaagaagggatcgctatcattaagtattggcggaaatccagaactttgttcatcagatacatgcaaggcgaagaagaagtttgtgattcctgtagcagcatcagccgttacattgttcatccttataactgcattgacaatcttatggatcctcaaaaggaggaaacaacaggttgggaaggtggacacatatgattcattggagttggagaatcgccggttctcgcactcccagatcctgaggcttaccaacaactttgagaaggttcttggaaagggaggatctggaacagtatatcaaggctacttagatacaacaccagtggctatcaagatgctgtatccatcatcagtgcaggggactaaacagtttgaggcagaggggctcatctatgagtacatggctaatggaaacttagcagagcagctagcggacgattgcgagaatatcttgagttggaaagaaagactacaaatagcagttgaagcagcacaagagtttaaaatgtgggattgcgacagagatgtgaagtctacaaacatcttactagatgatgaatttcaagcaaagctatcagattttgggctgtccagaacttttcccgttcaaggtggcactcgtgtctctacagctcttgcggggaaccctggatatcttgaccctgagtacataatatcagacaggctgactgaaaaaagtgatgtccatagctttggaattgtcctcttagagataataacaggccaacctgtgattaaagaaataagtgagaacgagaagactcacataagtcaatgggttacctccatgcttgcaaaaggggatgttaagaatattgctgatccaaggttaaagactgattttgattttgactctttcctgaaagctgttgaaacagcgatggcttgtgtatctctaactgctgctgaaagaccaactatgaataaggtgtctatgaaattgaacgaatacttagcaatggaggttgctcgaacgaagcagactcatcagccatatgacactgaa

SEQ ID NO: 684 - protein, 838 aa, Citrus clementina
  clementine0.9_032331m
MHKILICFYISVTGFISLDCGSPKDSNYTDSLTGLNYTSDSAFIGTGISKSISPEFKTEDLNQQLWNVRSFPEGKRNCYNVKLPRAKNNKHLIRARLMYGNCDARNVTPQFDLHLQANFWVSVKLENADNIISEEIIHVPSSNYLQACLVNTGLGTPFISALEIRSLNNTIDKTKSCSLHLFSRLDIASTTKQMVRYQDDAYYDRIWMPFNLENWGKISTSLTIDDGFYIDLRPPEVVMRTAATPANASEPLEFYLITDDTLEFNFYFYFAELTKLQPNESREFNISFNGKHIYGPLSLEYLYSLAIFSVLPTMSGGDISASTGDNRFSIYKIKDSTLPPILNAIEIYTVKQLLQHHTDEQDVDAIKSIKSISGVKKNWQGDPCVPRAYIWNGLNCSYDGFDPSRIMSLNLSASGLTGEIAPYFSNLPLLQYLDLSNNSLTGPVPNFLAKLPALRILYAFDEKNKIRDYIFFLSFCRNLEGNMLTGLVPIELIERSKKGSLSLSIGGNPELCSSDTCKAKKKFVIPVAASAVTLFILITALTILWILKRRKQQVGKVDTYDSLELENRRFSHSQILRLTNNFEKVLGKGGSGTVYQGYLDTTPVAIKMLYPSSVQGTKQFEAEGLIYEYMANGNLAEQLADDCENILSWKERLQIAVEAAQEFKMWDCDRDVKSTNILLDDEFQAKLSDFGLSRTFPVQGGTRVSTALAGNPGYLDPEYIISDRLTEKSDVHSFGIVLLEIITGQPVIKEISENEKTHISQWVTSMLAKGDVKNIADPRLKTDFDFDSFLKAVETAMACVSLTAAERPTMNKVSMKLNEYLAMEVARTKQTHQPYDTE

SEQ ID NO: 685 - DNA, 2286 bp, Citrus clementina
  clementine0.9_030629m
tttatcagcatagactgcggaataccggaaaatgcaagctatagtgacaagataacaggcataaattacgtttcagatgcaacctacgtggacacgggggtaagccatagcatatcttccggatacaacaatgaagccgttgagcgacaatttttaaatttgagaagcttcccggaaggaataagaaattgctacaccctaagacctgcaaatggggatgtaaagtttctgatcagggcgagcttcatgtacggaaattacgatggccaagatatgccgccgagttttgatctcatgctcggagctgatgtttgggattctgtgcaattacaggattcagatggtattatcaccaaagagatcatccatatgcccaacaaaggctatatacatgtctgtcttgtgcacacatactctggaacacctttcatatcagcattagagttgaggcctataacaaattcaatttatgcaactcaatcaggctcactgtcacgctattttcgctgggacgtaggttcaacaaccaatgaaacattcaggtacccagatgacgtttatgatcgcatatggtctccgaacagcttctactactgggcaccaatcagcacctcgagcaatgtcgattcaaccggcaccattaatttcaatctgccatctactgtcatgcagactgccgccattccagcaaacggtgtcacttcgttggagttccattgggtgcctgttaatcgtactttcaagtattatgtctacatgcatttttcggaagttggaagtgacctagccaaaaaccagactagagaaatgtacatctatttcaatggagagaagtggcatggacctttatctccctcgcacttggaaacagttacagtatacaccacatcagccatgacgaattatagtagatatgatatcgaaatcagagctacagacaaatcgtcactacctcccatcctgaatgccttggaggtatatcaggtaaaagaattcccgcaattgctgacgcaccaacaagatgtggatgctatcacgaatatcaaatcaaaatatgaggtgaagagagattggcaaggagatccatgtacccctaaagttcacttgtggcaaggtcttaattgcagctacgatgataatcagcccccaagaatcatatccctcgttgagaggaatcccaatttctgtctttcggattcctgcaaaaagaagaacaataggtttattgttcccgtgctagcatccgttgttacgttttctgttttcttagctgcattggtaattttacagcaccttagaaggagaaaacaagctaagaagaagaagggttcattggagacgaaaaatcggaaattctcatactttgatctactgaagattaccaataactttgagagggttcttgggaaaggaggatttgggactgtttaccatggttacttggacgacaagcaagtagctgtgaagatgctctctccatcatcagttcaaggatataagcagtttcaggctgaggtcgaacttcttattagggctcatcataaaaacttgacaatccttgttgggtattgtgatgagggcacaaacatgggactgatctatgagttcatggccaatggaaacttacagtcgcatctcttagaagataaagcggatactttgagctgggaacgaagacttcagatagcatcagagtccgcacaaggattggaatatcttcataatggttgtaagccacccatagtccaccgggatgtgaagtccgcaaacatcttactgaatgaaaaattccaagccaaattagcggattttggcctttccagaatttttccagttgaaggaggaactcatgtgtcgacaacagtagttggaacccctggataccttgaccctgagtactatatatcaaacaggttaacagagaaaagtgatgtttacagctttggagtagttctcttagagttaatcacaggtcaacctgtgattcaaaaaactcctcagagaactctcataggtcagtgggtaagttccatgcttgccagaggggatattaaaaatattgtcgaccacaggttacaaggagatttcgacacaaacacagtctggaaagcggtagaaatagctctggcttgtattcataccatttccactagaaggccaacaatgaatcaggttgtgattgaactgaacgattgtttagcaatggaaatagctcgtacaaaggcgcacgagactgcaccagatggaactcctgatgaattgatgatagatttgaatctacaaagt

SEQ ID NO: 686 - protein, 763 aa, Citrus clementina
  clementine0.9_030629m
FISIDCGIPENASYSDKITGINYVSDATYVDTGVSHSISSGYNNEAVERQFLNLRSFPEGIRNCYTLRPANGDVKFLIRASFMYGNYDGQDMPPSFDLMLGADVWDSVQLQDSDGIITKEIIHMPNKGYIHVCLVHTYSGTPFISALELRPITNSIYATQSGSLSRYFRWDVGSTTNETFRYPDDVYDRIWSPNSFYYWAPISTSSNVDSTGTINFNLPSTVMQTAAIPANGVTSLEFHWVPVNRTFKYYVYMHFSEVGSDLAKNQTREMYIYFNGEKWHGPLSPSHLETVTVYTTSAMTNYSRYDIEIRATDKSSLPPILNALEVYQVKEFPQLLTHQQDVDAITNIKSKYEVKRDWQGDPCTPKVHLWQGLNCSYDDNQPPRIISLVERNPNFCLSDSCKKKNNRFIVPVLASVVTFSVFLAALVILQHLRRRKQAKKKKGSLETKNRKFSYFDLLKITNNFERVLGKGGFGTVYHGYLDDKQVAVKMLSPSSVQGYKQFQAEVELLIRAHHKNLTILVGYCDEGTNMGLIYEFMANGNLQSHLLEDKADTLSWERRLQIASESAQGLEYLHNGCKPPIVHRDVKSANILLNEKFQAKLADFGLSRIFPVEGGTHVSTTVVGTPGYLDPEYYISNRLTEKSDVYSFGVVLLELITGQPVIQKTPQRTLIGQWVSSMLARGDIKNIVDHRLQGDFDTNTVWKAVEIALACIHTISTRRPTMNQVVIELNDCLAMEIARTKAHETAPDGTPDELMIDLNLQSD

SEQ ID NO: 687 - DNA, 2403 bp, Citrus clementina
  clementine0.9_030812m
atggctgtcatgatgttaaactatttgctgccagcatttttgggtatcattatggctcatgctcagaatcaatcaggctttattagcattgactgtggaataccacatgattctagctataccgacaagataacaggcataaattacgtttcagattcaaccttcatagatactggtgtaatcaataacatatcatccgaatacagcagcaataagacacttgagcgacaatttttaaatgtgagaagcttccctgaaggaataagaaactgttacaccctaaaaccctcaagtggcgatgtaaagtttttgatcagggcaagatttatgtatggtaattatgatggccaaaacataataccaagtttcagtcttcttcttgaagctgatgtgtgggattcagtgaatctgaaagatgcatcgggcattgttactaaagagatcatccatgctccaaagaaaaattatatgtacgtttgtcttgtaaacacaggctctggaacacctttcatatcagctttagaattaaggcctctgaaaaattccacttacgaaactcagtcaggttcattacttctgtatgggaggtgggatgtaggttcaacgaccagtgaagcaatcaggtacccagatgatgtttatgatcgcatatggtcgccctatcgctccctcagatgggaaagtataactcgtcgctccgacagtactttcttcgagaacgattggcaactaccgctcacaatcatgaggacggccgtcaggccagcaaacgctagcatcaactctttgagtttttattggaagactagtactcccgaatctcaatattatatctttttgcactttgccgaagttgaagggagacaagaaaaccagactagagaaatgagcatctattcaaatggaaagttatggtatggacctttcgttccttatacctttttcacaacaactcttgtcagcatttatccctcgaaaggatcagaaagaattgatttctcaatcaacaaaactgagaactcaacactaccccccattctcaacgctgaggagatatatctggcaaaggaattcccaagttcactaacaagccaacaagatgttgatgctatcatgagtatcaagaaaaagtatggagtgaaaaaaaactggcaaggagatccatgtgcccctaaagtttacttgtggcaaggtcttaattgcagctacgatggtaatgaactcccaaggatcatatccctgaatttatcatcgagtggcatttctggcgacataattacttacatattcagtctcacttccctacaagcttttgtggacgggaacccaaaactatgccatacggcttcatgcaacaaaaggcaaaacaaaaagtatattgttcctgttgcagcatccgttgtatcgctttctgtcctcctaacagcattggcaattttatggaatctgaaaaggagaaagcaaggtgggaggaagaagggttcatgggagctgaaaaataggaaattctcatactccgatgtggcgaagattacaaataactttgagaaggttattgggaaaggaggatttggaacggtttaccatggttacttggaatttaatggcactcaagtagctgtgaagatgctctctgcatcatcagttcaagggtataagcaatttcaagccgaggtggaacttcttatgagagttcatcataaaaacttgacaacccttgttgggtattgcgatgaggacacaaacatgggactgatctatgagttcatggcgaagggtaacttagaagagcatctctcaggattggagtatctccacagtggttgtaagccacacatagtacacggagatgtcaaatcaacaaacatcttattaaatgaaaaattccaggccaaattagctgattttggcctctccagaatttttccggttgaaggcggaactcacgtgtcaacaacaattgctggaactcctggataccttgaccctgaatactatatttcgaaccggttaacagaaaaaagtgatgtgtacagtttcggagtggttctcttggagataatcacaagcaaacctgtgattgagagaacccatgagaggactcatataactcaatgggtgagtttcatgttggcaaaaggggatattaaaaatattgttgatccaacattatatggagatttcgatatcaactctgtctggaaaattgtagaaatagctatggcttgtgtctctccaacttccaccaaaaggccaaccatgactcaggtagtgatggaattgaacgagtctatggcaattgagattgctcgtacgcaggctggaaaggataatgatgaatcaaaagttttaatagaattgatcgatgtgaatctgcacagtgaacgatctcccctcgctaga

SEQ ID NO: 688 - protein, 801 aa, Citrus clementina
  clementine0.9_030812m
MAVMMLNYLLPAFLGIIMAHAQNQSGFISIDCGIPHDSSYTDKITGINYVSDSTFIDTGVINNISSEYSSNKTLERQFLNVRSFPEGIRNCYTLKPSSGDVKFLIRARFMYGNYDGQNIIPSFSLLLEADVWDSVNLKDASGIVTKEIIHAPKKNYMYVCLVNTGSGTPFISALELRPLKNSTYETQSGSLLLYGRWDVGSTTSEAIRYPDDVYDRIWSPYRSLRWESITRRSDSTFFENDWQLPLTIMRTAVRPANASINSLSFYWKTSTPESQYYIFLHFAEVEGRQENQTREMSIYSNGKLWYGPFVPYTFFTTTLVSIYPSKGSERIDFSINKTENSTLPPILNAEEIYLAKEFPSSLTSQQDVDAIMSIKKKYGVKKNWQGDPCAPKVYLWQGLNCSYDGNELPRIISLNLSSSGISGDIITYIFSLTSLQAFVDGNPKLCHTASCNKRQNKKYIVPVAASVVSLSVLLTALAILWNLKRRKQGGRKKGSWELKNRKFSYSDVAKITNNFEKVIGKGGFGTVYHGYLEFNGTQVAVKMLSASSVQGYKQFQAEVELLMRVHHKNLTTLVGYCDEDTNMGLIYEFMAKGNLEEHLSGLEYLHSGCKPHIVHGDVKSTNILLNEKFQAKLADFGLSRIFPVEGGTHVSTTIAGTPGYLDPEYYISNRLTEKSDVYSFGVVLLEIITSKPVIERTHERTHITQWVSFMLAKGDIKNIVDPTLYGDFDINSVWKIVEIAMACVSPTSTKRPTMTQVVMELNESMAIEIARTQAGKDNDESKVLIELIDVNLHSERSPLAR

SEQ ID NO: 689 - DNA, 2607 bp, Citrus clementina
  clementine0.9_033075m
atggagaaattaaggagctttcggtatgcattgctttcttgtttaactcttggagtactgattcaagctcaggatcaatctggattcattagcatagattgtgggataccggcttcttctggttacaacgatgagattacaggcatcaagtacatttcagatgaaaccttcatcgatacaggaacatcaaagagcatagcacctgaatttcagtccaacgcacttgaacgacaatttaatcacatccgaagttttcctgaaggtacaaaaaactgttacactctaaatcctgcccaaggacaaaactacaagtatttgctcagagcccgtttcatgtatgcaaattatgatggccgaaataatgtgccacaatttgatttgtttgtcggagacataatctgggatacgataaaattggataatgcttcaagtattatgaccacagagatcatacacgtccctccaagaaaaaacatttatgtttatcttgttaatactggccttggaacacctttcatttcatcacttgagctcaggcttttgaaaaattctacctatgagactcaatctctggctgaatcactttggtacaaggatgatatatatgatcgcttatggatgcctaagaactaccctggctggaaaaaattaagcacatcgctacccattgatgctgaaaatcccaatgcctttagaccggcaccagctgtgatgagtacagctgtcacatcggagaatgttagcgaaaattttttgatcgttttctgggagcctacggatcccgcttcgcaatattatgtatacatgcacttctgtgaagtagaggtcttattagcaaaccagacgcgagaattcaacatcactcagaatggcaagttttacattgggcctattgttcctacttacttgtacacaacaactgccttaagctcagtgcctgtgagcggcgcaagaatcgagtatataatcaatgcaactgagagatcaactcttcaacccattctgaatgccatggagatctatatggtcaaaaattcctcgcaattgctaacggatgaagatgatgttgatgctttaaggaatataaaatcaacatacggagttaaaagaaattggcaaggagatccgtgcgttccgaaaaattactggtgggatggtcttaattgcagttatgaggataacaatccttctcgaatcatatccctgaacttatcttcaagtggactgaccggagagatatctccatactttgccaatctcacagcaatagagtttctggatttatcgaacaatagtttaagcggaaccttccctgaatttttatctaaactgccgtctttgagagcgctaaacttaaaaagaaacaagcttacaggttctcttccagctgacctcgtggaaaggtcaaacaacgggtcgctgacattgagtgtggacggcaatacaagcacaacttgttcatccgaatcatgcaaaaagaagaagcacaagtttgttgttcctgtagtagtatcagttgctgcgttttctactgtcttatttgcattggcaatcttttgcggtcttagaaggagaaacaaacgagttggccaaaaggtggaaatggaatttgaaaacagaaatgattcttttgcaccgaaaagtcggcaatttgcatattctgaaatccagaagattacaaacaattttgagagggtccttggcaaaggaggatttggagaagtttaccatggctctttggatgacaatcaacaagtagctgttaaaatgctttcttcttcgtcagcgcaaggttacaaggagtttcatgcagaggttaaacttctgatgagagttcatcatagaaacttgacagcccttattggttattgcattgaaggcaacaacatggggctcatttacgagtacatggccagtggaaccctggatcaatatctgaaaggcaagaaagagcatatgttgaattgggtggagagattgcaaatagcagttgattctgctcaaggattggagtatcttcactatggttgtaagccgcccatagtgcacagagatgtgaaatcatccaatatcttattgaatgaaaaattacaggccaagatagctgattttggcctttcccggattttttcaattgaaagcggtgaccagatatctacagctgttgctggaacccctggttaccttgaccctgagtactatgtgctcaattggctaaatgagaaaagtgacgtgtacagctttggggttgttcttctagaaataatcacaggccgtcggccagtgatatcaagggcagaggatgacactacgcacataagtcaatgggttaattccatgcttgccgagggagatatcagaaacattgttgatccaagtttacagggcaattttgacaacaattccgcctggaaagctgttgaactagcactagcttgtgcatctcatacttcctctgaaaggccaacaatgacagacgttttgatggaattaaaagagtgtttgtcattagaaattgttcggaatgaagggcatgaaaaaggacatagagatccaagaagaatggtcacacttaatctggatactgagtcttctccttcagcaaga

SEQ ID NO: 690 - protein, 869 aa, Citrus clementina
  clementine0.9_033075m
MEKLRSFRYALLSCLTLGVLIQAQDQSGFISIDCGIPASSGYNDEITGIKYISDETFIDTGTSKSIAPEFQSNALERQFNHIRSFPEGTKNCYTLNPAQGQNYKYLLRARFMYANYDGRNNVPQFDLFVGDIIWDTIKLDNASSIMTTEIIHVPPRKNIYVYLVNTGLGTPFISSLELRLLKNSTYETQSLAESLWYKDDIYDRLWMPKNYPGWKKLSTSLPIDAENPNAFRPAPAVMSTAVTSENVSENFLIVFWEPTDPASQYYVYMHFCEVEVLLANQTREFNITQNGKFYIGPIVPTYLYTTTALSSVPVSGARIEYIINATERSTLQPILNAMEIYMVKNSSQLLTDEDDVDALRNIKSTYGVKRNWQGDPCVPKNYWWDGLNCSYEDNNPSRIISLNLSSSGLTGEISPYFANLTAIEFLDLSNNSLSGTFPEFLSKLPSLRALNLKRNKLTGSLPADLVERSNNGSLTLSVDGNTSTTCSSESCKKKKHKFVVPVVVSVAAFSTVLFALAIFCGLRRRNKRVGQKVEMEFENRNDSFAPKSRQFAYSEIQKITNNFERVLGKGGFGEVYHGSLDDNQQVAVKMLSSSSAQGYKEFHAEVKLLMRVHHRNLTALIGYCIEGNNMGLIYEYMASGTLDQYLKGKKEHMLNWVERLQIAVDSAQGLEYLHYGCKPPIVHRDVKSSNILLNEKLQAKIADFGLSRIFSIESGDQISTAVAGTPGYLDPEYYVLNWLNEKSDVYSFGVVLLEIITGRRPVISRAEDDTTHISQWVNSMLAEGDIRNIVDPSLQGNFDNNSAWKAVELALACASHTSSERPTMTDVLMELKECLSLEIVRNEGHEKGHRDPRRMVTLNLDTESSPSAR

SEQ ID NO: 691 - DNA, 3726 bp, Vitis vinifera
  GSVIVT01016910001
atgtgggacagtcttaactgcagctatgatggtcatgaaccccccaggatcatatccttgaacttgtcctcaagtggattgactggggaaatagctccttctatatcaaatctaacgttggtacaatatctggatttatcaaacaatggcttaactggaccagtacctgattttctttctcaacttccattgttgagggcccaaaacttgacaggaaacaagctgacaggatctattccagttgaactcattgaaagatcagagaatggatcactgctattgagtgtgaatgaaaatccaaatctttgttggtcgggttcatgcaaaaagaaaaagaagtttgttgttccaatagtggcatcagttgctgcactattcattctcttaactgcactggctatcttctggaagcatagaagggggggaaaacaagttagtaaggatcaggaaatggtttccgaatccaacagagatgaagggtctttggtgtcaaaaaaacagcaatttacatattctgaggtcatcactatcaccaacaactttgagaaggaagtggggaaaggtggatttggaacagtttaccatggccatctagatgacactcaagttgctgtgaagatgttctctccatcatcaattcaaggatataagcagtttcaggcagaggcaaaacttcttatgagagttcaccacagaaacattacttctcttattggctattgcaaggaaggcaacaacatggggctcatctatgagtacatggccaatggagacttacagaggcatccatctggtaatgagagaaatacaaatgttctgagttgggaagagagactaagaatagcagtggagacagcacaaggattggagtatttgcacaatggttgtaagccacctataatccacagagacataaagtctaccaacatcttattgaatgaaaaattccaggccaaactagctgattttaggctgtccagagcttttccaaatgaaggcagcactcatgtgtcaacaatagttgctggcacccgtggctaccttgatcctgagtaccatgcatcaaacaggttgactgagaaaagcgatgtttttagctttggggttgttcttttagagatcatcacaagccagtccccagttcctggaaatcatgaggagactcacataattcaatgggttagttccatgctagcaaatggggatattaagaatattgttgaccccaggctacagggagactttgacatcaattctgcctggaaagctgtagaagtagcaatgtcttgtgtagcttccacttcaactgaaaggccagctatgaactatgtagattacaggacaatccccttcattctagatgatgtttgtgccaaactgaattcatctgctgctataggtatcacatttggcaattatcatgaaggtaaaataactatgaagcagacatttcaaactcagaagagattgttagatttttgttttagatcacatatcttgtattaccaattggaagtgagagtgcatcacctgaatttggaatcaatagccttctacagcaatcttggaacttcagaagctcccctgaaggagtacaaaaactattacaccctgagacctgcaagagacaaaggcaataaatgcttaatgagggcatggtccatgcattggaatcatgatgctgaagataggactataggacagcactcacaatttagattatgtgctaagcatgaaccatgtagtgatggaattacagcagttaacagaaatagctggatccacatactggaactactcccctggctcagtagtacagtttacatgactctcagtaatgcccaaaattcaaatgtcatacatgcttcctgcactaatggaagactattggatcaggcaaaaatttgcaccatttgtctcaagaaccagttttccaagccaaggaggttatcaccctccaatgccaagctgggatttcctctattaggggaggaaagcatttaccacagagctgctgtgccccattgcaaaaagaatctgaagaaggtgatggacatgttaaaaggctctctatttgaattacttggtacttttgctcttatatttctcgttcatgcccaggatcaatcaggctttataagcatagattgtgggatatcagaagattccagctataccgatcaggtgactggtatatattacacttcagatgcaaccttcattgatactggtataagtaacagcagaggtaataaatatttgatcagagcacagttcatgtatggaaattacgatgccaaaaatcagctaccagaatttgatctgattcttggagtaaatatgttggagtcagtgcaattggataatgcatccagtgtcataagcaaggagatcatacatgtcttgttattggataattccatgtatgaaactcaatcaggatcactagtacgctatgcaaggtgggattttggttcaccctatgaattaataaggtttaaagatgataactgtgatcgcttttggttcccatacaactcgggtgaatggaaaatgttaaatacctcgcgtactattgacactgatgatgacaacaaacttcaactaacatctattgtcatgagcactgccgtcaaaccactaaacacgatggaacctttgaagttctcctgggagtccactgatccgacttctaaattttacatctatttgtactttgctgaagtggaggaactccaattaaatgagtccagagagtttaacatctttctgaatggaaatttatggcatggaccacttactcctgaaagttttgaagcaactgcaatgtacagaatttcatccagcatcagtgaaaagtttgagttttcaatctataaaaccaatagttcaacacttccccccatcatcaatgctctcgaagtttatctagtaaaacaactcctgcaatcacaaacagaccaaaaagatgttgatgccatcatgaatatcaaatcattgtatggagtgaagaaaaactggcagggagatccttgtgcgcctgaaaattactcatgggagggccttaactgcagctacaatgactacaatccccccaggatcatatccttgaacttgtcctcaagcagattgactgggaacataactccttatatatctaacctcacactcttacagtctttggacttatcacaaaatggcttgaatggaccaatacctgattttctatctcaactgccactcttgaggtccctaaacttaacaggaaacaagctcacaggatcagttcccgttgaactcattgaaagatataagaatggatcactgttgttgagtgtgaagagcaatccagaactttgttggccaggctcatgcaaaaagaagaacaagtttgttgttccagtagtggtatcagttactgcagcattcattttcttaactacactggctaccttctggtggattagaagaggaagacaagaagttgggaaggtagaggagatggatgctgagatggactcaaacaaacgccagtttacatattctgaggtcctgactattaccaacaaccttgagaaggttgttggaaaaggaggatttggaactgtttactatggtcatctagatggaattcaagttgctgtgaagatgctctctcaatcatcaattcaaggatataagcaatttcaggctgaggtaaattacaacaagttcatcacagaaatg

SEQ ID NO: 692 - protein, 1242 aa, Vitis vinifera
  GSVIVT01016910001
MWDSLNCSYDGHEPPRIISLNLSSSGLTGEIAPSISNLTLVQYLDLSNNGLTGPVPDFLSQLPLLRAQNLTGNKLTGSIPVELIERSENGSLLLSVNENPNLCWSGSCKKKKKFVVPIVASVAALFILLTALAIFWKHRRGGKQVSKDQEMVSESNRDEGSLVSKKQQFTYSEVITITNNFEKEVGKGGFGTVYHGHLDDTQVAVKMFSPSSIQGYKQFQAEAKLLMRVHHRNITSLIGYCKEGNNMGLIYEYMANGDLQRHPSGNERNTNVLSWEERLRIAVETAQGLEYLHNGCKPPIIHRDIKSTNILLNEKFQAKLADFRLSRAFPNEGSTHVSTIVAGTRGYLDPEYHASNRLTEKSDVFSFGVVLLEIITSQSPVPGNHEETHIIQWVSSMLANGDIKNIVDPRLQGDFDINSAWKAVEVAMSCVASTSTERPAMNYVDYRTIPFILDDVCAKLNSSAAIGITFGNYHEGKITMKQTFQTQKRLLDFCFRSHILYYQLEVRVHHLNLESIAFYSNLGTSEAPLKEYKNYYTLRPARDKGNKCLMRAWSMHWNHDAEDRTIGQHSQFRLCAKHEPCSDGITAVNRNSWIHILELLPWLSSTVYMTLSNAQNSNVIHASCTNGRLLDQAKICTICLKNQFSKPRRLSPSNAKLGFPLLGEESIYHRAAVPHCKKNLKKVMDMLKGSLFELLGTFALIFLVHAQDQSGFISIDCGISEDSSYTDQVTGIYYTSDATFIDTGISNSRGNKYLIRAQFMYGNYDAKNQLPEFDLILGVNMLESVQLDNASSVISKEIIHVLLLDNSMYETQSGSLVRYARWDFGSPYELIRFKDDNCDRFWFPYNSGEWKMLNTSRTIDTDDDNKLQLTSIVMSTAVKPLNTMEPLKFSWESTDPTSKFYIYLYFAEVEELQLNESREFNIFLNGNLWHGPLTPESFEATAMYRISSSISEKFEFSIYKTNSSTLPPIINALEVYLVKQLLQSQTDQKDVDAIMNIKSLYGVKKNWQGDPCAPENYSWEGLNCSYNDYNPPRIISLNLSSSRLTGNITPYISNLTLLQSLDLSQNGLNGPIPDFLSQLPLLRSLNLTGNKLTGSVPVELIERYKNGSLLLSVKSNPELCWPGSCKKKNKFVVPVVVSVTAAFIFLTTLATFWWIRRGRQEVGKVEEMDAEMDSNKRQFTYSEVLTITNNLEKVVGKGGFGTVYYGHLDGIQVAVKMLSQSSIQGYKQFQAEVNYNKFITEM

SEQ ID NO: 693 - DNA, 2682 bp, Solanum lycopersicum
  Solyc03g121230.2.1
atgactagagacttgatttttacctttctaatttgtatttctctctttgcacttgaagctaacgcccaaattgatcaatcaggattcataagcatagattgtggaattcctcgaggttccaactacaccgatgtagctactggactccaatatgtttccgattcagcattcgtggatacaggtagtaacgctactatctcgagtgagtttcactccgatgacctggaacaacagttgtacacactcacaagttttccccaaggaaaacgaaattgctacaccattagagttgcagaaggaaaaggaaaaaaatacttgatcagggctagttttttatacggaaactatgatggaaagagtcagctactgatcaattttgatcttcacctcggagttgacttttggaccacgattcaaattgtcaatgcttcagttccgttatatgaagagatcatacacattctctcatcggattttgttcaggtttgtctagtaaataaggatcgaggaacaccatttgtatccgcacttgaattgagactcttgaactcaaccatatacaagacaacatccgggtcactacaaacattcgtacgtctagatcttggctcaacagccactcaaatagtaaggtaccaagatgacatatacgatcgtttatggtggccatataataatgatgaaaacacgatatcattgagtacgacttcaaccattgataacaccaacagttatctaccgccgacaaaggtgctgagcacagcaatagcagcagataatgacaccgatggaatatcactttggtgggaacctgcgaattcaacagatgagtattatatctacttgcactttgcagagattgaagccaaccatgtcaataggcaattcaacatatatgtggatggagagttgtatcaggggtcatttgctccggactatatgtctgtaaccacaattttttcaacatcagctctaaagccaaaagacaggcaccaaatttccctcaacaaaacgggaaattcaattcgtcatcctaccatcaatgccatagagttgtataaagttgtcaagcaaatcataaacccccaaacaaatgacttagatgttgaggctattatgaatgtcaaatcaacatacgaggttaaaaagaactggcaaggagatccatgcggccctgtagctgacatttggaagggtgtcacatgcaattttaatggggatctccccacagttatttccttagacttatcttcaagtgaattacaaggggcaatatcgccttacataataagtctcacaaaactagaaacgttgaacatgtcaaacaatcagctgacgggagaggtgcctcccaatctctcacaactagccttcttacaagagctggacttgtcaaacaatctgctgacgggaaaggtccctgccaatcttgcaaaactaccctacttaaaaaaactatacttgaaaggaaacagtttctccgaaaaaattcctgaagaattgctggaaaaatcaagaaatggatcactcgatttgagatatgatgaatttagtcctcctcctcctccgaaagatgaaattagtcctcctccgaaagatgaatttcttcctccgaaagatggtaataacctcagtgctggtgcactagcaggaattattgcatccgtggtggtcttgggcgtcttggccttactactgcttctttggtttataattcgaaggatgaaaaacaaaaaaggtaagatcactgagacagaaacaacagtacagagtccaaaaattgcattggagttgaaaaacaggcagttcacatactcacaggtgttgcacatgacaaataacttccagagagtccttggtaaaggaggttttggaacagtttatcttggctatgttgataaccgtgacgtggctgttaagatgctgtccccatcttcagttcaagggttcaaggaattccaggctgaggctagtctcctgatgagcatacatcataagaacttgatttctatagttgggtattgtgttgaaggcaaccacattggtattatttacgaatacatggccaatcgaagcttagacatgcaactatcagatagaaatccaaatgctttaacatgggaggaaagacttcatatagccttggatgcggcacaaggactggagtatctgcatcatggttgccagccatcaataatacacagagatatcaagtctagtaatattctattagatgataaattccaagcaaaacttgctgattttggtttgtcaaggactttaccaactggggagggaagtcatgttaccaccataatcgcgggtagtccaggctatcttgaccctgattactacaggacaaataagctaacggagaaaagtgatgtatacagtttcggtgtggttcttttggaaataataacaggacggcatttactaggaaaacatgacaagatttatgtaataacatgggtcaatggtatgattaatgataacggagatgtttcaaaagtaatcgatccaagattaggaggacaagttgatctgaattcagcaaagagaattgtggcattggcaatggcttgtgtttctcttgaaccaacaaatagaccagctatatctctcgttgtcacgataataaaacaatgtttaagacagatgattgagaattatgactcgaat

SEQ ID NO: 694 - protein, 894 aa, Solanum lycopersicum
  Solyc03g121230.2.1
MTRDLIFTFLICISLFALEANAQIDQSGFISIDCGIPRGSNYTDVATGLQYVSDSAFVDTGSNATISSEFHSDDLEQQLYTLTSFPQGKRNCYTIRVAEGKGKKYLIRASFLYGNYDGKSQLLINFDLHLGVDFWTTIQIVNASVPLYEEIIHILSSDFVQVCLVNKDRGTPFVSALELRLLNSTIYKTTSGSLQTFVRLDLGSTATQIVRYQDDIYDRLWWPYNNDENTISLSTTSTIDNTNSYLPPTKVLSTAIAADNDTDGISLWWEPANSTDEYYIYLHFAEIEANHVNRQFNIYVDGELYQGSFAPDYMSVTTIFSTSALKPKDRHQISLNKTGNSIRHPTINAIELYKVVKQIINPQTNDLDVEAIMNVKSTYEVKKNWQGDPCGPVADIWKGVTCNFNGDLPTVISLDLSSSELQGAISPYIISLTKLETLNMSNNQLTGEVPPNLSQLAFLQELDLSNNLLTGKVPANLAKLPYLKKLYLKGNSFSEKIPEELLEKSRNGSLDLRYDEFSPPPPPKDEISPPPKDEFLPPKDGNNLSAGALAGIIASVVVLGVLALLLLLWFIIRRMKNKKGKITETETTVQSPKIALELKNRQFTYSQVLHMTNNFQRVLGKGGFGTVYLGYVDNRDVAVKMLSPSSVQGFKEFQAEASLLMSIHHKNLISIVGYCVEGNHIGIIYEYMANRSLDMQLSDRNPNALTWEERLHIALDAAQGLEYLHHGCQPSIIHRDIKSSNILLDDKFQAKLADFGLSRTLPTGEGSHVTTIIAGSPGYLDPDYYRTNKLTEKSDVYSFGVVLLEIITGRHLLGKHDKIYVITWVNGMINDNGDVSKVIDPRLGGQVDLNSAKRIVALAMACVSLEPTNRPAISLVVTIIKQCLRQMIENYDSN

SEQ ID NO: 695 - DNA, 2401 bp, Glycine max
  Glyma13g42910.1
atggaaggacactttctatttctgatgtttcatctctctttaactcttcctatcattgttcgagcacagaatcaatcaggcttcattagtattgactgcggacttgaggatgaaccaaactacacagatgaaaccacttccatctattactcttcggatgtcaacttcacaaacagtggtgtaagccacagtatatcatctaaatacaaggcttcccttgacaggcagttctggaatgttagaagcttcccggatggaaccaggaactgctatacccttgttgttcctcaagtaagtagcaagaaatatttagtgagggcaaggtttgcatatggaaattacgatggaaaagactctcttcccgagtttgacatctatcttggagacagttggtggggatcagtggtgtttcaggatgcatccagtgtagtcaccaaggaaatcatttatgctgcttcatccaactatgctcatgtttgtttattcaacactgcaaagggtacaccctttatttcagttttagagcttagagttcttaacagtgaggcctatctagttaactttgtggagctattggcacgatttgacgtaggcttacaggatggtgaaataatcagatatccggatgatgtctacgatagaatatggacaccttataactcaaatgaatggacacagatagataacacccttaccatagaccatgatgctactacgtcatttgattttttaccattgccgccttccattgtcatgggaactgcagcaattccagcaaatgtcaatgacaatatagaattccacttccttcccaaaaataatgcatccacatgttatgtgtacatgttctttgctgaactacagaagctccaggcaaaccaaattagagagttcaacatttttgtaaatggggacattttaaataatgctccaatcaatcctatatacctgcagaatgcgtatcatttagcaataattgaaaatccgttggaactttggattaataaaactagtggatcgactcttccacctcttctcaacgccatcgagatatacatgacaaaaaacttctcactatcagaaacatatcaaacagatgttgatggtatcataaatgtcaagtcaatctatgggatcaagagaaactggcaaggagatccttgtaccccactggcttacttgtgggatggtcttaactgcagctatgctgaatctgattcaccaaggatcatatacttgaacttatctttcagtggtttaataggaaacatagcccctggcatatcaaatctgcagtccattgaatatttggatttgtcaaacaacaatttgactggggccgtgcctgaattcctatcccaactgcgcttcttaagagttctgaacctagaaggaaatcagctatcaggaacaattccaatgcaactcattgtaaattccgagaatggtttgcttgaattcatcaagcagaatgcttattacaaaataagggaggaactagagtcaaataaacaagaattcacctatgccgaagtcttgagcatgaccagaaattttgaaagggttgttgggaaaggaggatttgctacagtgtaccatggctggatagatgatactgaggtagctgtcaaaatgctctctccctcagctcaaggatatctgcaatttcaggcagaggccaaacttcttgctgtagttcatcataaattcttgactgctctgataggatattgtgatgatggcgaaaatatggctctcatctatgagtatatggctaatggagacttagcaaagcatttatcaggcaaaagcaaaaatatattgagttggaaccaacgaattcaaattgcagtggatgctgcagaaggattggagtacctgcatcatggctgcaatatgccgattgttcacagagatgttaagtctaaaaacatcttactgaatgaaaaattccggggtaaactagctgattttgggttgtcaaagatctactcagatgaagatgacacccatatgaccacagtggtagctggcacccttggatatcttgacccagagtacaatagatcacacaaattgagggaaaaaagtgatgttttcagttttgggatagttttgtttgagataattacaggtcaacctgctataaccaaaaccgaagagagaactcacataattcaatgggttgattctatactgcttgaaagggggatcaatgatattgtggattcaagattgcagggagaatttgatattcatcatgtgaagaaggccttagacactgcaaaggcttgtgtagcaaccacttccattaataggccaaccatgacccatgtagttaatgaattgaaacaatgtttctcaaaaatgatgacaactccgtctaattctgacgatcatg

SEQ ID NO: 696 - protein, 802 aa, Glycine max
  misc_feature (802)..(802): Xaa can be any naturally occurring amino acid
  Glyma13g42910.1
MEGHFLFLMFHLSLTLPIIVRAQNQSGFISIDCGLEDEPNYTDETTSIYYSSDVNFTNSGVSHSISSKYKASLDRQFWNVRSFPDGTRNCYTLVVPQVSSKKYLVRARFAYGNYDGKDSLPEFDIYLGDSWWGSVVFQDASSVVTKEIIYAASSNYAHVCLFNTAKGTPFISVLELRVLNSEAYLVNFVELLARFDVGLQDGEIIRYPDDVYDRIWTPYNSNEWTQIDNTLTIDHDATTSFDFLPLPPSIVMGTAAIPANVNDNIEFHFLPKNNASTCYVYMFFAELQKLQANQIREFNIFVNGDILNNAPINPIYLQNAYHLAIIENPLELWINKTSGSTLPPLLNAIEIYMTKNFSLSETYQTDVDGIINVKSIYGIKRNWQGDPCTPLAYLWDGLNCSYAESDSPRIIYLNLSFSGLIGNIAPGISNLQSIEYLDLSNNNLTGAVPEFLSQLRFLRVLNLEGNQLSGTIPMQLIVNSENGLLEFIKQNAYYKIREELESNKQEFTYAEVLSMTRNFERVVGKGGFATVYHGWIDDTEVAVKMLSPSAQGYLQFQAEAKLLAVVHHKFLTALIGYCDDGENMALIYEYMANGDLAKHLSGKSKNILSWNQRIQIAVDAAEGLEYLHHGCNMPIVHRDVKSKNILLNEKFRGKLADFGLSKIYSDEDDTHMTTVVAGTLGYLDPEYNRSHKLREKSDVFSFGIVLFEIITGQPAITKTEERTHIIQWVDSILLERGINDIVDSRLQGEFDIHHVKKALDTAKACVATTSINRPTMTHVVNELKQCFSKMMTTPSNSDDHEX

SEQ ID NO: 697 - DNA, 2595 bp, Solanum lycopersicum
  Solyc03g093380.1.1
atggatttcaagttacaaaaatatttcctttttcccctccttgttcttttggcgatcacccttttaactcactgcagcccaccagtttatgatgatcaatcaggattcgtgagtatcgattgtggattaccagaaaactcaacttatagtggcagtatgtttccagtaacttacacgagcgatgaaatgttcataaacacgggtgtaaatgcacgtctattgcctaaattcatttccaattatacagaaatttacttagaaactgttagaagctttccacaagggaaaaggaactgttacaatctaagatcatctaaagacaaagatagcaaatttctaatacgtgcttttttcatgtacggtaactatgataataaaagtcatgtaccaaagtttgatttgcatattggtactgagctgtgggacacaattcaactggataattcctctcatgtagtcacaaaagagatcatacatgttttttctacgaattatacgaacgtatgcctcgtaaatacgggcaacggaacaccttttatttcagcgttggagctgcgacgattcagaaattcaatgtatccttctgaatatgaaatatctttggagcttaaaatgcgttacaattttgtttatggtactatgccattgaggtatagctttgatgcttacgatcgaatttgggaagctcttcaacttccagaatgggatagtgtttccacaagacgagaagtcgacagagatatcgagaatgatttttacccaccaactctggctatggggacggcagcaacgccactcaattctactacctggactctctcttggggtcctgcagatcccaatattgactaccatacctacttgtattttgctgaactagtgagccttttgcctaatcagaccagaaaattcgatgtcatcattaatagtgaaacggcctcctgggaggaatttgagccagagtatttgactacttttgtgatgagcgacaagcgaaaggctagcaattttaactatactttgcgtcaaaccaacaattcaacattgccgccgcttattaacgcgcttgaggtttatgctgctaaacggttcttcaaggttcatactgatgaaaatgatgttgatgcaatcatggaaattaagagaacttatgatgtaaagaaaaactggcaaggagatccatgcttgccaaaagattacacatgggaaggtcttcgctgcaattacagttccagcaattccacaagaattataggcttggacttgtcctccagtggattaagtggggacattccatcttctctatcaaatctaactgctttacagtacttggatctgtcggacaatgatttaacaggtccaataccaagttctcttgctggatttgcgttcttgagattcttaaacttaactggaaacaagttctggggttcaattcctcttggacttgctgaaaaggcgaataatgaaaccttgttgctcagcatggatggattcgtacccctcattaagaatcagtgtcaatcagctcaatgtacaaaaaagaagctttctattccagtagttgcatcagtagctgtactgttgatgctcttgattgtggcaatcaccatctattacttcaccaaacgcaaaggggataaaagggttgattcttttgactcaagaagccaacgtttttcatacactaaaatagtgagtatgactaacaactttgagaagattttaggcagaggtggatttggattagtataccatggttacttggacaacaaagaagttgctgtgaagatgcttgctgagacaggatacaaggaatttcaaattgaggctgagctattgggaagagttcatcacagaaacttgatttcacttgttgggtattgttatgaaggtgcttacatggcgcttgtgtacgagtacatggcaaatgggactgtaaaggagcatctcaatggtccaaaatcattgacttggatagagagacttcaggtggccctgaatggagcagaaggtttggattatctgcataatggttgcactccacctattgtccacagagatgttaagagtaccaacatcttattagatgataacttccatgcaaaacttgccgattttggaatttctagagctttttctgtagatgagagctctttcgtgtcaactgcagttgttggcactatcggttatctcgatccggagtatgctcatttacagaaattgcatgaaaagagtgatgtttatagctttggagtcgtgcttttggaactcatcacagggcagcctcctgtaataacaagcaagaactgtcacataactcagtgggttggtaattctcttaccactggtgatgttgccgatgttattgacccgagtctagatggaacctatgatagtgaattggtggaaaaatatgtaagattagcaatcagttgttgctcaccctcttctgctaataggccaaccatgcattatgtgtctagcagactggaggaatatttagaagctgcaacagaggctactaaaggcataatggtttatattgaagattcaacaacaatcccatatgatagcaatttctcaaacaaattt

SEQ ID NO: 698 - protein, 865 aa, Solanum lycopersicum
  Solyc03g093380.1.1
MDFKLQKYFLFPLLVLLAITLLTHCSPPVYDDQSGFVSIDCGLPENSTYSGSMFPVTYTSDEMFINTGVNARLLPKFISNYTEIYLETVRSFPQGKRNCYNLRSSKDKDSKFLIRAFFMYGNYDNKSHVPKFDLHIGTELWDTIQLDNSSHVVTKEIIHVFSTNYTNVCLVNTGNGTPFISALELRRFRNSMYPSEYEISLELKMRYNFVYGTMPLRYSFDAYDRIWEALQLPEWDSVSTRREVDRDIENDFYPPTLAMGTAATPLNSTTWTLSWGPADPNIDYHTYLYFAELVSLLPNQTRKFDVIINSETASWEEFEPEYLTTFVMSDKRKASNFNYTLRQTNNSTLPPLINALEVYAAKRFFKVHTDENDVDAIMEIKRTYDVKKNWQGDPCLPKDYTWEGLRCNYSSSNSTRIIGLDLSSSGLSGDIPSSLSNLTALQYLDLSDNDLTGPIPSSLAGFAFLRFLNLTGNKFWGSIPLGLAEKANNETLLLSMDGFVPLIKNQCQSAQCTKKKLSIPVVASVAVLLMLLIVAITIYYFTKRKGDKRVDSFDSRSQRFSYTKIVSMTNNFEKILGRGGFGLVYHGYLDNKEVAVKMLAETGYKEFQIEAELLGRVHHRNLISLVGYCYEGAYMALVYEYMANGTVKEHLNGPKSLTWIERLQVALNGAEGLDYLHNGCTPPIVHRDVKSTNILLDDNFHAKLADFGISRAFSVDESSFVSTAVVGTIGYLDPEYAHLQKLHEKSDVYSFGVVLLELITGQPPVITSKNCHITQWVGNSLTTGDVADVIDPSLDGTYDSELVEKYVRLAISCCSPSSANRPTMHYVSSRLEEYLEAATEATKGIMVYIEDSTTIPYDSNFSNKF

SEQ ID NO: 699 - DNA, 2715 bp, Citrus clementina
  clementine0.9_001865m
atgaggtttatattcatatcactctttgccatttgtgtttgcattgaaaagcaaacagttttggcttctgatgctacatcttctggcaagagtgagaaatttgtcggtcacaagcatgctagaaggaaactagatgacataggaggcgacataagtatagactgcggggtaccggcaggtttcatgtaccttgacgaaaaaacacagctaagttacaaatcggatgaagaatttatcagaactggagtgaataagaacatttcttcaaagttcatgtctgcaaatcttcaaaacacttatgcaactgtcagaagtttccctgaaggaaatagaaattgttactcacttagacctccagaaggcaaagcaaagacctacttgacaagggcttctttcatgtatggggattatgatgacgaagacaagctgcctgaatttgatctatacattggagttaaccgatgggacagtataaagttcgacaatgcatctcatgttgtaattaaagagattatacattcagccttaatggatgaaattaacgtttgtctcctcaatactggtaaaggaactcctttcatttcagcattagagctaaggcatttccataatgccacttacagaactcaatctggagctttagtgttataccggcgccttgatgtcggttcaacgaccactcagataatcaggtttaaagatgatcactatgatcgaatttgggttccttaccctggtttccctggttctgcatcaatcaatacctcattcatcattgattccctggttgattctcagtatagactaccatcagctgttatgaaaactgctgtcaagccaatgaatgttaatgattcattggattttgactttgaaattggcgatccgacattacagttctatgtgtacatgcactttgctgaacttgaaagccgccaagggaaccagtacagagaattcagcatagaactgaatggtaacttgtgggagaagtcagttgttcctgagtacctacagtcaaaaactatatctagcacacagccggcgagaggaagcaagctcaatttctctttgtgtaaaacatcaaattccaccctccctcccattctaaacgcaatagaaatatatattctgacagatacattacaagaaccaacggaccaagatgatgtcaatgcaatcatggacataaagttgagctatgatgtgggtaaaggctggcaaggagatccatgctctccaatgtattattcttgggatggcctgaattgcagctacaacggttacaaacccccaaaaattatctctttgaatctaacgtcagaaggattgacaggcaagatatctccttcactgtccaatctaaagtcactagagaatctggacttatcgaacaacagcttgaccggatcaattcctgaatttctgtcacaactacctctcttgagagttctgaacttggacggaaacaaactctccggttcagttcccacatctctcgtggcaaggtcacagaatggatcactcttattgagcatcggcagaaacccagatctttgtttgtcagctccatgcaagaaggaaaagagaaatagtgtgatgccggtagttgcagccagtgtgtcattgctagttattttaattgcattgcttgttttctggacctataaacgaaaacgagctgcaaggctgaatgtcgataattctcactcaaagaaagaagggtctttaaaatcagataatcaacagtttacgtactctgagattgtggatatcactaataacttccacaggattcttggaaaaggagggtttggaacagtttaccatggctacttggcagatggttctgaagttgccatcaaaatgctctctgcctcatcatctcaagggcctaagcaattccgaaccgaggcacagctcttgatgagagttcatcacagaaacttagcttctcttgttggatattgcaatgatggtggaaacgttggactcgtctacgagtatatggcatatgggaacttgaagcaatatctatttgatgaaacaaaggaagctttgagttggaaagatagacttcaaattgcagttgatgcagcacaagggctagagtacttgcatcatggctgcaagccgcctataattcacagagatgtgaagactgccaacattttgttgaatgaaaaaatgcaggcaaaattagcagattttggattctcgaaaattttcccagctgaaagcgaaagtcatatatcgacatcaattgttggcacagtcggttaccttgatccagagtattatgcatcgaatcggctaaccgagaaaagtgatgtgtacagctttggaattgttctgttagaactaatcactggcctgcctgcaataataagaggctataataacactcatattgttaatagggtgtgtccatttcttgaaagaggggatgtcagaagcatcgttgatcctagactggaagcaaattttgacactaattccgtctggaaagttgctgagactgcgatggaatgtgtgccatcaatttccttccaaagaccaactatgagccatgtggtgacagaactaaaaaagtgcctggaaatggaaaccgcccgtgaacaaattcagagaacaaaaagccaaatgctgagtttaagcagttcagttgacataagtgctgtggaagttgaaacagaaatgggtcctgaagcaagg

SEQ ID NO: 700 - protein, 905 aa, Citrus clementina
  clementine0.9_001865m
MRFIFISLFAICVCIEKQTVLASDATSSGKSEKFVGHKHARRKLDDIGGDISIDCGVPAGFMYLDEKTQLSYKSDEEFIRTGVNKNISSKFMSANLQNTYATVRSFPEGNRNCYSLRPPEGKAKTYLTRASFMYGDYDDEDKLPEFDLYIGVNRWDSIKFDNASHVVIKEIIHSALMDEINVCLLNTGKGTPFISALELRHFHNATYRTQSGALVLYRRLDVGSTTTQIIRFKDDHYDRIWVPYPGFPGSASINTSFIIDSLVDSQYRLPSAVMKTAVKPMNVNDSLDFDFEIGDPTLQFYVYMHFAELESRQGNQYREFSIELNGNLWEKSVVPEYLQSKTISSTQPARGSKLNFSLCKTSNSTLPPILNAIEIYILTDTLQEPTDQDDVNAIMDIKLSYDVGKGWQGDPCSPMYYSWDGLNCSYNGYKPPKIISLNLTSEGLTGKISPSLSNLKSLENLDLSNNSLTGSIPEFLSQLPLLRVLNLDGNKLSGSVPTSLVARSQNGSLLLSIGRNPDLCLSAPCKKEKRNSVMPVVAASVSLLVILIALLVFWTYKRKRAARLNVDNSHSKKEGSLKSDNQQFTYSEIVDITNNFHRILGKGGFGTVYHGYLADGSEVAIKMLSASSSQGPKQFRTEAQLLMRVHHRNLASLVGYCNDGGNVGLVYEYMAYGNLKQYLFDETKEALSWKDRLQIAVDAAQGLEYLHHGCKPPIIHRDVKTANILLNEKMQAKLADFGFSKIFPAESESHISTSIVGTVGYLDPEYYASNRLTEKSDVYSFGIVLLELITGLPAIIRGYNNTHIVNRVCPFLERGDVRSIVDPRLEANFDTNSVWKVAETAMECVPSISFQRPTMSHVVTELKKCLEMETAREQIQRTKSQMLSLSSSVDISAVEVETEMGPEAR

SEQ ID NO: 701 - DNA, 2613 bp, Glycine max
  Glyma15g02440.1
atggatggaaaatggagatgccattgggcttggagctgcaccttgtggtgtgtccttgcatataccgtttcagaatttactggaaagtccatagttatggccacagggaagaactctatgcatcacaaacaaggaagaaggaaactagatgatgtaactggttctatttgcattgactgtgggatagcagaaggccttgactatactgatgacaaaactcagattcattacacttcagatgcacagttcattggcactggaacaagcaaaagcatatcccacaagttcatttctgacacaccccaaagaactttcacaaatgtaagaagcttccctgaggggaaaaagaattgctacacgctacgacatccagaaggcagaaatactatttacttgataagagcttcgttcatgtatgggaactatgatgacttgaataagctgccacaatttgatctctatattggggttaatttatgggacactgtgatgtttgaaaatgccactcatgtggtaatcaaggagattctacatgtgccatccttggatgaattatatgtttgtttattgaacactgataaaggaactccttttatatcagcactggaggtgaggcactttgatcattccagttacagaacaaaatctgaactcttatccctctatagacgttttgacattggatcaacaaccaatgaaatagtgaggtatgacaaagatgtttacgatcgaatgtggtatccgtacaacttacctgattctacaccactcaatacttccttcaccgtcgactccttgaaccatactgcatatcacttgccatcagcagtaatgaaaactgctgtgaggccgacaaatgaaaatgattccctggaatttgaatttgacactgggcaacctacttcagagtcttatgtttacatgcactttgctgaaatcgaagtgcttaatgaaaatgaatgcagggcatttgacattacattgaatggaaaattatgggctgaatatgtaactcccacgtatttgcagtcaaatacaatagatggtaatcagtccattaggggaagtaagctcaagttctctatgcacaagaaaccaaattccacccatccacccattctaaatgcaatggagatttacattgttaaagaattcttgcattctcctacaaaccaagatgatgttaaggctatcatcgacatcaaatcgcattacaagttgacatcatcggtgggtaaatcctggcaaggagatccttgcgcaccatcgaaatactcttggaatggactcaactgcagcaataatggatataatccacccacaataactgcattatatctggcctccagtggattaggtggcacaataattgcatcatttttggagctcaaattcttagaatccttggatttatcaaacaatagcttaacaggacctctacctgatttttcacaactgcaacacttaaaggctctcaatttatcagggaatagactctcaggtgaaattccttcacttctcaaggaaagatcaaataatggttcacttttgctgagtgtggatggaaatctggatctctgccgggagggcccatgtgaagaggataaaatgaatattgccccacttgttgcaggcattctttcagttgtagtctttttcattgtattgggtattgtactgaatatcatttggagaaggagatgcaacagaaaaccagcatcaaagcaagctgtgagattaaatgaagaggttatatcgactattaccaataacttcgacaaaatgattgggaagggaggatgtggaattgtttatcttggttccttacaggatggcacacaggttgctgtcaaaatgctcttgccaaaatgtcctcagggatcacaacaaaatgctcaactcttaatgcgtgtgcatcacaagaacttagcttcctttgtcggatactgtaatgaagttggacacacaggcatcatctacgaatatatggcttatgggaacttggaagagtatctatcagatgcaaggagagaaccattaagttggagacagaggattcagatagcagttgatgctgctcaaggtatcgagtacttgcatcatggctgcaagccgccaataattcatagagacattaagactgcaaacattttgctgaatgagaaaatgcaagcaaaagtagctgattttggtttctcaaaacttttctcagctgaaaatgaaagtcatgtatcgactgtagttattggcacattaggatatcttgatccagaatactacacatccagcaggctaaccgagaaaagcgacgtttatagttttggcattgtgcttttggagctaattactgggcagccagcaataataaaaggtcatcagaacactcacattgcgcaatgggttaacaactttcttgcaaaaggagatatacaacaaattgttgatccaaggttgcggggagattttgactttggctctgtgtggaaggccttggaggcagcaatagcttgtgtgccttcaatttctatccaaaggccatcaatgagttacattgtcggcgaactcaaagagtccttagaaatggaagcagctctgtacaatgtaacgtatcta

SEQ ID NO: 702 - protein, 871 aa, Glycine max
  Glyma15g02440.1
MDGKWRCHWAWSCTLWCVLAYTVSEFTGKSIVMATGKNSMHHKQGRRKLDDVTGSICIDCGIAEGLDYTDDKTQIHYTSDAQFIGTGTSKSISHKFISDTPQRTFTNVRSFPEGKKNCYTLRHPEGRNTIYLIRASFMYGNYDDLNKLPQFDLYIGVNLWDTVMFENATHVVIKEILHVPSLDELYVCLLNTDKGTPFISALEVRHFDHSSYRTKSELLSLYRRFDIGSTTNEIVRYDKDVYDRMWYPYNLPDSTPLNTSFTVDSLNHTAYHLPSAVMKTAVRPTNENDSLEFEFDTGQPTSESYVYMHFAEIEVLNENECRAFDITLNGKLWAEYVTPTYLQSNTIDGNQSIRGSKLKFSMHKKPNSTHPPILNAMEIYIVKEFLHSPTNQDDVKAIIDIKSHYKLTSSVGKSWQGDPCAPSKYSWNGLNCSNNGYNPPTITALYLASSGLGGTIIASFLELKFLESLDLSNNSLTGPLPDFSQLQHLKALNLSGNRLSGEIPSLLKERSNNGSLLLSVDGNLDLCREGPCEEDKMNIAPLVAGILSVVVFFIVLGIVLNIIWRRRCNRKPASKQAVRLNEEVISTITNNFDKMIGKGGCGIVYLGSLQDGTQVAVKMLLPKCPQGSQQNAQLLMRVHHKNLASFVGYCNEVGHTGIIYEYMAYGNLEEYLSDARREPLSWRQRIQIAVDAAQGIEYLHHGCKPPIIHRDIKTANILLNEKMQAKVADFGFSKLFSAENESHVSTVVIGTLGYLDPEYYTSSRLTEKSDVYSFGIVLLELITGQPAIIKGHQNTHIAQWVNNFLAKGDIQQIVDPRLRGDFDFGSVWKALEAAIACVPSISIQRPSMSYIVGELKESLEMEAALYNVTYL

SEQ ID NO: 703 - DNA, 2754 bp, Vitis vinifera
  GSVIVT01016933001
atgtttgtggagtgcagaggaacatatgcctggtcttcaaaagtatgccttattttcctgcaagtgtttgccctcaccatttctatggaagaatcggtagctctggcttctgatggtgtttttggtaattcagaaagcgtcatcaatcgtaaacctgctcgaaggaagctagatgacatagctggctccataaacatagactgcgggctacctgaagattgcaagtacattgatgccgaaactgggttacagtacacttcagatgcaagcttcatcagatccggaataaataagaacatatcatccaagttcagctctacaactcttcataagtctctcacaaatgttagaagcttccctcaagggaaaaggaattgttacacactgagacctccagaaggccatggcactatgtatttgatcagagcttccttcatgtatggaaactatgatgaactcaaccaggttccacagtttgatctttatattggagttaacatgtgggattctgtgaagctggacaatgcatctcatcttgtgatgaaggagattctacatgctccctcagatgatgatatctatgtatgtcttgtaaatatcggttatggagaaccatttatatcatcactggaagtaaggcattttcatgattctagttataagactgagtctggatcactagctttatacaggcggctcgatgctggttcaacaaccaatgagatagtcaggttcaaagacgacgcttatgatcgaatttggtttccttataatttgcctgactgtgaatcactcaatacaacagtgcccattgattcccatgctgaaactgagtataaactgccatcaaaggtcatgaccactgccattaggccaatgaatagcagtgcctcattggactttgatttcgatatcggtgattccactctggagttttatgtgtacatgcactttgcagaacttgaggggctgcaggaaaaccagactagaaatttcagcattaccctgaatggtaacccctggggggaagctaatattgttcccaagtacctgcactcaagaactgtaaataacaaacagccagtgaggggatccaagctgaagttttctatttataagacattgaattcttcccttcctccgatcctaaatgccatggagatttacatggtgaaaggtctcttacaggcgccaacttgccaagaagatgtaaatggtatctcgagaatcaaatcattctatcttgttgagaagaactggcaaggagatccatgtgccccagtgcaaccttgggatggcctcacctgcagtaacaatggttatgaatcacccagaatcatctctctgaaactgtcctcaagtggattgagaggcacgatatctccttcactgttgaatctcacagcattacagttcctggatttgtcgaacaatagcctaacaggagaactgcctgaatttttgtcacgactgtcattcttgactgccctgaatgttacaggaaacaagctctcgggttcagttcctccagatctcattgcaagatcagagaaagggtcactgtcattgagtgtggccaacaacccggatctttgtccatcggctcaatgcaaagagaataagaactctgtcggtccaatagttgcagcagtagtttcatcacttgtcatcatcttccttgcattggttattatatggagcctaaaaagaaggaaaaaagctacaaaatcacttgtcagatctcctgaagaaacatggtcactaaagatggagaaccaacgattcagatacttagagattgtgagtattaccaatgactttcaaacagtccttgggacgggaggatttggaaccgtttaccatggctgcatgcttaatggcacacaagttgctatcaagatgctctctcaatcatcaaaacaaggaatgaaggagtttcgcaatgaggctaggctcttgatgagagttcaccacagaaacttggcttctctggttgggtactgccatgaaggtacaaacatggggctcatctatgagtacatggctggtgggaacttacaaaattatctatcaggggcagatataagcactagtcctttgagttggatagagagacttcaaatagcagtggatgcagcacaaggactagaatacatgcactgtggttgcaagccacctataatccacagagatgtgaaaactgccaacattttgttgagtgaaaaactgcaagctaagatagctgattttgggttctcaagatttttctcaattgagagtgaaactcatgccacaactgcagttgttggcactattggttacattgatccagagtactacatatctaataggttgaccgagaaaagtgatgtttatagctttggaattgttctattggagttgataactggaaaacctgcaatcattaaagatgaagacaatattcatatagttcaatgggtaaggtcttttgtggagagaggggacattggaagcattgttgatcccaggctacaaggaaatttgaacacaaattcagtttggagagttttggagacagcaatggcatgcctaccaccaatttccatccaaagggtgactatgagtcatgtagtgatgcaactaaaggagtgtttggaagaagagaaagctcatgatcaaactagaaggatggaggaacaggccacaaaatcaagcaatttgattgacttatatagtttggatcttgaacttgaaatgggtccagaagcaaga

SEQ ID NO: 704 - protein, 918 aa, Vitis vinifera
  GSVIVT01016933001
MFVECRGTYAWSSKVCLIFLQVFALTISMEESVALASDGVFGNSESVINRKPARRKLDDIAGSINIDCGLPEDCKYIDAETGLQYTSDASFIRSGINKNISSKFSSTTLHKSLTNVRSFPQGKRNCYTLRPPEGHGTMYLIRASFMYGNYDELNQVPQFDLYIGVNMWDSVKLDNASHLVMKEILHAPSDDDIYVCLVNIGYGEPFISSLEVRHFHDSSYKTESGSLALYRRLDAGSTTNEIVRFKDDAYDRIWFPYNLPDCESLNTTVPIDSHAETEYKLPSKVMTTAIRPMNSSASLDFDFDIGDSTLEFYVYMHFAELEGLQENQTRNFSITLNGNPWGEANIVPKYLHSRTVNNKQPVRGSKLKFSIYKTLNSSLPPILNAMEIYMVKGLLQAPTCQEDVNGISRIKSFYLVEKNWQGDPCAPVQPWDGLTCSNNGYESPRIISLKLSSSGLRGTISPSLLNLTALQFLDLSNNSLTGELPEFLSRLSFLTALNVTGNKLSGSVPPDLIARSEKGSLSLSVANNPDLCPSAQCKENKNSVGPIVAAVVSSLVIIFLALVIIWSLKRRKKATKSLVRSPEETWSLKMENQRFRYLEIVSITNDFQTVLGTGGFGTVYHGCMLNGTQVAIKMLSQSSKQGMKEFRNEARLLMRVHHRNLASLVGYCHEGTNMGLIYEYMAGGNLQNYLSGADISTSPLSWIERLQIAVDAAQGLEYMHCGCKPPIIHRDVKTANILLSEKLQAKIADFGFSRFFSIESETHATTAVVGTIGYIDPEYYISNRLTEKSDVYSFGIVLLELITGKPAIIKDEDNIHIVQWVRSFVERGDIGSIVDPRLQGNLNTNSVWRVLETAMACLPPISIQRVTMSHVVMQLKECLEEEKAHDQTRRMEEQATKSSNLIDLYSLDLELEMGPEAR

SEQ ID NO: 705 - DNA, 2412 bp, Vitis vinifera
  GSVIVT01016915001
atgaatgttagaagcttcccagaaggagccaggaactgttataccttacgaccagaacaagaaaaggataataagtatttgatcagagctttattcatgtatgggaattatgactccaagaatcaatttccagaattcaaactatatctgggtactgatgaatgggacactgtcaacattggggattcatctacagctttatggaaggaaattatacacgccccgaaaacaaatgacatagatgtgtgtctagtaaacatcgattctgggacacctttcatttcagtgttagagctccgaccgcttaataattccatttatgataagactgaacccgggtcgctgctattctataacaggtgggattttggtgcagaacaagatatggaaatcagggacaaagatgatgttttcgaccgcatttggaacccattcagattggattcctgggaattcattactgcatcgtatgggagttatacccttagtaccagtgaatataggcttccacggacagtcatggcgactgctgcaacgcctgcaaatgaaagtgaatccttgcgcctctctttgaacatcagtggtgatccttctcagaagttatacatgtacatgcactttgccgaggttgagaaactcaatgaaggcgagttgagagaatttactatctcactgaatgatgatgagtcatggggtggtggggctctcactcctccatacctgtcttccgacacgttgtatagtacaaattctgttagtggaagcaccacaaacaaactgttatttacaattaaaaagacaggtagatccacacgtccgcccattatcaatgctatggaggtttacaagataaaagatttctcacaatcatcaactctccaaggcgatgttgatgctatcaagaagatcaaatcagtgtacacaatgagcagaaactggcaaggagatccatgtctcccggagtcgtaccggtggactggcctgagctgcagcaagagtggttctcctagtatcatctccttgaacctctcatccagcagtctgactgggaagatagactcttcattctccactctcacctctttgcaatatttagatttatcttacaataacttaactggagaaataccagattttctagctgagctgacttccttgaactccctgaacttatcagggaacaatttcacagggtcagttccattggctcttcttagaaaatcagatgaggaatccctgtctttgagtttggatgggaatccgtatctttgtaagacaaactcatgtgctgaggaggaagagaagcagaagaagaagggtaggaatattactgttccagtagttgcatccgttgcatccattgcttcagttctactcctcttagctgcattagccaccttgtggagatttaaaataagaagacagcatggaacagatggcaaacctaaggaagaaaaaaagttattggattcgaagaatcaatgcttcagttactctgaggtggtgagcatcactgacaacttccaaaaggtgctcggaaaaggaggatttggagcagtttacagtggccatttgaaagatggcactcaagttgctgtcaagatgctctcgccatcatcagctcaaggaaacttggcttctctggttggatactgtgatgaaggttcaaacatggggctcatttatgagtacatggctaatgggaacttagaagagcttttatcaggtaaaaatgcacctgtcttgagttgggaacaaagacttcgaattgcaattgatgcagcacaagcactggaatatttgcataatggttgcaaaccacccataatccacagagatgttaagactgcaaacatcttactgaatgagaaactgcaagccaaagttggggattttgggatgtccagaattattccctttgaatctgaaactcatgtatcaactgcagttgttggcacacccgggtaccttgatcctgagtattacataacagcgaggttgaacgagaaaagtgatgtttatagctttgggattgttctgttggagcttatttcaggaaaacctgcaataataggtagccatgggaacaaggatcacatagtccaatgggttagtccaattatttccagaggagaaataagaagcattgtggatccgaggttagaaggagacttgatcaacaccaattctgcgtggaaagctgtggagactgcaatggcttgtgttccatccatctccatccagaggccaaccatgagtgaggtagtaggggaactaaaggagtgtttgaatatagagataagagatgaaagagcttataatgtgaaagaggacaatggcataatatcaagctattcacctgaaatggttgttttaggtattgatgaagatgcaatgggtccccaagcaagg

SEQ ID NO: 706 - protein, 804 aa, Vitis vinifera
  GSVIVT01016915001
MNVRSFPEGARNCYTLRPEQEKDNKYLIRALFMYGNYDSKNQFPEFKLYLGTDEWDTVNIGDSSTALWKEIIHAPKTNDIDVCLVNIDSGTPFISVLELRPLNNSIYDKTEPGSLLFYNRWDFGAEQDMEIRDKDDVFDRIWNPFRLDSWEFITASYGSYTLSTSEYRLPRTVMATAATPANESESLRLSLNISGDPSQKLYMYMHFAEVEKLNEGELREFTISLNDDESWGGGALTPPYLSSDTLYSTNSVSGSTTNKLLFTIKKTGRSTRPPIINAMEVYKIKDFSQSSTLQGDVDAIKKIKSVYTMSRNWQGDPCLPESYRWTGLSCSKSGSPSIISLNLSSSSLTGKIDSSFSTLTSLQYLDLSYNNLTGEIPDFLAELTSLNSLNLSGNNFTGSVPLALLRKSDEESLSLSLDGNPYLCKTNSCAEEEEKQKKKGRNITVPVVASVASIASVLLLLAALATLWRFKIRRQHGTDGKPKEEKKLLDSKNQCFSYSEVVSITDNFQKVLGKGGFGAVYSGHLKDGTQVAVKMLSPSSAQGNLASLVGYCDEGSNMGLIYEYMANGNLEELLSGKNAPVLSWEQRLRIAIDAAQALEYLHNGCKPPIIHRDVKTANILLNEKLQAKVGDFGMSRIIPFESETHVSTAVVGTPGYLDPEYYITARLNEKSDVYSFGIVLLELISGKPAIIGSHGNKDHIVQWVSPIISRGEIRSIVDPRLEGDLINTNSAWKAVETAMACVPSISIQRPTMSEVVGELKECLNIEIRDERAYNVKEDNGIISSYSPEMVVLGIDEDAMGPQAR

SEQ ID NO: 707 - DNA, 2178 bp, Vitis vinifera
  GSVIVT01016916001
atggattcaaaatattgtgtaggattcataagcattgattgtgggatagctgagggctcagactataaggataataccactggcctgctttacacttcggatgcaaaattcatagacactggaataaatgggaagatttcttcaaagttcacggctttcttcatgtatggaaattatgactccaaggatcaacctccagaattcaaactacatcttggtgttgaggagtgggacacaacagatgacatatatgtctgtctggcaaacactgggtctgggacaccttttatatctgcgttagagctgagaccactggataattccacttataccaccgaatctggatcactggaactctttacaagggttgacgttggatcaacaacaaatgaaacagtcagatacaaagacgatgtttttgatcgcatttgggatcccgtcagctgggattattgggctcccatcaattcaagatatgttagtggcaccttaagtaacaatgagtacaaacctccatccaatgtcatgtctactgctgtgattccaggcctcgattccctttccttggagttttattgggatacagatgatcctagtcaacagttttatatgattccaactactatatggaacaccgactctataagtgctcctggtagtctaaattttagtatttctaagacagataactccacacgtcctcccattctcaatgctttggagatatattcggtaaaacacttcttacaatcaccaactggccaaaatgaagttgatgctatcaagaaaatcaagtcagtgtacaaggtgatgaagagtagctggcaaggagatccatgcatccccagagattacttatgggatggcctgacctgcagtgacaatggctatgatgctcccagtatcatctcactgaacctttcttcgagcaatttgaccgggaggatcgatggttcattctctaatctcacgtcattacaacatttagatttatcttacaataacttaactggagaagtgacaacctttctagctaacctgcctgccttgaaaaccttgaatttatcatggaacaatttcataggttcagttccattggcgctaataaaacaagctgatggtggtaccttgtctttgagtttgttcaagagtttattagctattttcccatttggttacctagacaatgagggaaaattgaccctattgtttttggatgggaatccgcatctttgtaaaacaagctcatgtaagtggaagaatcctattgttccaatagtttcatgcgccgttttcgttctggtcctcttaggtgtatttgccatcttctggatctacaaaaggaagcaacgacaagaagagaagataatgaggcagaataacaggaacgttagttactctgagattgtaagcatcactggtaacttccaacaggtgattgggaaaggagggtttggaaaagtttatagtggccatttaagtgatggtactcaagttgctgtcaagatgctttcatctccatcaatccatgggtctaagcaatgtaggactgaggcaagcttctttatatatatatctataaacttggtttctctactcggttactgtgatgagagtccaaacatggggctcatgtacgagtacatggctaatgggaatttacaagagtgtttgtcaggtatcaatcgcttgatgcatcctaatttttcaactgcaatatctggaacgcctggatacctcgatcctgagtattacacatccttaaggttggatgagaaaagcgatgtttatagctttgggattgttctgttggagcttatcactggccagcctccgataataaagcagggcgaagaaagcatgcttcacatagtccaatgggtcagtcccattattaaaaggggggagattagagacatagtagatcagaggttacagggagattttgatatcagttctgtcgggaaagctatagatatagcaatggcttgtgtaacctacagctccaccacaaggccgaccatgagtcatgtgttgctggaattaaaaggctgtttgaacattgagatagcccctgaaaggacgcggagtatggaggaagacaatgagaaacaagcaaacgattcgcttgaaatgatttttgttagcacagaaattccaaagggtcctcaggaaagg

SEQ ID NO: 708 - protein, 726 aa, Vitis vinifera
  GSVIVT01016916001
MDSKYCVGFISIDCGIAEGSDYKDNTTGLLYTSDAKFIDTGINGKISSKFTAFFMYGNYDSKDQPPEFKLHLGVEEWDTTDDIYVCLANTGSGTPFISALELRPLDNSTYTTESGSLELFTRVDVGSTTNETVRYKDDVFDRIWDPVSWDYWAPINSRYVSGTLSNNEYKPPSNVMSTAVIPGLDSLSLEFYWDTDDPSQQFYMIPTTIWNTDSISAPGSLNFSISKTDNSTRPPILNALEIYSVKHFLQSPTGQNEVDAIKKIKSVYKVMKSSWQGDPCIPRDYLWDGLTCSDNGYDAPSIISLNLSSSNLTGRIDGSFSNLTSLQHLDLSYNNLTGEVTTFLANLPALKTLNLSWNNFIGSVPLALIKQADGGTLSLSLFKSLLAIFPFGYLDNEGKLTLLFLDGNPHLCKTSSCKWKNPIVPIVSCAVFVLVLLGVFAIFWIYKRKQRQEEKIMRQNNRNVSYSEIVSITGNFQQVIGKGGFGKVYSGHLSDGTQVAVKMLSSPSIHGSKQCRTEASFFIYISINLVSLLGYCDESPNMGLMYEYMANGNLQECLSGINRLMHPNFSTAISGTPGYLDPEYYTSLRLDEKSDVYSFGIVLLELITGQPPIIKQGEESMLHIVQWVSPIIKRGEIRDIVDQRLQGDFDISSVGKAIDIAMACVTYSSTTRPTMSHVLLELKGCLNIEIAPERTRSMEEDNEKQANDSLEMIFVSTEIPKGPQER

SEQ ID NO: 709 - DNA, 2718 bp, Vitis vinifera
  GSVIVT01016917001
atgtgtatatatggacattttccatatccttctctccttagaagactaatggaaatgctacttcgggttcttagttttctagctcttaatatgcttcttcatgtgcatgctcaaacaggattcataagcattgattgtggagtggatgaggactacatagataacacaaccaaactattttacagttcggatgcaaacttcatagacagtggagaaaacaagaacatcccttatgatttcacgtccacaatttatgaaaaacagctcacaaatgttcgaagcttcccaaaaggagtcaagaactgctacaccctaccagcagaccaaggcaaagataataagtacttgatcagagctgtattcatgtgcggtaatgttcaagagtacaataatcagcttccagagttcaaactatatctgggtgtcgaagaatgggactcagtgacattcaactcgtcttataatatcgtccgcagggaaatcatatatgtccctaaaacagatgaaatatatgtgtgtcttgttaatactgattctgggacacctttcatttctgcattagagctcaggccaattgatgattccatttataacaaaactcaatctggatcgctggtgctttttaacaggtacaattttggttcagaaaccagtgagacagtcagatatggagacgatgtgttggatcgcatatggggaccctacagttggtcttctggggaatccatcaaagcaccctatagtagttctgggttaagtgaaaatcaatttaaacttccggccaaggtaatggagaccgcggtaaaacctgtgaatggaacttcgttggacttctatttggatgggattgattcatctcaagaattttacgtatatttgcatgttgctgagattgagacattggtgcaaggccagatcagagagtttaccgtttcagtgaataagaaagcaatttctagtgctatccaacctcggtacatgattgcagatacttattttactcaatcttccttaagtggaagtgagctgaatttttcactttcccagacaaatcaatccacacttccacccattatgaatgctctggagatttacatgataaaagaattcgtacagttgtccactgaacaacgtaatgttgatgctatgaagaaaatcaagtcagtataccagatgacgaagagtagttggcaaggagatccatgtctcccaagaaattactcatgggatggcctgatctgcagtgacaatggttataatgcccctagtatcacctcactgaacctatcatctagcaatttggctgggaagatagataaatcattctccaatctcacttcgttacaatatttggatttatcttacaatagtctaaatggagaagtaccagaatttctatctgaaatgtcttccttgaagaccctgaacttatcagggaataaattgacaggttcggttccttcggccctcctcgcaaaatctaacgatggaacactgtctttaagtttggatgggaatccggatctttgtaaaaccaactcgtgcaatacaaagacgaaaaagaagaactcggttgttgttcctgtagttgcatccattgcttcagttgtggtcctcttaggtgcaatatttgcagtctattggcgcttcataggaggcggaagacgtggtaaacctgctggagtgaaacccaatgatcgagataatgtgtcacaattggagttccagaaaccagatgtacctaatgaagaagagaactgggactcggagttagaagaaatacaaaaggaagtgatcgaaactaatggaaagctggaggcaaggaagcaacgtcttagttattctgaggttaaaaggatcactaacaactttggagaggtgatcggaaagggaggatctggattggtttacaatggccgtttaagcaatggcattaaagttgcggtcaagaagctgtcaccttctttgaatctagcttttgagcaatttcagaatgaggcaaggtactgcgacgagggttcgaacatgttgctaatttatgagtatatggctaatgggaacttgaaagaacatatatcaggtaaaaatgggtcggtgttgagttgggaacaaagagttcaaatagcaattgaggcagcacaagcactggaatatttacatgatggttgcaatccatccataattcacagagatgttaaggctgccaacatcttattgaatgaaaaaatgcaagccaaagtagcagattttgggtggtccagaagcatgccctctgaaagtcaatctcatgtatcagctacctttgttgtcggcacttctgggtaccttgaccctgagtacaacaaaactggaaagttgactaaggaaagtgatgtttatagctttgggattgttcttctagagcttatttccggccggtctgcgaaaattgaggacaatctcagcatattggattggttctatcctgtttttgaaagtgggaaattagaagacattgtggatccaaggttacaaggaatcttcagtactaactcagcctggagagctgtagagacagcaaactcttgcataccactcagatccatagagaggcaaactatgagctatgtagtgaatgaattgaaagagtgcctgaaactgctagagatgagtagcccttcaaatacaggagtaaccattactcgacctattggaactgaaaccggccctcaagcaagg

SEQ ID NO: 710 - protein, 906 aa, Vitis vinifera
  GSVIVT01016917001
MCIYGHFPYPSLLRRLMEMLLRVLSFLALNMLLHVHAQTGFISIDCGVDEDYIDNTTKLFYSSDANFIDSGENKNIPYDFTSTIYEKQLTNVRSFPKGVKNCYTLPADQGKDNKYLIRAVFMCGNVQEYNNQLPEFKLYLGVEEWDSVTFNSSYNIVRREIIYVPKTDEIYVCLVNTDSGTPFISALELRPIDDSIYNKTQSGSLVLFNRYNFGSETSETVRYGDDVLDRIWGPYSWSSGESIKAPYSSSGLSENQFKLPAKVMETAVKPVNGTSLDFYLDGIDSSQEFYVYLHVAEIETLVQGQIREFTVSVNKKAISSAIQPRYMIADTYFTQSSLSGSELNFSLSQTNQSTLPPIMNALEIYMIKEFVQLSTEQRNVDAMKKIKSVYQMTKSSWQGDPCLPRNYSWDGLICSDNGYNAPSITSLNLSSSNLAGKIDKSFSNLTSLQYLDLSYNSLNGEVPEFLSEMSSLKTLNLSGNKLTGSVPSALLAKSNDGTLSLSLDGNPDLCKTNSCNTKTKKKNSVVVPVVASIASVVVLLGAIFAVYWRFIGGGRRGKPAGVKPNDRDNVSQLEFQKPDVPNEEENWDSELEEIQKEVIETNGKLEARKQRLSYSEVKRITNNFGEVIGKGGSGLVYNGRLSNGIKVAVKKLSPSLNLAFEQFQNEARYCDEGSNMLLIYEYMANGNLKEHISGKNGSVLSWEQRVQIAIEAAQALEYLHDGCNPSIIHRDVKAANILLNEKMQAKVADFGWSRSMPSESQSHVSATFVVGTSGYLDPEYNKTGKLTKESDVYSFGIVLLELISGRSAKIEDNLSILDWFYPVFESGKLEDIVDPRLQGIFSTNSAWRAVETANSCIPLRSIERQTMSYVVNELKECLKLLEMSSPSNTGVTITRPIGTETGPQAR

SEQ ID NO: 711 - DNA, 5520 bp, Vitis vinifera
  GSVIVT01016922001
atggtaattctgaaattccatattcaagaatgggtacaaatatctcttcgtagttgctccccttcattgctgaggaggcaaaggaggagaccaatggaaatgttagttgttgttcttggatatttggctcttactgccatggttcttgggcaggatcaatcaggcttcataagcatcgattgcgggataaatccgggttccagctattttgatgccttaaccgaaatatactatgcatcagactcagaattcatacacactggaataaattatgatgtttctgaggaacacagacctaggtttgaaactcgagatcagcagctcatgaatgtgaggagcttccctgaaggagccaagaattgttacactcttcgaccgcaacaaggcaaagatcataagtacttgatcagagcttccttcatgtatgggaactatgactccaaaaatcagcttccagtgttcaaactatacgtgggtgttaatgaatgggacactgtgaaattcagcaattcatatgatgttgttcggaaagaaattatacatgtcccgagaacagatcacatatatgtctgtctagtgaacactggttttgggtcacctttcatatcagcattagagttgagacaactgaataattccatttatacaactcaatctggatcattgatactctttaggaggcttgatattggttcaaaaacaagtcagacagtcagatacaaagatgacgcttttgatcgtatttgggaaccattcagccggccttattggaaatcagtcagtgcatcctatagtagtgatagtttaagtgataaccactttaaacctccatccaaggtcatggcaactgctgtaacccctgctgatgagagatatcccttggaattccactggaatctggacaattctactcgacagttctatgtatacatgcactttgctgaggttgaggagctccaatccaaccagttgagagaattttatgtatcgcttaatggttggttctggagtcccgaacctattgttcctggaagattggttccacatactggatttagcacacattccataagtgcatcatctgagctatcactttcaatttataagacacatagatccactcttccaccaattctcaatgctttggagatttatgagataaaacaattgtttcaatcatcaactgtccagagcaatgttgatgctatcaagaaaatcaagatggtgtacaaggtgaagaaaaactggcaaggagatccatgtcttcccattgagttctcatgggatggcctgagctgcagtgacagcaattccatttcccttagtatcatctctttgaacctttcatggagcaagttaaccggggagatagattcttcattctccagtctcacatcattaaaatatttagatttatcttacaacagtttgactggaaaagtgccaaactttctgtccaaactttcttccttgaaggccctgaacttgtcagggaataatctgacaggttcagttccattgtctctccttgaaaaatctagaaatggatccctgtctttgagattggatgggaatccacatctttgtaagaaaaactcttgtgaggatgaggaagaggagggcaaggagaagacgaagaataatgttattgttccagtagttgcatccattatttcaattctagtcctcttattaggtgaggtagcagccctgtggatatttaaaaggagacaacaatacgatggtatgaaattggactctatgaactgccacgttagttactctgaggttgatagaatcactgataacttcaaaaaaatgcttggccgaggagcatcaggaaaagtttaccttggccatttaagtgatggcaccgaagttgcagtcaagatgctgacaccttcatcagttctagtgtttaagcaattcaagactgaggctcagctgttgacaagaattcatcacaaaaacttagtttctctaattggatactgtgatgaaggttcaagaatggtgctcgtttatgagcatatggctgaggggaacttaaaagagtatttatcaggtaaaaaagaaattgtcttgagttgggaacaaaggcttcaaatagcaattgatgcagcacaagcactggaatatttacatgatgcttgcaatccacccataatccatagagatgtaaaacctgaaaacatcttattgaccaaaaaatttcaagccaaagttgcagattttgggtggtctagaagtttgccctctgaaggtggaagctatgtatcaactgcaattgttggcacaccggggtacattgaccccgagtacaacagaacctcattaccaagtaagaaaaccgatgtttatagctttgggattgttttattggaggttatttcgggtcaacctgtaatcataaagatcacaaaagagagctcatgtaacatagcagattgggttcgcctagtaactgcaaaaggtgatataaaaatgattgtagatccaaggttacaaggagaatttgaagccaattctgcctggagagctgtagagacagcaatgtcttgtgtgctactcagctccacagataggccaaccatgagtcatgtagtagtggaattaaaagaatgtctgaaaatagccatggtccatgaaagaactgacaatgcggaagaggaccagggtcctgttagtattgaagctgtccatgaaagaactgacaatgtggaagaggattgtgatccttttggtagtgaagctgcctatgaaagaactgatgatgcagcagaggaccatggccctcttggtgttgaagctgcccatgaagtaaccaacaatgccaaagaggaccagggtcctgttggtattgaagctccacatgaaagaaatgacagtgggagagagggccatggttctgttggtattggagctgcccataaaagaaatgacaatggggaagaggaccagtgtcctgttggtattgaagctgcccatgaaagacatgacgatgggaaagaggaccatggtcctgatggtattgaagctgcccatgaaattactgacaatgcagaagaggaccaaggtcttgttggtattgaagccacccaagaaagaactgacattgtggaagagaaccatggtcctgttggtatcgaagctgcccatgaaagaaatgacaatgatgaagaggaccatggtcctgttggtattgaagctacccatgaaagaactgataatgtggaagagaaccatggtcctcttggtagcgaagctgcaatggctatccaagaaaggacaaactcatatggggcggccaaggaaaagaagaaggagaagaagaagaatgttgtagtttcaccagttgcatcaattacttcagttgttgtcccatcagacattgttgtcaaacccaatgaggatgataaaacatttgagccaaagaaccaacaccttacttattctgagattgaaagaatcactgaaaatttccaaaaggagcttggaaaaggagcatcagcaatagtttatcatggtcatttaagtaatggcactgaagttgcggtcaagaaactgtcaccttcatcaattctagggtcaaagcaattcaaaactgaggctcagcttttgacaagagttcatcataaaaacttggtttctctatttggatactgtgatgaaggttcaaacatggtgctcatttatgagtacatggcaaaggggaatttaaaagcatatttatcaggtaaaacagaagctgccctgagttgggaacaaagacttcgaatagcaattgatgcagcacaagcattggaatatttacacaatggttgcaacccacccataatccatagagacgtcaaaactgaaaacattctattaaacgaaaaattgcaagccaaagtggcagattttgggtggtctaaaagtatgcctgtggaaggtggaagctatgtatcaactgcaattgttggcacacctggctaccttgaccctgaatatcacagaaactcagtgccgaatgagaaaaccgatgtttatagctttgggattgttttgttggagcttatttcaagtagacctgcaatcataaagatcacagaagacaatcgatgcaacataacatattgggtccgccccattattgcaaaaggggatataagaatgattgtagatccaaggttacaaggaaaatttgagactaattctgccaggagagcaatagagacagcaatgtcatgtgtgtcactcagctccactgacaggcctaccatgagtgacataatagtagaattaagagaatgcctaaagatagtgatgacccatgaaagaacgaaagagggccatgcttctgttggtattgaagctgcaatgactgttcaagaaagtttcaatggaaatcaggatttccttacgacaggctcgaatgcgaaggctgcggagaaagagaaggagaaggacgagaagaagaagaaaaagaagaaaaagaattttattggtccagcagtcacatcaattacttcagttttagtcccctctggtgcattagccagcttgggaaaatctaaaaagaaatggccacatgctaaagataagagttactccgaggttgcaagaatcacgaacaacttccagcaggtgattggatgtggagcatttgcatcagtttacctaggttatttaagcgatggtactgaggtagctgtcaagttgctttcatcttcaactagaggatcccaggaccttcagacagaggctcagctgctgacaagaattcgacataaaaacttggtttctctgcatggataccatgatgaaggttcaatcattgcgctcatttatgaatatatggtgaaggggagcttaagaaagtatctatcagatgaaaatgaagttgttttgagctggaagcaaagaattggaatagcacttgatgtagcacaaggactggaatatctacatgatggttgcaggccacccataatccacagagacgttacatctgcaaacatcttattgaatgaaaaattgcaagccaaagtggcagatatggggttgtctagaagtctacccattgatgatttgactgatatttccactgtggttgttggcacacccgggtaccttgaccctgagtattttcaatccaatagggtgtctatgaaaagcgatgtctatagctttggggttgttctgctggaacttgtttcaggccaacctgcactgataaagagcaccaacggtataactgatcacctaatcaattgggttcgacccctgattgataggagggaaataagaggaattgtggatccaaggttaaatggagactttgacattagttctgcctggaaggctgtagaaacagcaatggcttgtgtaagattcagctccgttgataggccaaccatgagtgacatagcatacgaattaaaagggtgtgtaaattgtttagcaatagcaactggggatgtggaagaggaccttggttcttttattattgaggatgcaatgcttcaccaaccaagc

SEQ ID NO: 712 - protein, 1840 aa, Vitis vinifera
  GSVIVT01016922001
MVILKFHIQEWVQISLRSCSPSLLRRQRRRPMEMLVVVLGYLALTAMVLGQDQSGFISIDCGINPGSSYFDALTEIYYASDSEFIHTGINYDVSEEHRPRFETRDQQLMNVRSFPEGAKNCYTLRPQQGKDHKYLIRASFMYGNYDSKNQLPVFKLYVGVNEWDTVKFSNSYDVVRKEIIHVPRTDHIYVCLVNTGFGSPFISALELRQLNNSIYTTQSGSLILFRRLDIGSKTSQTVRYKDDAFDRIWEPFSRPYWKSVSASYSSDSLSDNHFKPPSKVMATAVTPADERYPLEFHWNLDNSTRQFYVYMHFAEVEELQSNQLREFYVSLNGWFWSPEPIVPGRLVPHTGFSTHSISASSELSLSIYKTHRSTLPPILNALEIYEIKQLFQSSTVQSNVDAIKKIKMVYKVKKNWQGDPCLPIEFSWDGLSCSDSNSISLSIISLNLSWSKLTGEIDSSFSSLTSLKYLDLSYNSLTGKVPNFLSKLSSLKALNLSGNNLTGSVPLSLLEKSRNGSLSLRLDGNPHLCKKNSCEDEEEEGKEKTKNNVIVPVVASIISILVLLLGEVAALWIFKRRQQYDGMKLDSMNCHVSYSEVDRITDNFKKMLGRGASGKVYLGHLSDGTEVAVKMLTPSSVLVFKQFKTEAQLLTRIHHKNLVSLIGYCDEGSRMVLVYEHMAEGNLKEYLSGKKEIVLSWEQRLQIAIDAAQALEYLHDACNPPIIHRDVKPENILLTKKFQAKVADFGWSRSLPSEGGSYVSTAIVGTPGYIDPEYNRTSLPSKKTDVYSFGIVLLEVISGQPVIIKITKESSCNIADWVRLVTAKGDIKMIVDPRLQGEFEANSAWRAVETAMSCVLLSSTDRPTMSHVVVELKECLKIAMVHERTDNAEEDQGPVSIEAVHERTDNVEEDCDPFGSEAAYERTDDAAEDHGPLGVEAAHEVTNNAKEDQGPVGIEAPHERNDSGREGHGSVGIGAAHKRNDNGEEDQCPVGIEAAHERHDDGKEDHGPDGIEAAHEITDNAEEDQGLVGIEATQERTDIVEENHGPVGIEAAHERNDNDEEDHGPVGIEATHERTDNVEENHGPLGSEAAMAIQERTNSYGAAKEKKKEKKKNVVVSPVASITSVVVPSDIVVKPNEDDKTFEPKNQHLTYSEIERITENFQKELGKGASAIVYHGHLSNGTEVAVKKLSPSSILGSKQFKTEAQLLTRVHHKNLVSLFGYCDEGSNMVLIYEYMAKGNLKAYLSGKTEAALSWEQRLRIAIDAAQALEYLHNGCNPPIIHRDVKTENILLNEKLQAKVADFGWSKSMPVEGGSYVSTAIVGTPGYLDPEYHRNSVPNEKTDVYSFGIVLLELISSRPAIIKITEDNRCNITYWVRPIIAKGDIRMIVDPRLQGKFETNSARRAIETAMSCVSLSSTDRPTMSDIIVELRECLKIVMTHERTKEGHASVGIEAAMTVQESFNGNQDFLTTGSNAKAAEKEKEKDEKKKKKKKKNFIGPAVTSITSVLVPSGALASLGKSKKKWPHAKDKSYSEVARITNNFQQVIGCGAFASVYLGYLSDGTEVAVKLLSSSTRGSQDLQTEAQLLTRIRHKNLVSLHGYHDEGSIIALIYEYMVKGSLRKYLSDENEVVLSWKQRIGIALDVAQGLEYLHDGCRPPIIHRDVTSANILLNEKLQAKVADMGLSRSLPIDDLTDISTVVVGTPGYLDPEYFQSNRVSMKSDVYSFGVVLLELVSGQPALIKSTNGITDHLINWVRPLIDRREIRGIVDPRLNGDFDISSAWKAVETAMACVRFSSVDRPTMSDIAYELKGCVNCLAIATGDVEEDLGSFIIEDAMLHQPS

SEQ ID NO: 713 - DNA, 4437 bp, Vitis vinifera
  GSVIVT01016925001
atggccttgagtgcagctacaatggttacaattcccccaggatcatctctctctgaggacctgtcttcaagtgggttgtccgggaaaatagactcttcactgtccaatctcgaatccttacagtacttagatttatcaaacaatagtctaactggagaagtgccagattttctcagccaactgcctctattgaagaccctaaacttatcaggaaatgaattcacaggttcagttccatcacttcttatccaaagatccaaaaatggatccctctctttgagatgctatcagaacaatcagctcaaggtaaacccatttgcattacaggctcagctgttgacaaaagttcatcatcggaacttggctcccctaattggatactgtaatgaaggacgatacaaggggattgtgtatgagtatatggctaatggaaacttgcgagaacatttgtcaggtgcaggaaaggacactccggtcttgagttgggaacaaaggcttcaaatagcagttgatgcagcacaagcatttgaatatttacatgaaggttgcaaaccaccaataatccacagagatgttaagacttccaacattttgttggatggaaaattgcaagcaaaagtggctgattttgggctgtccagattcatgccatcagagagtagaactattgtatcaactcaagttgctggcacacccggctacctcgatcctgagtactacatatcgaacaatctgaatgagaaaagcgatgtttacgcctttgggatagtcctgttggagctggtcactggccaccctgcaatcataccaggccatgagaacacacacttagttgactggctcagtcccaggcttgcaggaggggaaataagaagcattgtagactctaggctaaatggagatttcaaccccaactccgcctggaaacttgtagagacagcaatggcatgtgtgcccagaagctccatacaaaggccaacaatgagtcaagtggttgcggacctgaaggagtgtctgcagatggaaatgcaccgcaacaaaagtgcttcacagtctagaacatatcaagatacagcatcaagtacccgaagacaagaagaacgaaatggcgtgacgtcgatagtgcaatcgaaccaggcggcaggaaaccctaacttcgacgggaatccgccggtggccccaactccgctgggaacaaacatgacgggcatctgtttcaaagatcagctatggttaaactcctaccctaactcaaatgagcatatgtttggaactccagatcagcagcttatgactgtgagaagctttccagaaggaaccaagaattgttacactcttcaaccacaacaaggcaaagataataagtacttgatcagagcttccttcatgtatgggaactatgactccaagaatcaacttccagagttcaaactatatctgggtgttaatgaatgggatgctgtgaaattcaaccattcatatgatattgtcaggaaggaaattatacatgtcccaagaacaggtcacatagatgtctgcctagtgaacactggttctgggtcacctttcatatcggcattagagttgagacaactgaataattccatttattcaactcaatctggatcattgatactctttaagaggcttgatattggttcaacacgtcagacagtcagatacaaagatgacgcttttgatcgcatttgggaaccattcagccggccttattggaaatcagtgagcgcatcctatagtagtgatactttaagtgataaccactttaaacctccatccaaggtcatggcaactgctgtaacccctgctgatgaaagatatcccttggaattccactggaatctggacaattctactcgacagttctatgtatacacgcactttgctgaggttgaggagctccaatccaaccagttgagagaattgtatgtatcacttaatggttggttctggagtcctgaacctattgttcctggaagattggttccacatactggatttagcgcacattccataagtgcatcatctgagctatcgctttcaatttttaagacacacagatccactcttccaccaattctcaatgctttggagatttatgagataaaacagttgtttcaatcatcaactgtccagagcaatgttgatgctatcaagaaaatcaaggcagtttacaaggtgaagaaaaactggcaaggagatccatgtcttcccattgagttctcatggaatggcctgagctgcagtgacaacagtcccctttcccctagcaccgtctctttcaggaacctttcttggagcaagttaactgggaagatagattcttcattctccaatctcacatcattaaaatctttagatttatcttacaatagtttgactggagaagtgccaaactttctatctaaactgccttccttgaagaccctgaacttgtcagggaataatctcacaggatcagttccattggctctcattgaaaaatctagaaatggatccctgtctttgagattggatggaaatctgaatctttgtaagaaaaactcttgtgaggaagaggaggacaaagagaagtccagtaataatgttattgttccattagttgcatccattatttcagttctagtcctcttattaggtgaagtagcagccttgtggatatttaaaaggagacaacaacatggtattcttctttgtggtatggcattggactcaatgaacccccgccttagttactctgaggtcaatagaatcactggcaacttcaaaaagctgcttgaccaaggagaatcagcagaagtttaccttggccatttaagtgatggcactgaagttgcagtcaagatgctgacaccttcatcagttctagtgtttaagcaattcaagactgaggcaagcttctctacacaagcaaaaagaaaagtcaatttcaatgtcgttggttgttttcagcattcatgtccaaaagccatgcattttgacaaaactgcagaatcatttaacttatcatgcatgcatgcaggcaaaaaagaaactgtcttgagttgggaacaaaggcttcgaatagcaattaacacggcacaagctttggaatatttacacgatggttgcaatccgcccataatccatagagatgttaaaactgaaaatatcttattgaatgaaaaaattcaagccaaagttgcagcttttgggtggtctagaagtatgccctctgaaggtggaagctatgtatcaactgcaattgttggcacaccggggtacatcgaccccgagtacgacaaaacctcagtaccaagtaagaaaactgatatttatagctttgggattgttttattggagcttatttcgggtcgacctgcaatcataaagatcacaaaagagagcccattcagctccatagataggccaaccatgaacattgttgtcaaacctaacgaggatgataaaacatttgagccaaagaaccaacaccttacttattttgaggttgaaagaatcactgacaatttccaaaaggagcttggaagaggagcatcatcaatagtttatcatggtcatttaagtaatggcactgaagttgcagtcaagaagctgtcaccttcatcaattctagggtcaaagcaattcaaaactgaggctcagcttttgacacgagttcatcataaaaacttggtttctctatttggatactgtgatgaaggttcaaacatggtgctcatttatgagtatatggcaaaggggaatgtaaaagcatatttatcaggtaaaacagaagctgtcctgagttgggaacaaagacttcaaatagcaattgatgcagcacaagcactggaatatttacacaatggttgcaacccacccataatccatagagatatcaaaactgaaaacatcctattgaatgaaaaattgcaagcgaaagtggcagattttggttggtctaaaagtatgcctgctgaaggtggaagctatgtattaactgcaattgttggcacacctggctacctcgaccctgaatatcacagaagctcagtgccaaatgagaaaaccgatgtttatagctttgggattgttttgttggagcttatttcaggtaggcctgcaatcataaagataacaaaagagaacctatgtaacataacaaattgggtccaccacatcattgcaaaaggggatataagaatgattgtagatccaaggttacaaggagaatttgagaccaattctgccaggagaactatagagacagcaatgtcctgtgtatcattcagctccactgagaggcctactatgagcgacatagtagtagaattaagagaatgtctaaaaatagcgatggcccatgaaagaactaacaatttggaagaggaccatgattctgctggtattgaagctgcaatgactgctgaagaaagg

SEQ ID NO: 714 - protein, 1479 aa, Vitis vinifera
  GSVIVT01016925001
MALSAATMVTIPPGSSLSEDLSSSGLSGKIDSSLSNLESLQYLDLSNNSLTGEVPDFLSQLPLLKTLNLSGNEFTGSVPSLLIQRSKNGSLSLRCYQNNQLKVNPFALQAQLLTKVHHRNLAPLIGYCNEGRYKGIVYEYMANGNLREHLSGAGKDTPVLSWEQRLQIAVDAAQAFEYLHEGCKPPIIHRDVKTSNILLDGKLQAKVADFGLSRFMPSESRTIVSTQVAGTPGYLDPEYYISNNLNEKSDVYAFGIVLLELVTGHPAIIPGHENTHLVDWLSPRLAGGEIRSIVDSRLNGDFNPNSAWKLVETAMACVPRSSIQRPTMSQVVADLKECLQMEMHRNKSASQSRTYQDTASSTRRQEERNGVTSIVQSNQAAGNPNFDGNPPVAPTPLGTNMTGICFKDQLWLNSYPNSNEHMFGTPDQQLMTVRSFPEGTKNCYTLQPQQGKDNKYLIRASFMYGNYDSKNQLPEFKLYLGVNEWDAVKFNHSYDIVRKEIIHVPRTGHIDVCLVNTGSGSPFISALELRQLNNSIYSTQSGSLILFKRLDIGSTRQTVRYKDDAFDRIWEPFSRPYWKSVSASYSSDTLSDNHFKPPSKVMATAVTPADERYPLEFHWNLDNSTRQFYVYTHFAEVEELQSNQLRELYVSLNGWFWSPEPIVPGRLVPHTGFSAHSISASSELSLSIFKTHRSTLPPILNALEIYEIKQLFQSSTVQSNVDAIKKIKAVYKVKKNWQGDPCLPIEFSWNGLSCSDNSPLSPSTVSFRNLSWSKLTGKIDSSFSNLTSLKSLDLSYNSLTGEVPNFLSKLPSLKTLNLSGNNLTGSVPLALIEKSRNGSLSLRLDGNLNLCKKNSCEEEEDKEKSSNNVIVPLVASIISVLVLLLGEVAALWIFKRRQQHGILLCGMALDSMNPRLSYSEVNRITGNFKKLLDQGESAEVYLGHLSDGTEVAVKMLTPSSVLVFKQFKTEASFSTQAKRKVNFNVVGCFQHSCPKAMHFDKTAESFNLSCMHAGKKETVLSWEQRLRIAINTAQALEYLHDGCNPPIIHRDVKTENILLNEKIQAKVAAFGWSRSMPSEGGSYVSTAIVGTPGYIDPEYDKTSVPSKKTDIYSFGIVLLELISGRPAIIKITKESPFSSIDRPTMNIVVKPNEDDKTFEPKNQHLTYFEVERITDNFQKELGRGASSIVYHGHLSNGTEVAVKKLSPSSILGSKQFKTEAQLLTRVHHKNLVSLFGYCDEGSNMVLIYEYMAKGNVKAYLSGKTEAVLSWEQRLQIAIDAAQALEYLHNGCNPPIIHRDIKTENILLNEKLQAKVADFGWSKSMPAEGGSYVLTAIVGTPGYLDPEYHRSSVPNEKTDVYSFGIVLLELISGRPAIIKITKENLCNITNWVHHIIAKGDIRMIVDPRLQGEFETNSARRTIETAMSCVSFSSTERPTMSDIVVELRECLKIAMAHERTNNLEEDHDSAGIEAAMTAEER

SEQ ID NO: 715 - DNA, 2319 bp, Vitis vinifera
  GSVIVT01016934001
atgtatgggaattatgattccaagaatcaacctccaatcttcaagctatatctgggtgttgatgaatgggccacggtgaggatagaaaaggccattgaaattagcatggcagaaatcatacacataccaattacagatgacatagatgtgtgtctagtaaacaccggtttggggacaccattcatatcggtgttagagctcagacagcttaatgattcgatttatagtccacctgaaccagggtcactgcttctccgtggtaggttcgattttggtacacaacaggacttgtatgcaatcagggacaaagatgatgtttacgatcggatttgggaaccagccaattcggagtccattagttcaccacttgtaaattcttcctttagtacctctgactataaactaccagggattgtcatggcaactgctgcaacacctgcagatgaaaatgaacccttgggtttctcttttttaatagctggtcatccttctcaaaagttgtacgtgtacatgcactttgcggaggttgaggatctcaagggccaaatcagagaatttaccatctccgtgaatgatgatgagtcatttggtgggccagtggctcctagatacctactttcggacacggtatatagcaaatattccctgaatggaagtattaaccgattgtccttttcactaaaaaggacaaacagatccacgcttccaccaattatcaatgctatggaggtttacaggttaaaagaattctcacagtcatcaacccaacaaaacgatgttgatgcaatcaagaggatcaaatcaggatacgcagtgagcagcaactggcaaggagatccatgtctccccatgaaataccaatgggatggcctgacttgcagccaagatacttccccttctataatatcattgaacctctcatctagcaatttgtccgggaatatacttacttcattttcaagtctcagatcattacaaaatctggatttatcatacaacaacttgactggaccagtaccagaattttttgcagacttgccatctttaaaaaccctaaatttaacggggaacaacctaacaggttcggttccacaggctgttatcgataagttcaaggatggaactctgagtcttggcgaaaatccaaatctttgtcagtcagactcgtgccaaagaaagaagaagaaggagaacaagttccttgttcctgttcttatatccgttctgtctgtaattatcctgattctcatagctgcccttgcaatcatccggaagttgaccaagaggagagaaactagagagacggtcagtgaacgccccaaagaagggtcattgaagtcagggaattccgagttcactttctctgatgtggcaactatcaccaattactttagtcgtaccatcggtagaggaggattcggacaagtttatctaggcactttgacagatggcactcaggttgccgtcaagatgcgttctcaatcatcaatacaaagccccaaggcattacaagccgaggcgaaactcttgacgagagttcatcataaaaacttggttcgtctaattgggtactgcaaggatggtacacacatggctctcatttatgaatacatgtccaatggaaacttgcaaaacaagttattagggagagaagctgcagatgttttgaattggaaacagagacttcaaattgcagtagatgcagcacatggattggagtatctacacaatggctgtaagccaccaatagtccacagagacatgaaatcttccaacattctattaactgaaacactgcaagccaaggtagctgattttgggatgtccagagatcttgcaattgaaagtggagctttcatatcaactgtccctgcaggcacacctggatatctggatccggaataccagtcaacgggaattttgaataagaagagcgatgtttacagctttgggattgttttgttggagctaatcaccggccagcctgcgataaagaaccctgggaacattcatatagttggatgggttagtcctatgattaaaagaggggatatgcgaagcattgttgatccaaggttacaaggagctttcaacgccaattctgcctggaaagccctagagttagccttagcatgtgtagcattaacaggaatgcaaaggccagatatgagtcatgtactggaagacttgaaggaatgtttggagatggaggtgacttccaggagaattcaaagtgtaggtagccacagcatcggatcaggcaattccctggacgatcttcccttgattcttggcactcaattgggtccccgtgctagg

SEQ ID NO: 716 - protein, 773 aa, Vitis vinifera
  GSVIVT01016934001
MYGNYDSKNQPPIFKLYLGVDEWATVRIEKAIEISMAEIIHIPITDDIDVCLVNTGLGTPFISVLELRQLNDSIYSPPEPGSLLLRGRFDFGTQQDLYAIRDKDDVYDRIWEPANSESISSPLVNSSFSTSDYKLPGIVMATAATPADENEPLGFSFLIAGHPSQKLYVYMHFAEVEDLKGQIREFTISVNDDESFGGPVAPRYLLSDTVYSKYSLNGSINRLSFSLKRTNRSTLPPIINAMEVYRLKEFSQSSTQQNDVDAIKRIKSGYAVSSNWQGDPCLPMKYQWDGLTCSQDTSPSIISLNLSSSNLSGNILTSFSSLRSLQNLDLSYNNLTGPVPEFFADLPSLKTLNLTGNNLTGSVPQAVIDKFKDGTLSLGENPNLCQSDSCQRKKKKENKFLVPVLISVLSVIILILIAALAIIRKLTKRRETRETVSERPKEGSLKSGNSEFTFSDVATITNYFSRTIGRGGFGQVYLGTLTDGTQVAVKMRSQSSIQSPKALQAEAKLLTRVHHKNLVRLIGYCKDGTHMALIYEYMSNGNLQNKLLGREAADVLNWKQRLQIAVDAAHGLEYLHNGCKPPIVHRDMKSSNILLTETLQAKVADFGMSRDLAIESGAFISTVPAGTPGYLDPEYQSTGILNKKSDVYSFGIVLLELITGQPAIKNPGNIHIVGWVSPMIKRGDMRSIVDPRLQGAFNANSAWKALELALACVALTGMQRPDMSHVLEDLKECLEMEVTSRRIQSVGSHSIGSGNSLDDLPLILGTQLGPRAR

SEQ ID NO: 717 - DNA, 2307 bp, Vitis vinifera
  GSVIVT01016936001
atggaactaaaggattggtatttacttgctatgttcctccgtcttaaccaattttccaatggcgataatccccatatttcaaccacatgccttgctgtcttcttccacacaacatgcccccacagctcttaccatttccacttatttagcctaacgaatatgatgagaaagaccaacatggacagtaaaacaacaccattggttttggctctgatatctttcattgcaacaagagagaaggaaatcatacacataccaattacagattacatagatgtgtgtctggagtggaagttaatcagggaaaaagatgatgtttacgatcggatttggaaaccattaacacggtcatcttggttgtccattaattcatcacttgtaagttcttcctttagtacctctgactataaactaccgggtattgtcatggcgactgctgcaacacctgcaaatgaaagtgaatcctggcgtatctctttaggcatagatgatgatccttctcaaaagttgtacatgtacatgcactttgcggaggttgaggatctcaaaggccaaatcagagaatttaccatctccgtgaacgatgatgagtcatatgctggacctctgactcctggataccttttttcagtcacggtatatagcaaatattccgtgagtggaagtaccacaaacaaattgtccttttcactagaaaggacaaacagatccacgcttccaccaattatcaatgctatggaggtttacatgataaaagaattcgcacaatcatcaactcaacaaaacgatgttgatgcaatcaagacggtcaaatcaggatatgcagtgagcaggaactggcaaggagacccatgtctcccaatggaataccaatgggatggcctgacttgcagccacaatacttcccctgctataatctcattgaacctctcatccagcaatttgtccgggaacatacttacttcatttttgagtctcaaatcattacaaaatctggatttatcatacaacaacttgactggacctgtaccagatttttttgcagactttccatctttaaaaactctgaatttaacggggaacaacctaacaggttcggttccacaggctgttacggataagttcaaggatggaactctgagtggacgtaccatgttctattttatgcaagttttggagaaaatccaaatctttgtccgagagaaaccaaaggtattttctttctttcactttcatttttttctaagtgaggattcaacattttattactccatttttgttgtgatttccttagctacaaccatagagacggtcactgaacgccccaaagaagggccattgaagtcagggaattgtgagttcacttactctgaggttgtgggtatcaccaataactttaatcgccccattggtagaggaggatttggagaagtttatctaggcactttggcagatgacactcaggttgccgtcaaggttcattctccatcatcgaatcaaggccctaaggcatttcgagcggaggcgaaactcttgacgagagttcatcataaaaacttggttcgtctaattgggtactgcgatgacagtacaaacatggttctcatttatgaatacatgtccaatggaaacctgcaacagaagttatcagcgagagaagctgcagatgttttgaactggaaacagagacttcaaattgcagtagatgcagcacatggattggagtatctacacaatggctgtaagccaccaatagtccacagagacatgaaatcttccaacattctattaactgaatcactgcaagccaagatagcggattttggaatgtccagagatcttcaaagcttatcaaccgacccagtaggcacacctggatattttgatcctgaatgccagtccacaggaaatttgaatgagaagagcgatgtttatagctttgggattgttttattggagctaatcaccggccggcgtgcaataatccctgggggcattcatatagctggatgggttagtcctatgattgaaagaggggatattcgaagcattgttgatccaaggttacaaggagatttcaacaccaattctgcctggaaagcagtagagatagccttagcatgtgtagcatcaacaggaatgcaaaggccagacatgagtcatgtagtggtagacttgaaggaatgtttggagacggagatggcttccaggagaattcagagggtaggtggccacagcatcggatcaggcaatttcctagaaaatgttcccttggttcttagcactgaagtggctccccatgctagg

SEQ ID NO: 718 - protein, 769 aa, Vitis vinifera
  GSVIVT01016936001
MELKDWYLLAMFLRLNQFSNGDNPHISTTCLAVFFHTTCPHSSYHFHLFSLTNMMRKTNMDSKTTPLVLALISFIATREKEIIHIPITDYIDVCLEWKLIREKDDVYDRIWKPLTRSSWLSINSSLVSSSFSTSDYKLPGIVMATAATPANESESWRISLGIDDDPSQKLYMYMHFAEVEDLKGQIREFTISVNDDESYAGPLTPGYLFSVTVYSKYSVSGSTTNKLSFSLERTNRSTLPPIINAMEVYMIKEFAQSSTQQNDVDAIKTVKSGYAVSRNWQGDPCLPMEYQWDGLTCSHNTSPAIISLNLSSSNLSGNILTSFLSLKSLQNLDLSYNNLTGPVPDFFADFPSLKTLNLTGNNLTGSVPQAVTDKFKDGTLSGRTMFYFMQVLEKIQIFVREKPKVFSFFHFHFFLSEDSTFYYSIFVVISLATTIETVTERPKEGPLKSGNCEFTYSEVVGITNNFNRPIGRGGFGEVYLGTLADDTQVAVKVHSPSSNQGPKAFRAEAKLLTRVHHKNLVRLIGYCDDSTNMVLIYEYMSNGNLQQKLSAREAADVLNWKQRLQIAVDAAHGLEYLHNGCKPPIVHRDMKSSNILLTESLQAKIADFGMSRDLQSLSTDPVGTPGYFDPECQSTGNLNEKSDVYSFGIVLLELITGRRAIIPGGIHIAGWVSPMIERGDIRSIVDPRLQGDFNTNSAWKAVEIALACVASTGMQRPDMSHVVVDLKECLETEMASRRIQRVGGHSIGSGNFLENVPLVLSTEVAPHAR

SEQ ID NO: 719 - DNA, 2574 bp, Vitis vinifera
  GSVIVT01016937001
atgcataaaatacaagtaatatttcaattcaaccacatgcctagttggccccctctcaacaacccaagacatacgctgcaagtcaataccctttcccaacaaacacgttggaagtcaacatcattcctacttcctccaagcttgggaggcttagtatacaaggctttgcctataaagctcgtttccgctccacgttatccgctacatgttatccatatctcttcttctttccttaatcttcaccacttcaggttcataagcatcgattgtgggatagctccgggctcctattatacagatagtgaaaccgagatatattacacttcggatgcaggattcacagatactggaatcaattataacgtttccgaagaatattatttgatcagggctcggttcttgtatgggaattatgattccaagaatcaacttccaatcttcaaactatatctaggtgttgacgaatggaccacagtgaatataagaaatgtcacttctacttacaggaaggaaatcatacacataccaattacagattacatagatgtgtgtctggtaaacatcggttcggggacaccattcatatcagtgttagagctcaaacggcttaatgattcgatttatagtccagctgaaccagggtcactgattctctatgacaggtgggattttggtacacaacaagaggagtggaaggaaaaagatgatgtttacgatcggatttggaaaccaaatacatggtggtcttggttgtccattaattcatcagttgtaagttcttcctttagtacctctgactataaactaccgggtattgtcatggcgactgctgcaaaacctgcaaatgaaagtgaatcctggggtatctctttaagcatagatgatgatccttctcaaaagttgtacatgtacatgcactttgcggaggttgaggatcacaaaggccaaatcagagaatttactgtctccgtgaatgatgaaccatttagtgggcctgtggctcctagactccttttttcggacaccgtgtctagcaaatattccattagtggaagtaccacaaagaaattgtccttttcactagaaaggacaaacagatccacgcttccgccaattattaatgctatggaggcttacatgataaaagaattcccacaatcatcaactcaacaaaacgatgttgatgcaatcaagaggatcaaatcagattacgcagtgggcaggaactggcaaggagacccatgtctccccatggaataccaatgggatggcctcacttgcagccataatacttcccctactgtaatctcattgaacctctcatctagcaatttcatgaatatcttctctataatctttgctcaaaatgcatgcaactcaaattatttcatggatttatcatacaacaacttgactggaccagtaccagaattttttgccgactggccatctttaaaaactctgaatttaacggggaacaacctaacaggttcggttccacaggctgttacggataagttcaaggatggaactctgagtctcggagaaaatccaaatctttgtccgaccgtctcaggagagaaaccaaaggtattttctttctttcagtttcatttttttctaagtgaggatttaacattttattactccaatatttttgttgtgatttccttagctacaaccatagagacagtcactgaacgccccaaagaagggccattgaagtcagggaattgtgagttcacttactctgaggtggtgggtatcaccaataactttaatcgccccattggtagaggaggatttggagaagtttatttaggcactttggcagatgacacacaggttgccgtcaaggtgcattctccatcatcaaatcaaggccctaaggcatttcgagcggaggcgaaactcttgacaagagttcatcataaaaacttggttcgtctaattgggtactgcgatgacagtacaaacatggttctcatttatgaatacatgtccaatggaaacctgcaacagaagttatcagcgagagaagctgcagatgttttgaactggaaacagagacttcaaattgcagtagatgcagcacatggtcaagatcttcaaagcttatcaactgacccagtaggcacacctggatattttgatcctgaatgccagtccacaggaaatttgaatgagaagagtgatgtttatagctttgggattgttttattggagctaatcaccggccggcgtgcaataatccctgggggcattcatatagctggatgggttagtcctatgattgaaagaggggatattcgaagcattgttgatccaaggttacaaggagatttcaacaccaattctgcctggaaagcagtagagatagccttagcatgtgtagcatcaacaggaatgcaaaggccagacatgagtcatgtagtggtagacttgaaggaatgtttggagagggaggtggcttccaggagaattcagagggtaggtggccacagcatcggatcaggcaatttcctagaaaatgttcccttggttcttagcactgaagtggctccccatgctagg

SEQ ID NO: 720 - protein, 858 aa, Vitis vinifera
  GSVIVT01016937001
MHKIQVIFQFNHMPSWPPLNNPRHTLQVNTLSQQTRWKSTSFLLPPSLGGLVYKALPIKLVSAPRYPLHVIHISSSFLNLHHFRFISIDCGIAPGSYYTDSETEIYYTSDAGFTDTGINYNVSEEYYLIRARFLYGNYDSKNQLPIFKLYLGVDEWTTVNIRNVTSTYRKEIIHIPITDYIDVCLVNIGSGTPFISVLELKRLNDSIYSPAEPGSLILYDRWDFGTQQEEWKEKDDVYDRIWKPNTWWSWLSINSSVVSSSFSTSDYKLPGIVMATAAKPANESESWGISLSIDDDPSQKLYMYMHFAEVEDHKGQIREFTVSVNDEPFSGPVAPRLLFSDTVSSKYSISGSTTKKLSFSLERTNRSTLPPIINAMEAYMIKEFPQSSTQQNDVDAIKRIKSDYAVGRNWQGDPCLPMEYQWDGLTCSHNTSPTVISLNLSSSNFMNIFSIIFAQNACNSNYFMDLSYNNLTGPVPEFFADWPSLKTLNLTGNNLTGSVPQAVTDKFKDGTLSLGENPNLCPTVSGEKPKVFSFFQFHFFLSEDLTFYYSNIFVVISLATTIETVTERPKEGPLKSGNCEFTYSEVVGITNNFNRPIGRGGFGEVYLGTLADDTQVAVKVHSPSSNQGPKAFRAEAKLLTRVHHKNLVRLIGYCDDSTNMVLIYEYMSNGNLQQKLSAREAADVLNWKQRLQIAVDAAHGQDLQSLSTDPVGTPGYFDPECQSTGNLNEKSDVYSFGIVLLELITGRRAIIPGGIHIAGWVSPMIERGDIRSIVDPRLQGDFNTNSAWKAVEIALACVASTGMQRPDMSHVVVDLKECLEREVASRRIQRVGGHSIGSGNFLENVPLVLSTEVAPHAR

SEQ ID NO: 721 - DNA, 2259 bp, Vitis vinifera
  GSVIVT01016943001
atgaatgttagaagcttcccggaaggtaacaagaattgttacaccctacgaccagaaggaggcaaaggtaataagtatttgatcagagctcggttcatgtatgggaattatgattccaataatcatcttccgaagttcaaactatatctgggtactgatgaatgggtcacagtgaatatagaagatgcatctgcttatatcagagaagaaatcatacatgtcccaacaacagatgacatatacgtttgtctagtaaacattggtggtgggacacctttcatatccacattagagctcagaccgctcaataattccatttacgatcaatccgaacaggggtcgctactactcttcaacaggtgggatttttgcaaaccagagaatgcgctacacaggccggatgatgttttcgaccacatttggaacctatcggcctggtcgaatgaatgggataccctcgaagcagcatatgaaatttcttcccttagtcacagtgagtataaacttccgatgtcggtcatgatggatgctgtcatacccgtagatataagtgagccctggaacttctctctggatcttgatgatgatccttcacaaaatttatacatatacatgcactttgccgaggttcagaaacttcgagaaggggatattagagaatttactgtctcactaaatgaggacgattcatggggtggtggcgagccaactaatagatccacgcttccaccccttatcaatgcaatggaagtttacaaaataaaagattttgcacagtcatcaactaaacaaggggatgttctcgctgtcaagaacatccggtcagcgtaccgactgacaagacactggcaaggagatccatgtctccccttggatttcccatgggatggcctgcagtgcagctacagcagtgactcccccactataatctcactgaacctttcatcgagcaacttgactgggaatatccatccttcattttcccagctcaaatcattagcaaatctggatttatcatacaacaacttgactggaacggtaccagaattttttgcagacttgccattgttaatggtccttaatttgacggggaaccagctaacaggttcagttccccaaactattatggaaatgttcaaggataaggatagaacactgagtcttggcgcaaatccaaatctttgcccgtcagtctcttgccaaggaaaggagaagaagaagaagaacaggttccttgttcctgttctcatagccattctgactgtaactgtgatcctcgtcctcataactgcccttgcaatgatcatccgaaagttcaaaaggagagaaaccaaagcgacaaccatagagacggtcagtgaacgccccaaagaggggtcattgaagtcagggaactctgagttcactttctctgacgttgcaagtatcaccaataactttagtcgtaccatcggtagaggagaattcggacaagtttatctaggcactttggcagatggcacccaggttgcggtcaagatgcgttctgaatcatcaatgcaaggccccaaggcattacgagccgaggtgaaactcttgacgagagttcatcataaaaacttggttcgtctgattgggtattgcaatgacggtacaaacatcgctctcgtttatgaatacatgtccaacggaaacctgcaacagaagttatcagggagagcagcggcagatgttttgaattggaaacagagacttcaaattgcagtagatgcagcacatggattggagtatctacacaatggctgtaagccaccaatagtccacagagacatgaaatcttccaacactctattaactgaaacactggaagccaagatagctgattttgggatgtccagagatcttgaaagtggtgctctcttatcaactgacccagtaggcacacctggatatcttgatcctgaataccacattcatatagttggatgggttagtcctatgattgaaagaggggatattcaaagcattgttgatccaaggttacaaggagatttccacaccaattctgcctggaaagccctagagatagccttagcatgtgtagcattaacaggaatgcaaaggccagatatgagtcatgtattggcagacttgaaggaatgtttggagatagagatggcttccaggagaactcaaagtgttagccacagcatcggatcaggcaatttcctggaagatagtcccttgactcttggcactcaatcggctccccgtgctacg

SEQ ID NO: 722 - protein, 753 aa, Vitis vinifera
  GSVIVT01016943001
MNVRSFPEGNKNCYTLRPEGGKGNKYLIRARFMYGNYDSNNHLPKFKLYLGTDEWVTVNIEDASAYIREEIIHVPTTDDIYVCLVNIGGGTPFISTLELRPLNNSIYDQSEQGSLLLFNRWDFCKPENALHRPDDVFDHIWNLSAWSNEWDTLEAAYEISSLSHSEYKLPMSVMMDAVIPVDISEPWNFSLDLDDDPSQNLYIYMHFAEVQKLREGDIREFTVSLNEDDSWGGGEPTNRSTLPPLINAMEVYKIKDFAQSSTKQGDVLAVKNIRSAYRLTRHWQGDPCLPLDFPWDGLQCSYSSDSPTIISLNLSSSNLTGNIHPSFSQLKSLANLDLSYNNLTGTVPEFFADLPLLMVLNLTGNQLTGSVPQTIMEMFKDKDRTLSLGANPNLCPSVSCQGKEKKKKNRFLVPVLIAILTVTVILVLITALAMIIRKFKRRETKATTIETVSERPKEGSLKSGNSEFTFSDVASITNNFSRTIGRGEFGQVYLGTLADGTQVAVKMRSESSMQGPKALRAEVKLLTRVHHKNLVRLIGYCNDGTNIALVYEYMSNGNLQQKLSGRAAADVLNWKQRLQIAVDAAHGLEYLHNGCKPPIVHRDMKSSNTLLTETLEAKIADFGMSRDLESGALLSTDPVGTPGYLDPEYHIHIVGWVSPMIERGDIQSIVDPRLQGDFHTNSAWKALEIALACVALTGMQRPDMSHVLADLKECLEIEMASRRTQSVSHSIGSGNFLEDSPLTLGTQSAPRAT

SEQ ID NO: 723 - DNA, 2619 bp, Vitis vinifera
  GSVIVT01016939001
atgaacagtagaccaccactggttcggctcatctttgtcctgttcaccatcatttcctcaggcaacaacccagaattggttgccggaaaaccccatcacactgcctcaaccttccagcacaaccatccttctccccggagacttgctgctgacacccaagggttcataagcatcgactgtgggatagctccaggctcatattatactgatgataaaacccagataccttacacttctgatgcagatttcacagacactggaatcaattataatgtttccaggtctgaaaatccttcaaagcagctcatgaatgttagaagcttcccagaaggagccaggaattgttacaccctagaaccagaaaaaggcaagggtaataagtatttgatcagagctttcttcatgtatgggaactatgactccaagaatcaactcccagtcttcaaacttcatctgggtgttgatgaatgggacactatcaacttcaacaattcaagccaaactgtaaggaaggaaatcatacatgtccccaaaacagattacatagatgtgtgtctcgtcaacaatggttctgggacacccttcatatctgcattagagcttagaccgcttggtaattccagttataataaaacagaatcgggttctctgctactctttaacagatgggacattggttcagagcaagaaaaattgcaagtcaggtacaaagatgatgctcttgaccgcatttggaactcctacatgagtacttcttgggaatccataactgcaggatttgaaagctattcctacagcgaaactcggtttaaacttccgggaataatcatgtctactgctgcaacacctaaaaatgaaagtgaacccttgagattcttcttggatatggatgatccttctcaaagcgatgctgtggctccggaacgccttacctcgaccacaatatttagcacaaattctgtaaggggaagtagattgtcattttcgcttcagaagacgggtgaatccatgcttccccccattatcaatgccttggaagtttatgtgataaaggaattctcacaatcaacaactgaccaagaagatgttgaagctatcaagaagattaaatcagtgtacatggtgaggagaaactggcaaggagatccatgtcttccaatggattaccaatgggatggcctgaaatgcagcgataacggttcccccaccttaatatcattgaacctctcatatagcaatttgacaggaaagatacatccttcattttccaatctcaaatcattacaaaatctggatttgtcttacaataacttgactggatcagtgccagagttcttagctgaactgtcatctctaacattccttaatttagaagggaacaacttgacaggttcagttccccaggctcttatggagaagtatcagaatggcacattgtccttgagtcttcgagaaaatccaaatctttgtctgtcagtctcatgcaaaggaaagcagaacaagaacttcattgttccagttcttgcatccattatatcagttctggtcctgttccttctaattgctgttggtatcatttggaacttcaaaaggaaagaagacacagctatggagatggtcaccaaagaaggatctttgaagtcagggaactcagagttcacttactctgagcttgtggctattaccagaaacttcacttccaccattggacaaggaggatttggaaatgttcatctaggcactctggtagatggcactcaagtcgcggtcaagctgcgctcacaatcatcaatgcaaggctccaaggaatttcgagctgaggcgaaactcttgatgagagttcatcataaaaacttggttcgccttgttgggtattgcaatgatggtacaaatatggccctcatttatgaatatatgtctaatggaaacttgagacagaggttatcagagagagatacagatgtcttgcattggaaagagaggcttcaaattgcagttgatgcagcacaaggactggagtatctgcacaatggttgcaagccaccaataatccacagagatttgaagacttccaacatattattaaatgaaaaactgcaagctaagatagctgattttgggctgtccagagaccttgcaactgaaagtggccctcctgtatcgactgtccctgcaggcaccccaggatacctggatcctgagtattactcatctggaaatttgaataaaaggagcgatgtttatagctttgggattgtcttgttggagctgattaccggccagcctgcaataataacccctgggaacattcacatagttcaatggattagtcctatgattgaaagaggggatattcaaaacgttgttgatccaaggttgcaaggagatttcaacaccaattctgcctggaaagctctggagacagccttagcatgtgtaccatcaactgcaatccaaaggccagacatgagccatgtactggcagacttaaaggattgtttggagatagaggtgggtgccatgagaactcagaggatagatagctacaaaatgggatcaagcaacaccctaaaaagctgtgcagtggatcttgaaaatgaaatggctccccatgttaga

SEQ ID NO: 724 - protein, 873 aa, Vitis vinifera
  GSVIVT01016939001
MNSRPPLVRLIFVLFTIISSGNNPELVAGKPHHTASTFQHNHPSPRRLAADTQGFISIDCGIAPGSYYTDDKTQIPYTSDADFTDTGINYNVSRSENPSKQLMNVRSFPEGARNCYTLEPEKGKGNKYLIRAFFMYGNYDSKNQLPVFKLHLGVDEWDTINFNNSSQTVRKEIIHVPKTDYIDVCLVNNGSGTPFISALELRPLGNSSYNKTESGSLLLFNRWDIGSEQEKLQVRYKDDALDRIWNSYMSTSWESITAGFESYSYSETRFKLPGIIMSTAATPKNESEPLRFFLDMDDPSQSDAVAPERLTSTTIFSTNSVRGSRLSFSLQKTGESMLPPIINALEVYVIKEFSQSTTDQEDVEAIKKIKSVYMVRRNWQGDPCLPMDYQWDGLKCSDNGSPTLISLNLSYSNLTGKIHPSFSNLKSLQNLDLSYNNLTGSVPEFLAELSSLTFLNLEGNNLTGSVPQALMEKYQNGTLSLSLRENPNLCLSVSCKGKQNKNFIVPVLASIISVLVLFLLIAVGIIWNFKRKEDTAMEMVTKEGSLKSGNSEFTYSELVAITRNFTSTIGQGGFGNVHLGTLVDGTQVAVKLRSQSSMQGSKEFRAEAKLLMRVHHKNLVRLVGYCNDGTNMALIYEYMSNGNLRQRLSERDTDVLHWKERLQIAVDAAQGLEYLHNGCKPPIIHRDLKTSNILLNEKLQAKIADFGLSRDLATESGPPVSTVPAGTPGYLDPEYYSSGNLNKRSDVYSFGIVLLELITGQPAIITPGNIHIVQWISPMIERGDIQNVVDPRLQGDFNTNSAWKALETALACVPSTAIQRPDMSHVLADLKDCLEIEVGAMRTQRIDSYKMGSSNTLKSCAVDLENEMAPHVR

SEQ ID NO: 725 - DNA, 4362 bp, Vitis vinifera
  GSVIVT01016948001
atggacgttagaagcttcccagaaggagacaggaattgttacgccctaccaccaggacaaggcaagaatcataagtatttgatcagggcttggttcatgtatgggaattatgattccaagaatcaacctctagtcttcaaactatatctgggtgttgatgaatgggctacggtgaatataacaaatgcctctgttatcatcagaaaggaaatcatacacattccgacaacagatgacatagatgtgtgtctagtaaacgcaggttccgggacgccattcatatcggtgctagagctccaacagcttaatgattccatttatagtccaactgaaccaggatccctgctactccatgacagatgggattttggtacacaaaaagagaagagcaaagatgatgtttacgaccggatttggagaccattcacaaagtcgtcttgggagtccattaattcatcagttgtaagatcttcctttagtgtctctgactataaactgccagggattgtcatggcgactgctgcaacacctgcaaatgaaagtgaacccttgcgaatctctttagacatagatgatgatccttctcaaaagttatacatttacatgcactttgccgaggttaaggaaggcgtgttcagagaatttactaccttcgtgaatgatgatgaggcatggggtgggactgtgcttactacataccttttttcctacacggcagagagcgactattccatgagcggaagtaccacaaagaaattgtccttttcactaaaaagaacaaacagatccacgcttccaccaattatcaatgctatggaggtttacataataaaagaattctcacaagcatcaactcaacaaaacgatgttgatgcaatcaaggggatcaaatcagagtacgcagtgagcaggaactggcaaggagacccatgtctccccatcaaataccaatgggatggcctgacttgcagcctcgatatttcccctgctataatcacattgaacctctcatccagcaatttggccgggaatatacttacttcattttcgggtctcaaatctttacaaaatctggatttatcatacaacaacttgactggaccagtaccagaattttttgcagacttgccatctttaacaacccttaacttaacggggaacaacctaacaggttcggttccacaggctgttatggataagttgaaggatggaactctgagtcttggcgaaaatccaagtctttgtcagtcagcctcgtgccaaggaaaggagaagaagaagagcaggttccttgttcctgttctcatagccattccgaatgtaattgtgatcctgatcctcataactgcccttgcaatgatcatccggaagttcagaaggagagaaaccaaagagaagtcagggaattccgagttcacttactctgaggtagtgagtatcaccaataactttagtcagaccatcggtagaggaggattcggacaagtttttctaggcactttggcagatggcactcaggttgccgtcaaggtgcattctgaatcatcaatacaagaagctaaggcattacaagctgaggtgaaactcttgacgagagttcatcataaaaacttggttcgtctaattgggtactgtgatgacggtacaaacatggttctcatttatgaatacatgtccaatggaaacctgcaacagaagttatcagggagagaagccgcagatgttttgaattgggaagagagacttcaaattgcagtagatgcagcacatggattggagtatctacacaatggctgtaagccaccaatagtccacagagacatgaaatcttccaacattctattaactgaaacactggaagcgaagatagctgattttgggatgtccagagatcttgaaagtggtgctctcttatcaactgacccagtaggcacacctggatatcttgatcctgaataccagtcagcgggtttgaataagaagagcgatgtttatagctttgggattgttttgttggagctactcaccggccggcctgcaataatccctgggggcatttatatagttgtatgggttagtcatatgattgaaagaggggatattgaaagcattgttgatcgaaggttacaaggagagttcaacaccaattctgcctggaaagcagtagagatagccttagcatgtgtagcatcaacaggaatgcaaaggccagacatgagtcatgtagtggtagacttgaaggaatgtttggagacaggggtggcttccaggagaattaagatggtaggtttcataagcattgactgtgggatagctccaggttcatcttatacagatgatagaacccagatacattacacttctgatgcagaattcacagacactggaatcaattataatgtttccagatgggacttcggttcagagcaagaaaagtttcaagtcaggtacaaagatgacgctcttgaccgcatttggaactcctacaagaatgctttttgggaatccataactgcaggatttgaaagctattcctacagtgacaatccctttaaacttccgggaatagtcatgtctactgctgcaacacctaaaaatgaaagcgaacccttgagcttcttcctggatatggattatccttctcaaagattttatttgttcatgcatttttctgaggttttgcaactccagggcaaccagtccagagtatttaccatctggctgaatggcaccttatggaacgatcctgtggttcccaaacgcttttatgtgataaaggaattctcacaatcaacaactgaccaagatgatgttgaggctatcaagaagattaaatcagtgtacatggtgaggagaaactggcaaggagatccatgtcttccaatggattaccaatgggatggcctgaaatgcagcaataatggttcccccactttaatatcattgaacctctcatatagcaatttgacaggaaagatacatccttcattttccaatctcaaatcattacaaactctggatttatctcacaataacttgactggatcagtgccagagttcttaactgaactgccatctctaacgttccttaatttagcagggaacaacttgaaaggttcagttcctcaggggcttatggagaagtctcagaatggcacattgtacttgagtcttggagaaaatccaaatccttgtgtgtcagtctcatgcaaaggaaagcaaaacaagaacttcgttgttccagctctcgcatccgttatatcagttctggtcctgttccttctaattgctgttggtatcatttggaacttcagaaggaaagaagacaggtattttctttctttcattcccctagatttcatggtcaccagagaaggatcattgaagtcagggaactcagagttcacttactctgagcttgtgactattacccacaacttcagttccaccattggacaaggaggatttggaaatgttcatctaggcactctggtagatggcactcaagtcacggtcaagctgcgctcgcaatcatcaatgcaaggccccagggaatttcaagctgaggcaaaactcttgaagagagtccatcataaaaacttggttcgccttgctgggtattgcaatgatggtacaaacacggccctcatttatgaatatatgtctaatggaaacctgagacagaggttgtcagcgagagatacggatgttttgtattggaaagagaggcttcaaattgcagttgatgtagcacaaggattggagtatctgcacaatggttgcaagccaccaataatccacagagatgtgaagacttccaacatactattaaacaaaaaactgcaagctaagatagctgattttgggctgtccagagaccttgcaattgaaagtggctctcatgcatcaactattcctgcaggcacaccaggatatctggatcctgagtattactcatctggaaatttgaataaaaggagcgatgtttatagctttgggattgtcttgttggagctgattactggcctgcctgcaataataacccctgggaacatccacatagttcaatggattagtcctatgcttaaaagaggggatattcagaacattgttgatccaaggctacaaggagatttcaacaccaattctgcctggaaagctctagagacagccttagcatgtgtaccatcaactgcaattcaaaggccagacatgagccatgtactggcagacttaaaggattgtttggagatggtgggtcccatgagaactcagaggatagatagctacaaaatgggatcaagcaactcccttaaaagctatgcggtggatcttgaaggtgaaatggctccccatgttaga

SEQ ID NO: 726 - protein, 1454 aa, Vitis vinifera
  GSVIVT01016948001
MDVRSFPEGDRNCYALPPGQGKNHKYLIRAWFMYGNYDSKNQPLVFKLYLGVDEWATVNITNASVIIRKEIIHIPTTDDIDVCLVNAGSGTPFISVLELQQLNDSIYSPTEPGSLLLHDRWDFGTQKEKSKDDVYDRIWRPFTKSSWESINSSVVRSSFSVSDYKLPGIVMATAATPANESEPLRISLDIDDDPSQKLYIYMHFAEVKEGVFREFTTFVNDDEAWGGTVLTTYLFSYTAESDYSMSGSTTKKLSFSLKRTNRSTLPPIINAMEVYIIKEFSQASTQQNDVDAIKGIKSEYAVSRNWQGDPCLPIKYQWDGLTCSLDISPAIITLNLSSSNLAGNILTSFSGLKSLQNLDLSYNNLTGPVPEFFADLPSLTTLNLTGNNLTGSVPQAVMDKLKDGTLSLGENPSLCQSASCQGKEKKKSRFLVPVLIAIPNVIVILILITALAMIIRKFRRRETKEKSGNSEFTYSEVVSITNNFSQTIGRGGFGQVFLGTLADGTQVAVKVHSESSIQEAKALQAEVKLLTRVHHKNLVRLIGYCDDGTNMVLIYEYMSNGNLQQKLSGREAADVLNWEERLQIAVDAAHGLEYLHNGCKPPIVHRDMKSSNILLTETLEAKIADFGMSRDLESGALLSTDPVGTPGYLDPEYQSAGLNKKSDVYSFGIVLLELLTGRPAIIPGGIYIVVWVSHMIERGDIESIVDRRLQGEFNTNSAWKAVEIALACVASTGMQRPDMSHVVVDLKECLETGVASRRIKMVGFISIDCGIAPGSSYTDDRTQIHYTSDAEFTDTGINYNVSRWDFGSEQEKFQVRYKDDALDRIWNSYKNAFWESITAGFESYSYSDNPFKLPGIVMSTAATPKNESEPLSFFLDMDYPSQRFYLFMHFSEVLQLQGNQSRVFTIWLNGTLWNDPVVPKRFYVIKEFSQSTTDQDDVEAIKKIKSVYMVRRNWQGDPCLPMDYQWDGLKCSNNGSPTLISLNLSYSNLTGKIHPSFSNLKSLQTLDLSHNNLTGSVPEFLTELPSLTFLNLAGNNLKGSVPQGLMEKSQNGTLYLSLGENPNPCVSVSCKGKQNKNFVVPALASVISVLVLFLLIAVGIIWNFRRKEDRYFLSFIPLDFMVTREGSLKSGNSEFTYSELVTITHNFSSTIGQGGFGNVHLGTLVDGTQVTVKLRSQSSMQGPREFQAEAKLLKRVHHKNLVRLAGYCNDGTNTALIYEYMSNGNLRQRLSARDTDVLYWKERLQIAVDVAQGLEYLHNGCKPPIIHRDVKTSNILLNKKLQAKIADFGLSRDLAIESGSHASTIPAGTPGYLDPEYYSSGNLNKRSDVYSFGIVLLELITGLPAIITPGNIHIVQWISPMLKRGDIQNIVDPRLQGDFNTNSAWKALETALACVPSTAIQRPDMSHVLADLKDCLEMVGPMRTQRIDSYKMGSSNSLKSYAVDLEGEMAPHVR

SEQ ID NO: 727 - DNA, 2490 bp, Eucalyptus grandis
  Eucgr.I00390.1
atgggaagatcaactacagcattttcgtttgcgctgcttgcttctttagcttcagcactagtcattatgattcgagcccaaccaggttttatcagcatcgattgtggggcacccaatgagtacaccgatgagaacactaatataacatataaaatggatgatgggttcataggctctggaaaaaacatgccaatatccgggttgacaggtgaacaacagagtgcaaacaatgtaaggtattttccggatggaacgaagaattgttacactttgagaccagaccgaggcaagaacagaaaatacttgattagggcattattttggtacgggaactatgatgggaagaatcaggctcctttattcgacctatacatcgatgttaattattgggccacggtgtcctctgctgctttccaagagatcatttatgtgcccaaggcagatgacatacgagtgtgtcttgtgaaaactggcaacggagtgccctttatttcggcattggaactaagagctttggacgatgacgtctatccattggaatctgggttcttgcgagtcattgaccggatcaacctgggacaaacctcggtggcaaatgggttcaggtacccttacgatgtttatgatcggctgtggagaccttcgcacttccctaagtggtcgatactgaacaccacagttgcgattgatttatctaattatagcaatgcttataaggttcccgggggcgttcttcagaccgctcaagagacaatgagtttgagttctcccttgtatttacagtggacagtagatttaccgccgaccaatgatgccatatcagtgccatgggcaccaccaaagatatggattgtgtacttacatttcatggagattgagagactgagtgtcctgcaaagggaattcacagtttccttgaatgataatcaattcacggagacggtgagccttgaatacttaaagccagtggttgtagtttcccgtccagttaatgggccactcattaccctcttgattaattcgacgaataagtctggaaatccaccgatcctcaatgccatggagttctatagcgttgttgatcttccaaatgtacccacagcacaagatgatgtgaaagctatcaacgacatcaaagcaaggtatcacattaagagaggaagctggcaaggtgatccgtgcgtaccaagcaattacacatgggatggtctaaactgtagctatggaaatcctccaaggattatatccctagatttgtccaacaatcagcttacaggagtgataccagaaactctagctgaattaccacatctcagctttctaaatttaagtggaaacaacctgaatggatcagttcctgaagctctcaagaaaagagttatggacaatactttaaacatgagtttgataggaaacgtgcatctttgcctggctgatccttgcccacataagaagaaacaaaagaccatacttgttacagttgttacaacagttttaggctttctgggggctctatttggtgccttggcaattatttggttaatcaaatggaaacggacctgttctaaaactggcaaggcatttgaacaaataccagaatctagtgagaggacaccgagactaaagaaccgaccttttgagtatagagagatctcaaaaatcactggtaactttggacaagtgattggtaaaggtggatttggaaaggtatatcttggcacactggataacggcaccgtagttgctgtgaagatgctctctaaatcatccgagcaagggtacaaggaatttcagactgaggcacagctattagcaattctacaccacaaaaatttggtttccctgtttggatattgtgatgattccaagcacaaggcattagtatatgaatacatggctaatggaaatttaaggcaacatttatcagaggaccattcgaagatcttgacgtggagtaagagactacaaatagctgtggatgcagcacaaggtttggattatttgcataacggttgtaagccacccatcatccatagagacttgaagacttcaaacgtcttgttaactgaagacttccaagccaaattagctaattttggcctgtcaagagctttcgcatctgaaaatgactctcatgtgtcaacttgcccgggcggcacctttggctacctcggccccgagtttcaatcttttggaaaccgtgacaagaagagtgatgtttacagtttcggaattgtactctttgagttaatcacgggccaacctgcagtaatgagaagtcgggatggcagcgacttcattcacatacttgaatggctaattcccatcattgaaagtggtgatatccagaggattatggatcctaggttacatagagaattgaacactaactcagcttggaaagtggtggagattgctatgtcttgtacacaaccaacggcgattcaaaggccagacataaatcatatattggcagagttgaaggagtca

SEQ ID NO: 728 - protein, 831 aa, Eucalyptus grandis
  Eucgr.I00390.1
MGRSTTAFSFALLASLASALVIMIRAQPGFISIDCGAPNEYTDENTNITYKMDDGFIGSGKNMPISGLTGEQQSANNVRYFPDGTKNCYTLRPDRGKNRKYLIRALFWYGNYDGKNQAPLFDLYIDVNYWATVSSAAFQEIIYVPKADDIRVCLVKTGNGVPFISALELRALDDDVYPLESGFLRVIDRINLGQTSVANGFRYPYDVYDRLWRPSHFPKWSILNTTVAIDLSNYSNAYKVPGGVLQTAQETMSLSSPLYLQWTVDLPPTNDAISVPWAPPKIWIVYLHFMEIERLSVLQREFTVSLNDNQFTETVSLEYLKPVVVVSRPVNGPLITLLINSTNKSGNPPILNAMEFYSVVDLPNVPTAQDDVKAINDIKARYHIKRGSWQGDPCVPSNYTWDGLNCSYGNPPRIISLDLSNNQLTGVIPETLAELPHLSFLNLSGNNLNGSVPEALKKRVMDNTLNMSLIGNVHLCLADPCPHKKKQKTILVTVVTTVLGFLGALFGALAIIWLIKWKRTCSKTGKAFEQIPESSERTPRLKNRPFEYREISKITGNFGQVIGKGGFGKVYLGTLDNGTVVAVKMLSKSSEQGYKEFQTEAQLLAILHHKNLVSLFGYCDDSKHKALVYEYMANGNLRQHLSEDHSKILTWSKRLQIAVDAAQGLDYLHNGCKPPIIHRDLKTSNVLLTEDFQAKLANFGLSRAFASENDSHVSTCPGGTFGYLGPEFQSFGNRDKKSDVYSFGIVLFELITGQPAVMRSRDGSDFIHILEWLIPIIESGDIQRIMDPRLHRELNTNSAWKVVEIAMSCTQPTAIQRPDINHILAELKESF

SEQ ID NO: 729 - DNA, 2562 bp, Eucalyptus grandis
  Eucgr.I00392.1
atggaaagatcaattacagctttctcgtttgcgctgcttgcttctttaacttcagcactagtccttgtggttcaagcccaaccaggttttatcagcatcgattgtggggcacccaatgactacacagatgaaaacactaatatgacatataaagtggatgatgggttcataggctctgggaaaaacatgtcaatatccgggttgatatatcaaagtaatctacggtgtacaaatttaaggttttttccggatggattgaggaattgttacactttgagaccagaccaaggcaagaatggaaaatacttgattagggcattattttgttacgggaattatgatgggaagaatcaggctcctttattcgacctatacatcgatgttaattattgggccacggtgggtgcctcctctgctattgtcgaagagatcatttatgtgcccaaggcagatgacatacgagtgtgtcttgtgaaaactggcaacggagtgccctttatttcggcattggaactaagagctttggacgatgacgtctatccactggaatctgggttcttgcaattaagtacgcggatcaacctgggacaaacctcggtggtaaattggttcaggtacagggacgatgtttatgatcggatgtggacaccttggcacttccctaactggtcgacactgaacaccacagttgcgattgatttatctaatgatagtaatgcttataaggtttcaagggacgttcttcaaaccgctcaagggacaatgagttcgagttctcccttgtatttacagtggacaacagatgcacaaccgaccaacgatgcgacatcattgccaggggcaccaccgaagatatggattgtgtacttacatttcatggagattgagagactgagtggcccgcagagggagttcacaatttccatgaacgataatcaattcgcggagacggtgagccttgaatacttaaagccagtggttgtagtttctcgtccagttaaatggccagttatcaccctctcgattaattcgatgaataagtctggaaatccaccgatcctcaatgccatggagatctataacgttgttgatcttccaaatgtacccacagcacatgatgatgtgaaagctatcaatgacatcaaagcaacatatcacattaagagagaaagctggcaaggtgatccatgtgtaccaagcgattacacatgggatggtctaaactgtagccacggaaatcctccacggattatatccctgaaactaaactctagcaatttgatgggccacatagtcccgtcactttctcatctatcaacgattgaatacttagatttgtccaacaatcagcttacgggagcaataccaaaaactctagctgaattaccacatcttagctttcttttgacaggaaacgtgcatctttgcctggctgatccttgcccacgtaagaagaaacaagagaccatacttgttactgttacatcagtttcaagcttctgtggggctctctttagtgctttggcaattatttggttaatcaaatggaaacagacttgttctaaaactagtgaggcatttgaacaaatgccagaatctagtgagaggacaccgagattaaagaatcgaccttttgagtatggagaggtctcaaaaatcactgggaactttggacaagtgataggtaaaggtggatttggaaatgtatatcttggcacactagataacggcaccatggttgctgtgaagatgctctctgaatcatcaaaacaagggtacaaagaatttcaagctgaggcacaactcttagcgattctacaccacggaaatttggtttccttgtttggatattgcgatgattccaagcacatggcattagtatatgaatacatggccaatggaaatttgaggcaacatttgtcagaggaccatccgaagatcttgacatggagtaagagacgacaaatagctgtggatgcagcacaaggtttggattatttgcataatggttgcaagccacccatcatccatagagacttgaagacttcaaacattttgttgaatgaagacttccaagccaaattagctgattttggcctatcaagagcttttgcatctgaaaatgactctcatgtgtcaactcgtcctgccggcacctttggctacctcggccccgagtttcaatcttctggaaatcgtgacaagaagagtgatgtttacagtttcggaattgtactctttgagttaatcacaggccaacctgcagtaatgagaagccaggatggctgcgacttcattcacatacttgaatggctaattcccatcattgaaagtggtgatatacataggattatggatcctaggttacaaggaaaattcaacatcaactcggcttggaaagtggtggagattgctatgtcttgtacacaaccaagggcgattcaaaggccagacataaatcatgtattggcagagttgagggagtctttggtgagcaaatcaagcggttcttttgaagtgacctcttcagagatacattgtgacagtgtccctatggcaaga

SEQ ID NO: 730 - protein, 854 aa, Eucalyptus grandis
  Eucgr.I00392.1
MERSITAFSFALLASLTSALVLVVQAQPGFISIDCGAPNDYTDENTNMTYKVDDGFIGSGKNMSISGLIYQSNLRCTNLRFFPDGLRNCYTLRPDQGKNGKYLIRALFCYGNYDGKNQAPLFDLYIDVNYWATVGASSAIVEEIIYVPKADDIRVCLVKTGNGVPFISALELRALDDDVYPLESGFLQLSTRINLGQTSVVNWFRYRDDVYDRMWTPWHFPNWSTLNTTVAIDLSNDSNAYKVSRDVLQTAQGTMSSSSPLYLQWTTDAQPTNDATSLPGAPPKIWIVYLHFMEIERLSGPQREFTISMNDNQFAETVSLEYLKPVVVVSRPVKWPVITLSINSMNKSGNPPILNAMEIYNVVDLPNVPTAHDDVKAINDIKATYHIKRESWQGDPCVPSDYTWDGLNCSHGNPPRIISLKLNSSNLMGHIVPSLSHLSTIEYLDLSNNQLTGAIPKTLAELPHLSFLLTGNVHLCLADPCPRKKKQETILVTVTSVSSFCGALFSALAIIWLIKWKQTCSKTSEAFEQMPESSERTPRLKNRPFEYGEVSKITGNFGQVIGKGGFGNVYLGTLDNGTMVAVKMLSESSKQGYKEFQAEAQLLAILHHGNLVSLFGYCDDSKHMALVYEYMANGNLRQHLSEDHPKILTWSKRRQIAVDAAQGLDYLHNGCKPPIIHRDLKTSNILLNEDFQAKLADFGLSRAFASENDSHVSTRPAGTFGYLGPEFQSSGNRDKKSDVYSFGIVLFELITGQPAVMRSQDGCDFIHILEWLIPIIESGDIHRIMDPRLQGKFNINSAWKVVEIAMSCTQPRAIQRPDINHVLAELRESLVSKSSGSFEVTSSEIHCDSVPMAR

SEQ ID NO: 731 - DNA, 2613 bp, Eucalyptus grandis
  Eucgr.J02704.1
atgatcgagattcattggacttgttccaatgatttgacaaaaaaaccacggttccatttgatttactttttcttttccctaaatttacaaggttttatcagcatcgattgtggagcaactcttgcatacacagatgcgagaactcttataacatacgaatcggatgaaggactgatagactctgggaagatcatgcagacatctaggatgctcacatatcaaaatgatcgacagttattgaagaacataaggactttccctaatggaacaaggaattgttacactttaagaccaaatcaaggcaagaatacaacctacttgattagggcaacattttggtatgggaactatgatggggagaatcaggatccttcatttgatttatacattgatattaattattgggccacggtggactactcctattatcgtttcgaggaaatcatgtatgtgcccaaggcagatgatatacaagtgtgtcttgtgaacaccggcaagggagtgcccttcatttcggcgttggaattaagagctttggatgatggcatctatcgattagaatctggattcttgcaactccattggcggcacgacatcggacgaagcttggagtatgatgatgtcaggcaccctattgatgtttacgatcggatttggacacctcaaaactataatttcgggttgataataaacaccacagccattgatgtatctgacaataatgatgcaaataagtataaggttcccggagaagttcttcggactgctcaaagaacgaggagtgccagttctcgcttcgatatacagtggtcaccttcaaaatctggaaagaaatggattgtgtacttttatttcgttgagattgagagactgacaagtggcctgaaaagggtggtcacagtttccatgattgataataatttcacaaagacggtgagccttgaatacttaaagccagtggttgtagtttcccctcaagttgattggtcgcccatcaccttctccattgattcgacaaataactctggaaatccaccgatcctcaatgccgtggagttctataccgtcggtgatcttccattcgtacccacagcacaagatgatgtgaaagcgattattgacatcaaagcaacgtatcacattaagagagaaagctggcagggtgatccatgcgtaccaatcaattacacatgggatggtctaaattgtagttatgaaaatcctccgaggattatatcactgagattgagctcaagcaatttgacgggtgggatggtctcagcactttcacatctatcaagattggaatacttagatttgtccaacaatcagcttacaggaacaataccagaaactctggcaggattacaaaatcttacatttctaaatttaagtggaaacaacctgattaaatcagttcctgaagctctcaagaaaaggattctggacaaaactttaaacatgagtttagatgatgcgaatctgtgcctagctgatcattgccagcagaaaaagaaacaaaaaaccatcatcattgcagttgcaacatcagtttctggcttgtttgtggttctctttggtgctttgtccattatttggttgattaaaccgaaacaaatagcagaatctagtcaaaggacactgaggtcaaagaatcgaccttttaagtatagagaggtttcaaaaatcactgagaactttggacgagtgattggtgaaggtggatttggaaaggtatatcttggtacactagataacggcaccatagttgccgtgaagatgctctctgaatcatcaaggcaagggtacaaggaatttcaagctgaggcacagctcttaatgattcttcaccacaaaaacttggtttccctatttggatattgcaatgagtccaagcacatgacattaatatatgaatacatggctaatggaaatttaagggaacatttatcaggtgaagttaaaatccatccaacagagggccattcgcaagtcttgacatggagtaacagactacaaatagctatggatgcagcacaaggtttggattatttgcataatggttgcaagccatccatcatccatagagacatgaagactactaacatcttgttgaacgaagatttccaagccaaagtagctgattttggcttgtctagagcttttgcgactgaaaaggactctcatgtatcaacttgtcctgcgggcactcctggctatcttgaccctgaggttcattcttctggaaattttcacaagaagagtgatgtttatagttttggagttgtactatttgagttgatcacgggtcaacctgtgataacgagaagtcgggatggcagtgctagcatacacatacttcaatggttgattcctattgttgaaagtggtgatatacagaggattatggatccaaggttaaaaggaaaattcgacgtcaactcagcttggaaaatagtggagattgccatgtcttgtacaagaccaacgtcaattcaaaggccggatatccatcaagtattggcagagttggagtctttggtgagcaaatccagtgattccattgaaatgacctccgtggtgctcccatctgacaatgccccagtggcaagg

SEQ ID NO: 732 - protein, 871 aa, Eucalyptus grandis
  Eucgr.J02704.1
MIEIHWTCSNDLTKKPRFHLIYFFFSLNLQGFISIDCGATLAYTDARTLITYESDEGLIDSGKIMQTSRMLTYQNDRQLLKNIRTFPNGTRNCYTLRPNQGKNTTYLIRATFWYGNYDGENQDPSFDLYIDINYWATVDYSYYRFEEIMYVPKADDIQVCLVNTGKGVPFISALELRALDDGIYRLESGFLQLHWRHDIGRSLEYDDVRHPIDVYDRIWTPQNYNFGLIINTTAIDVSDNNDANKYKVPGEVLRTAQRTRSASSRFDIQWSPSKSGKKWIVYFYFVEIERLTSGLKRVVTVSMIDNNFTKTVSLEYLKPVVVVSPQVDWSPITFSIDSTNNSGNPPILNAVEFYTVGDLPFVPTAQDDVKAIIDIKATYHIKRESWQGDPCVPINYTWDGLNCSYENPPRIISLRLSSSNLTGGMVSALSHLSRLEYLDLSNNQLTGTIPETLAGLQNLTFLNLSGNNLIKSVPEALKKRILDKTLNMSLDDANLCLADHCQQKKKQKTIIIAVATSVSGLFVVLFGALSIIWLIKPKQIAESSQRTLRSKNRPFKYREVSKITENFGRVIGEGGFGKVYLGTLDNGTIVAVKMLSESSRQGYKEFQAEAQLLMILHHKNLVSLFGYCNESKHMTLIYEYMANGNLREHLSGEVKIHPTEGHSQVLTWSNRLQIAMDAAQGLDYLHNGCKPSIIHRDMKTTNILLNEDFQAKVADFGLSRAFATEKDSHVSTCPAGTPGYLDPEVHSSGNFHKKSDVYSFGVVLFELITGQPVITRSRDGSASIHILQWLIPIVESGDIQRIMDPRLKGKFDVNSAWKIVEIAMSCTRPTSIQRPDIHQVLAELESLVSKSSDSIEMTSVVLPSDNAPVAR

SEQ ID NO: 733 - DNA, 2505 bp, Eucalyptus grandis
  Eucgr.J02905.1
atgaaagaacgtttcataagtatcgactgcggagcaccgaattcatacaccgactacgtgaccaatatagatttttttacggataaaggatacatagaatctggagagagcatgcagatatccacaaagttcatcgtccaacaattccgacaatggttgaaaaatctaaggagttttcctagtgggatgagaaactgctacaccttgaaaccagacaaaggcaagaacaacacgtacttgattagagcatcattttggtatgcggactatgatgataagaaccgacctccgatattcgacctatacatcgatgttaatcattgggctacggttgataattctgataaaaagcactacgaaattgtctatgtggcccaaaggaatgatatacaagtgtgcctcgtaaatattggccaaggagtgccctttatttcggcattggaactaagacctttggacaattctatctatcatattgaatcaggatttttgacgctttggaagagatttgacgtcggaggctcaaattcgaccatcaggtacccggacgatgtttatgatcgcatctggaaaggttggaactctcctttctggcttatgctcaacccggggacgtccgcctctgatttatccaacaacaacgatgagtataaggttccgggcgaagtcctgaggacagctcaaacagcaagcgatgccaacactaccttaatctattatttattgccggacaacgtgacatctaaatggatttggtacttccatttcgccgaaacccaaatcttgccgagcggccagcaaagagagctcacggtttccacaagtgatggccgattcgaggagacagtggggctcgagtacttgaagccggtgaccattgtttccactccagtctctgggtctcaaatcaacttctcattcaaagcaacgacgatgcagtctggatatccgccaccgatcatcaatgcctttgagatctttcaaattaaagaacttctgaatgcaccaacagcccaagatgatgtcaaagctctcaccagcaccaaggcagagtatactgtgaataaagatagctggcaaggtgacccatgtgtaccacgcaaatttgcttgggatggtctgaattgtagctatggaaatcctccaagggttatttcattgaacctgagctctagcaatttgaggggcatcatctcttcttcactatcaaatctattggaattggagtccttagatctgtccaacaatcaacttacaggagccataccagaaactttggcaaatctgccaaaattgagaattctaaatctcagcggaaacgagcttaatggttcagttcctaaggctctcaaaagaaggcacgaagacaagacattggacttgagtcttaacaacaaccccgatctttgccaggaaagtccttgctcaaaggaggctaaaaactccatcttggtcccagttgttgcatcggtttcagtcgtattcgtagttatctgcgtgttgagtattgggttgattagaaggaaacggacaatagaatctagtgagaggaatttgggattaaagaatcgaccttttaagtatgaagaagtttcaagaatcactggaaactttggacaagtgattggtgaaggtggatttggaaaggtatatcttggtgcattggataacggcactgtagttgcagtgaagatgctctctgaatcatcaaagcaaggatacaaagaatttcaagccgaggcgcgaaccttactgattgttcaccacagaaacttggtttctctatttggatattgcaatgagtctaggcacatggcattgatatatgaatacatggcaaatggaaatttaaggcaacatttatcagaggaccatccaaagatcttgacatggagtaaaagactacatatagctgttgatgcagcacaaggtttggattatttgcataatggttgcaagccacccatcatccatagagacttgaagactacaaacatcttgttgaatgaagacttccaagccaagatagctgattttggcctttcaagagcttttgcaactgaaaatgacatttatgtgtcaacttgccctgcaggcactcccggctatctcgatcccgagtttcaatcttctggaaacataaccaagaagagtgatgtttatagtttcggaatcgtactctttgagttgatgacgggccaatctgcaataatgagaagccgggatggcagtgccagcgtgcacatacttgaatggttgattcctattgtcgaaagtggtgatatacatagcattatggatccaaggttacaaggagaatttgacatcaactcagcttggaaactagtggagattgctatgtcttgtacacgaccaacggcaattcaaaggtcggacataaatcacgtattggcagagttaaagcagtctttggtgagcaaatcaagcagttcttttgaaatgacctccttggagctccattctgacattgcccctatggcaagg

SEQ ID NO: 734 - protein, 835 aa, Eucalyptus grandis
  Eucgr.J02905.1
MKERFISIDCGAPNSYTDYVTNIDFFTDKGYIESGESMQISTKFIVQQFRQWLKNLRSFPSGMRNCYTLKPDKGKNNTYLIRASFWYADYDDKNRPPIFDLYIDVNHWATVDNSDKKHYEIVYVAQRNDIQVCLVNIGQGVPFISALELRPLDNSIYHIESGFLTLWKRFDVGGSNSTIRYPDDVYDRIWKGWNSPFWLMLNPGTSASDLSNNNDEYKVPGEVLRTAQTASDANTTLIYYLLPDNVTSKWIWYFHFAETQILPSGQQRELTVSTSDGRFEETVGLEYLKPVTIVSTPVSGSQINFSFKATTMQSGYPPPIINAFEIFQIKELLNAPTAQDDVKALTSTKAEYTVNKDSWQGDPCVPRKFAWDGLNCSYGNPPRVISLNLSSSNLRGIISSSLSNLLELESLDLSNNQLTGAIPETLANLPKLRILNLSGNELNGSVPKALKRRHEDKTLDLSLNNNPDLCQESPCSKEAKNSILVPVVASVSVVFVVICVLSIGLIRRKRTIESSERNLGLKNRPFKYEEVSRITGNFGQVIGEGGFGKVYLGALDNGTVVAVKMLSESSKQGYKEFQAEARTLLIVHHRNLVSLFGYCNESRHMALIYEYMANGNLRQHLSEDHPKILTWSKRLHIAVDAAQGLDYLHNGCKPPIIHRDLKTTNILLNEDFQAKIADFGLSRAFATENDIYVSTCPAGTPGYLDPEFQSSGNITKKSDVYSFGIVLFELMTGQSAIMRSRDGSASVHILEWLIPIVESGDIHSIMDPRLQGEFDINSAWKLVEIAMSCTRPTAIQRSDINHVLAELKQSLVSKSSSSFEMTSLELHSDIAPMAR

SEQ ID NO: 735 - DNA, 2412 bp, Eucalyptus grandis
  Eucgr.J02909.1
atgcagatatccacaaagttcatcggccaacaactccgacaatggttgaaaaatctaagaagttttcctagtgggatgagaaactgctacaccttgaaaccagacaaaggcaagaacaacacgtacttgattagagcatcattttggtatgcggcctatgatgataagaaccgacctcccatattcgacctatacatcgatgttaattattgggctacggttgataattctgataaaaagtactacgaaattgtctatgtggcccaaagggatgatatacaagtgtgcctcgtaaatattggccaaggagtgcccttcatttcggcattggaacttagaactttggacaattctctgtatcaaattgaatcaggaattcttatggttaatttcagaaatgacgtcggaggcttaaaagcgaccatcaggtacccggaagatgtctatgatcgcatctgggaaagacagacctttaactggtccatgctcaaccccgggaacgggacgtctgcctctgtattgtccataaacaacgacgcgtataaggttccaggagaagtcctcctcaccgctcaaacggcgaatgatgccactatttttttcccatcaaataactcgacgaatagatggattgggtacttccattttgcagaaacacaaagcttgctgagcggccagcaaagggagttcacggtttttacaagcgatggccaattcacggagacagtgaggctcgagtacttgaagccggtgactgtaatttccactcctgtcacagggtccatgatcaacttctcattccaagcacagtctggacatccaccaccgatcatcaacgccctggagatctttcttatccgagaacttccgaatgtaccaacagccctagatgatgtaaaagctctcactgacaccaaggcagagtatactatcaataaagatagttggcaaggagatccatgtgtaccaagaaaattttcgtgggatggtgtgaattgtagctatgaagatactccgagggttatttcgctaaatctgagctctagcaatttgaggggcatcatctcttcttcactatcaaatatattggaattggattccttagatttgtccaacaatcaacttataggagccataccggaagctttggcaaatctaccaaagttgagaattctaaatctcagtggaaacaagcttaatggttcggttccagaggctcttaaaaggaggcacgaagacaagacattggacttgagtcttaacaacaaccccgatctttgccaggcaagtccttgctcaaagaagaagactaaaaactccatctcggtcccagttgttgcatcggtttcagtcgtatttttagttatctgcgtgttgagtatttggttgattagaaggaaacagacagaatctagtgaaaggacactaagattaaagaatcgaccttttacgtatagagaggtttcaagaatcactgggaactttggacgagtgattggcgaaggtggatttggaaaggtttatgttggtgcactggttaacggcaccagagttgcagtcaagatgctctctgaatcatcaaagcaggggtacaaagaatttcaagcagaggcgcgactcttaatgattgttcaccatagaaacttggtttctttgtttggatattgcaatgagtctaagcacatggcattgatatatgaatacatggcaaatggaaatttaaggcaacatttatcagccacaggtaaagttaaaatccatccaacagaggaccatccgaaggtcttgacatggagtaagagactacaaatagctgtggatgcagcacaaggtacatgtttggattatttgcataatggttgcaagccacccatcatccatagagacttgaagactactaacatcttgttgaacaaagatttccaagctaaaatagctgattttggtttgtcaagagcttttgctactgaaaatgactcttatgtgtcaacttgtccagcgggcactcctggctacctcgaccccgagtttcaatcttctggaaacttaaacaagaagagtgatgtttatagttttggaatcgtactctttgagttgatcacgggccgacctccgataatgagaagcagggatgggcgcaccaacatgcacatacttaaatggttgattccgattgttgaaagtggcgatatacaaagcattatggatccaaggttgcaaggagaattcaacatcaactcggcttggaaagtagtggagattgctatgtcttgtacacgaccaacatcaattcaaaggccggacataaatcacgtcttggccgagctaaaggagtcttcggtgagcacttcaagtggttcttttgaaatgacctccctgaaactccattctgacaatgcccctgtggcaagg

SEQ ID NO: 736 - protein, 804 aa, Eucalyptus grandis
  Eucgr.J02909.1
MQISTKFIGQQLRQWLKNLRSFPSGMRNCYTLKPDKGKNNTYLIRASFWYAAYDDKNRPPIFDLYIDVNYWATVDNSDKKYYEIVYVAQRDDIQVCLVNIGQGVPFISALELRTLDNSLYQIESGILMVNFRNDVGGLKATIRYPEDVYDRIWERQTFNWSMLNPGNGTSASVLSINNDAYKVPGEVLLTAQTANDATIFFPSNNSTNRWIGYFHFAETQSLLSGQQREFTVFTSDGQFTETVRLEYLKPVTVISTPVTGSMINFSFQAQSGHPPPIINALEIFLIRELPNVPTALDDVKALTDTKAEYTINKDSWQGDPCVPRKFSWDGVNCSYEDTPRVISLNLSSSNLRGIISSSLSNILELDSLDLSNNQLIGAIPEALANLPKLRILNLSGNKLNGSVPEALKRRHEDKTLDLSLNNNPDLCQASPCSKKKTKNSISVPVVASVSVVFLVICVLSIWLIRRKQTESSERTLRLKNRPFTYREVSRITGNFGRVIGEGGFGKVYVGALVNGTRVAVKMLSESSKQGYKEFQAEARLLMIVHHRNLVSLFGYCNESKHMALIYEYMANGNLRQHLSATGKVKIHPTEDHPKVLTWSKRLQIAVDAAQGTCLDYLHNGCKPPIIHRDLKTTNILLNKDFQAKIADFGLSRAFATENDSYVSTCPAGTPGYLDPEFQSSGNLNKKSDVYSFGIVLFELITGRPPIMRSRDGRTNMHILKWLIPIVESGDIQSIMDPRLQGEFNINSAWKVVEIAMSCTRPTSIQRPDINHVLAELKESSVSTSSGSFEMTSLKLHSDNAPVAR

SEQ ID NO: 737 - DNA, 2406 bp, Eucalyptus grandis
  Eucgr.J02909.2
atgcagatatccacaaagttcatcggccaacaactccgacaatggttgaaaaatctaagaagttttcctagtgggatgagaaactgctacaccttgaaaccagacaaaggcaagaacaacacgtacttgattagagcatcattttggtatgcggcctatgatgataagaaccgacctcccatattcgacctatacatcgatgttaattattgggctacggttgataattctgataaaaagtactacgaaattgtctatgtggcccaaagggatgatatacaagtgtgcctcgtaaatattggccaaggagtgcccttcatttcggcattggaacttagaactttggacaattctctgtatcaaattgaatcaggaattcttatggttaatttcagaaatgacgtcggaggcttaaaagcgaccatcaggtacccggaagatgtctatgatcgcatctgggaaagacagacctttaactggtccatgctcaaccccgggaacgggacgtctgcctctgtattgtccataaacaacgacgcgtataaggttccaggagaagtcctcctcaccgctcaaacggcgaatgatgccactatttttttcccatcaaataactcgacgaatagatggattgggtacttccattttgcagaaacacaaagcttgctgagcggccagcaaagggagttcacggtttttacaagcgatggccaattcacggagacagtgaggctcgagtacttgaagccggtgactgtaatttccactcctgtcacagggtccatgatcaacttctcattccaagcacagtctggacatccaccaccgatcatcaacgccctggagatctttcttatccgagaacttccgaatgtaccaacagccctagatgatgtaaaagctctcactgacaccaaggcagagtatactatcaataaagatagttggcaaggagatccatgtgtaccaagaaaattttcgtgggatggtgtgaattgtagctatgaagatactccgagggttatttcgctaaatctgagctctagcaatttgaggggcatcatctcttcttcactatcaaatatattggaattggattccttagatttgtccaacaatcaacttataggagccataccggaagctttggcaaatctaccaaagttgagaattctaaatctcagtggaaacaagcttaatggttcggttccagaggctcttaaaaggaggcacgaagacaagacattggacttgagtcttaacaacaaccccgatctttgccaggcaagtccttgctcaaagaagaagactaaaaactccatctcggtcccagttgttgcatcggtttcagtcgtatttttagttatctgcgtgttgagtatttggttgattagaaggaaacagacagaatctagtgaaaggacactaagattaaagaatcgaccttttacgtatagagaggtttcaagaatcactgggaactttggacgagtgattggcgaaggtggatttggaaaggtttatgttggtgcactggttaacggcaccagagttgcagtcaagatgctctctgaatcatcaaagcaggggtacaaagaatttcaagcagaggcgcgactcttaatgattgttcaccatagaaacttggtttctttgtttggatattgcaatgagtctaagcacatggcattgatatatgaatacatggcaaatggaaatttaaggcaacatttatcagccacaggtaaagttaaaatccatccaacagaggaccatccgaaggtcttgacatggagtaagagactacaaatagctgtggatgcagcacaaggtttggattatttgcataatggttgcaagccacccatcatccatagagacttgaagactactaacatcttgttgaacaaagatttccaagctaaaatagctgattttggtttgtcaagagcttttgctactgaaaatgactcttatgtgtcaacttgtccagcgggcactcctggctacctcgaccccgagtttcaatcttctggaaacttaaacaagaagagtgatgtttatagttttggaatcgtactctttgagttgatcacgggccgacctccgataatgagaagcagggatgggcgcaccaacatgcacatacttaaatggttgattccgattgttgaaagtggcgatatacaaagcattatggatccaaggttgcaaggagaattcaacatcaactcggcttggaaagtagtggagattgctatgtcttgtacacgaccaacatcaattcaaaggccggacataaatcacgtcttggccgagctaaaggagtcttcggtgagcacttcaagtggttcttttgaaatgacctccctgaaactccattctgacaatgcccctgtggcaagg

SEQ ID NO: 738 - protein, 802 aa, Eucalyptus grandis
  Eucgr.J02909.2
MQISTKFIGQQLRQWLKNLRSFPSGMRNCYTLKPDKGKNNTYLIRASFWYAAYDDKNRPPIFDLYIDVNYWATVDNSDKKYYEIVYVAQRDDIQVCLVNIGQGVPFISALELRTLDNSLYQIESGILMVNFRNDVGGLKATIRYPEDVYDRIWERQTFNWSMLNPGNGTSASVLSINNDAYKVPGEVLLTAQTANDATIFFPSNNSTNRWIGYFHFAETQSLLSGQQREFTVFTSDGQFTETVRLEYLKPVTVISTPVTGSMINFSFQAQSGHPPPIINALEIFLIRELPNVPTALDDVKALTDTKAEYTINKDSWQGDPCVPRKFSWDGVNCSYEDTPRVISLNLSSSNLRGIISSSLSNILELDSLDLSNNQLIGAIPEALANLPKLRILNLSGNKLNGSVPEALKRRHEDKTLDLSLNNNPDLCQASPCSKKKTKNSISVPVVASVSVVFLVICVLSIWLIRRKQTESSERTLRLKNRPFTYREVSRITGNFGRVIGEGGFGKVYVGALVNGTRVAVKMLSESSKQGYKEFQAEARLLMIVHHRNLVSLFGYCNESKHMALIYEYMANGNLRQHLSATGKVKIHPTEDHPKVLTWSKRLQIAVDAAQGLDYLHNGCKPPIIHRDLKTTNILLNKDFQAKIADFGLSRAFATENDSYVSTCPAGTPGYLDPEFQSSGNLNKKSDVYSFGIVLFELITGRPPIMRSRDGRTNMHILKWLIPIVESGDIQSIMDPRLQGEFNINSAWKVVEIAMSCTRPTSIQRPDINHVLAELKESSVSTSSGSFEMTSLKLHSDNAPVAR

SEQ ID NO: 739 - DNA, 2400 bp, Eucalyptus grandis
  Eucgr.J02909.3
atgcagatatccacaaagttcatcggccaacaactccgacaatggttgaaaaatctaagaagttttcctagtgggatgagaaactgctacaccttgaaaccagacaaaggcaagaacaacacgtacttgattagagcatcattttggtatgcggcctatgatgataagaaccgacctcccatattcgacctatacatcgatgttaattattgggctacggttgataattctgataaaaagtactacgaaattgtctatgtggcccaaagggatgatatacaagtgtgcctcgtaaatattggccaaggagtgcccttcatttcggcattggaacttagaactttggacaattctctgtatcaaattgaatcaggaattcttatggttaatttcagaaatgacgtcggaggcttaaaagcgaccatcaggtacccggaagatgtctatgatcgcatctgggaaagacagacctttaactggtccatgctcaaccccgggaacgggacgtctgcctctgtattgtccataaacaacgacgcgtataaggttccaggagaagtcctcctcaccgctcaaacggcgaatgatgccactatttttttcccatcaaataactcgacgaatagatggattgggtacttccattttgcagaaacacaaagcttgctgagcggccagcaaagggagttcacggtttttacaagcgatggccaattcacggagacagtgaggctcgagtacttgaagccggtgactgtaatttccactcctgtcacagggtccatgatcaacttctcattccaagcacagtctggacatccaccaccgatcatcaacgccctggagatctttcttatccgagaacttccgaatgtaccaacagccctagatgatgtaaaagctctcactgacaccaaggcagagtatactatcaataaagatagttggcaaggagatccatgtgtaccaagaaaattttcgtgggatggtgtgaattgtagctatgaagatactccgagggttatttcgctaaatctgagctctagcaatttgaggggcatcatctcttcttcactatcaaatatattggaattggattccttagatttgtccaacaatcaacttataggagccataccggaagctttggcaaatctaccaaagttgagaattctaaatctcagtggaaacaagcttaatggttcggttccagaggctcttaaaaggaggcacgaagacaagacattggacttgagtcttaacaacaaccccgatctttgccaggcaagtccttgctcaaagaagaagactaaaaactccatctcggtcccagttgttgcatcggtttcagtcgtatttttagttatctgcgtgttgagtatttggttgattagaaggaaacagacagaatctagtgaaaggacactaagattaaagaatcgaccttttacgtatagagaggtttcaagaatcactgggaactttggacgagtgattggcgaaggtggatttggaaaggtttatgttggtgcactggttaacggcaccagagttgcagtcaagatgctctctgaatcatcaaagcaggggtacaaagaatttcaagcagaggcgcgactcttaatgattgttcaccatagaaacttggtttctttgtttggatattgcaatgagtctaagcacatggcattgatatatgaatacatggcaaatggaaatttaaggcaacatttatcaggtaaagttaaaatccatccaacagaggaccatccgaaggtcttgacatggagtaagagactacaaatagctgtggatgcagcacaaggtttggattatttgcataatggttgcaagccacccatcatccatagagacttgaagactactaacatcttgttgaacaaagatttccaagctaaaatagctgattttggtttgtcaagagcttttgctactgaaaatgactcttatgtgtcaacttgtccagcgggcactcctggctacctcgaccccgagtttcaatcttctggaaacttaaacaagaagagtgatgtttatagttttggaatcgtactctttgagttgatcacgggccgacctccgataatgagaagcagggatgggcgcaccaacatgcacatacttaaatggttgattccgattgttgaaagtggcgatatacaaagcattatggatccaaggttgcaaggagaattcaacatcaactcggcttggaaagtagtggagattgctatgtcttgtacacgaccaacatcaattcaaaggccggacataaatcacgtcttggccgagctaaaggagtcttcggtgagcacttcaagtggttcttttgaaatgacctccctgaaactccattctgacaatgcccctgtggcaagg

SEQ ID NO: 740 - protein, 800 aa, Eucalyptus grandis
  Eucgr.J02909.3
MQISTKFIGQQLRQWLKNLRSFPSGMRNCYTLKPDKGKNNTYLIRASFWYAAYDDKNRPPIFDLYIDVNYWATVDNSDKKYYEIVYVAQRDDIQVCLVNIGQGVPFISALELRTLDNSLYQIESGILMVNFRNDVGGLKATIRYPEDVYDRIWERQTFNWSMLNPGNGTSASVLSINNDAYKVPGEVLLTAQTANDATIFFPSNNSTNRWIGYFHFAETQSLLSGQQREFTVFTSDGQFTETVRLEYLKPVTVISTPVTGSMINFSFQAQSGHPPPIINALEIFLIRELPNVPTALDDVKALTDTKAEYTINKDSWQGDPCVPRKFSWDGVNCSYEDTPRVISLNLSSSNLRGIISSSLSNILELDSLDLSNNQLIGAIPEALANLPKLRILNLSGNKLNGSVPEALKRRHEDKTLDLSLNNNPDLCQASPCSKKKTKNSISVPVVASVSVVFLVICVLSIWLIRRKQTESSERTLRLKNRPFTYREVSRITGNFGRVIGEGGFGKVYVGALVNGTRVAVKMLSESSKQGYKEFQAEARLLMIVHHRNLVSLFGYCNESKHMALIYEYMANGNLRQHLSGKVKIHPTEDHPKVLTWSKRLQIAVDAAQGLDYLHNGCKPPIIHRDLKTTNILLNKDFQAKIADFGLSRAFATENDSYVSTCPAGTPGYLDPEFQSSGNLNKKSDVYSFGIVLFELITGRPPIMRSRDGRTNMHILKWLIPIVESGDIQSIMDPRLQGEFNINSAWKVVEIAMSCTRPTSIQRPDINHVLAELKESSVSTSSGSFEMTSLKLHSDNAPVAR

SEQ ID NO: 741 - DNA, 2445 bp, Eucalyptus grandis
  Eucgr.J01421.1
atgccggtgtccctcccatccaactaccaacgacgatcaaagaatcttaggatcttccccactggacaaaggaattgttacacattaaagccaaatgaaggaaagggcaacacatatttggtcagggcttcattttggtatggggattatgatggcaagaatcaaaccccggtatttgacctctatattgatgttaactattggaccacggtgaactcttcatcttggatatacgaagagattatatacactccttcaagagactatatacaagtttgcttggtgaataccagctcaggagttccattcttatcagctctcgacttgcggttgttggataagtcgatttaccaaatcaactctggtgcacttgtaaccagctggagacttaatttagggagcaattacacatacaggcatccacaagatgtatatgatcgcatctggacgggtcagacttatgaaaagttccagtcagtcagcaacaagacagccatcgagacaagtacaagtgatgatgcctttaaagttccacctgaagttttgatgaccgccgtacaaacacaatctgtcactgctaatttgactctgcgatggtcatcagacaactctgctaatgactggcttatgtactttcactttgtggaattgcaactgcaaaagaaagatatccgagaactcacggtacttgtacaaaataaagtcgtgaaaaccgtcatgctcgagaaccaaaggccggtgaccttaagctcatctcccataggtggaccatccttgaacttgactatttatgcgacagaccgctctactctgccacctctcctcaatgccgtcgagattttcactgaggcacaacttccattttcaccaacttttcttgatgactgtatctctttacgtggtggtttagtcaatgctatgtatgatgtcaagagaacatatgaggtgatcaaggctagctggcagggggatccatgtgttcctagacagtactcatggagcggactccattgtagcaacgatagtgctccaagagtcatctcgttgaacctgagctttagtggactgaaaggacggatagatacattgatctcccatttgacagcagtcgaatccctggatttatccaacaactcgttaactgggtctgtacctgagtttttatcacaaatgccgagcttgaaagttctgaatttaagcggaaacaacttgaacggctctgttcctcaaacactcttgaagaagaaggcagacggcacgttgctactaaggttagatggaaatccaaatctttgccaatcagacaattgtccaaccagcaatgtacagccgacgaaaaagggcatctctattgctccaatcatcgcagcagttgcagctgttctggtcttgattttattgggagctcttgcagtatcatggataatcagaagaagacaaatccaaaatgtttctaccactactacgactaccaactctactagaggatctattgggacattcaggttgtcaaaaaatcaaccttttacatctactgaggttacaagaattactgatgacttcagaacagtaatcggagagggaggatttgggaaagtttactttggcaaacttgatgatggcactgaagtcgcagtaaaaatgttatctcgatcatcaaagcaaggctacaaggagtttcacgcagaggcgcaactcctgatggtcgttcaccatagaaatctggtttcactcattggatattgcgaagaatatgaaaacatggcgctgatatatgaattcatgttcaatggaaatgttcggcaatatttgtcagcagcacaaaacgtgaatgttttgagttggagccagagactacaaatcgcaattgatgcagctcaagggttggagtacctgcataatggctgcaaaccccccattgtccatagggatttaaagacgtccaatattttactagacaaaaacatgcaagcgaagattgctgattttggattatcgaaggcatttgtaacagggcttgagtctcatatttcgactcacccagcaggaacacctggttatctcgatccagagtttcattcatctggaaaccggggcaagaagagcgatgtgtacagctttggtgtagttttattcgagttaatcacaggccaccccgccattataagaagtccagagggcagcagcatgcacatacttcactgggtgactccactcatagaaagaggggacatccagagcattgtcgatccgaggttgaatggccaattcagcatcaattctgcatggaaagcagtggaaatagccatgtcgtgcgtaccaacgatagcggtccaaaggccagacatagatcgtgttctgtcggaactaaaagaatgcttgacagcagagatcagttcaggaagaatacagggaatgggaaatagtaagagacaagtgagtctt

SEQ ID NO: 742 - protein, 815 aa, Eucalyptus grandis
  Eucgr.J01421.1
MPVSLPSNYQRRSKNLRIFPTGQRNCYTLKPNEGKGNTYLVRASFWYGDYDGKNQTPVFDLYIDVNYWTTVNSSSWIYEEIIYTPSRDYIQVCLVNTSSGVPFLSALDLRLLDKSIYQINSGALVTSWRLNLGSNYTYRHPQDVYDRIWTGQTYEKFQSVSNKTAIETSTSDDAFKVPPEVLMTAVQTQSVTANLTLRWSSDNSANDWLMYFHFVELQLQKKDIRELTVLVQNKVVKTVMLENQRPVTLSSSPIGGPSLNLTIYATDRSTLPPLLNAVEIFTEAQLPFSPTFLDDCISLRGGLVNAMYDVKRTYEVIKASWQGDPCVPRQYSWSGLHCSNDSAPRVISLNLSFSGLKGRIDTLISHLTAVESLDLSNNSLTGSVPEFLSQMPSLKVLNLSGNNLNGSVPQTLLKKKADGTLLLRLDGNPNLCQSDNCPTSNVQPTKKGISIAPIIAAVAAVLVLILLGALAVSWIIRRRQIQNVSTTTTTTNSTRGSIGTFRLSKNQPFTSTEVTRITDDFRTVIGEGGFGKVYFGKLDDGTEVAVKMLSRSSKQGYKEFHAEAQLLMVVHHRNLVSLIGYCEEYENMALIYEFMFNGNVRQYLSAAQNVNVLSWSQRLQIAIDAAQGLEYLHNGCKPPIVHRDLKTSNILLDKNMQAKIADFGLSKAFVTGLESHISTHPAGTPGYLDPEFHSSGNRGKKSDVYSFGVVLFELITGHPAIIRSPEGSSMHILHWVTPLIERGDIQSIVDPRLNGQFSINSAWKAVEIAMSCVPTIAVQRPDIDRVLSELKECLTAEISSGRIQGMGNSKRQVSL

SEQ ID NO: 743 - DNA, 2442 bp, Eucalyptus grandis
  Eucgr.J01421.2
atgccggtgtccctcccatccaactaccaacgacgatcaaagaatcttaggatcttccccactggacaaaggaattgttacacattaaagccaaatgaaggaaagggcaacacatatttggtcagggcttcattttggtatggggattatgatggcaagaatcaaaccccggtatttgacctctatattgatgttaactattggaccacggtgaactcttcatcttggatatacgaagagattatatacactccttcaagagactatatacaagtttgcttggtgaataccagctcaggagttccattcttatcagctctcgacttgcggttgttggataagtcgatttaccaaatcaactctggtgcacttgtaaccagctggagacttaatttagggagcaattacacatacaggcatccacaagatgtatatgatcgcatctggacgggtcagacttatgaaaagttccagtcagtcagcaacaagacagccatcgagacaagtacaagtgatgatgcctttaaagttccacctgaagttttgatgaccgccgtacaaacacaatctgtcactgctaatttgactctgcgatggtcatcagacaactctgctaatgactggcttatgtactttcactttgtggaattgcaactgcaaaagaaagatatccgagaactcacggtacttgtacaaaataaagtcgtgaaaaccgtcatgctcgagaaccaaaggccggtgaccttaagctcatctcccataggtggaccatccttgaacttgactatttatgcgacagaccgctctactctgccacctctcctcaatgccgtcgagattttcactgaggcacaacttccattttcaccaacttttcttgatgactgtatctctttacgtggtggtttagtcaatgctatgtatgatgtcaagagaacatatgaggtgatcaaggctagctggcagggggatccatgtgttcctagacagtactcatggagcggactccattgtagcaacgatagtgctccaagagtcatctcgttgaacctgagctttagtggactgaaaggacggatagatacattgatctcccatttgacagcagtcgaatccctggatttatccaacaactcgttaactgggtctgtacctgagtttttatcacaaatgccgagcttgaaagttctgaatttaagcggaaacaacttgaacggctctgttcctcaaacactcttgaagaagaaggcagacggcacgttgctactaaggttagatggaaatccaaatctttgccaatcagacaattgtccaaccagcaatgtacagccgacgaaaaagggcatctctattgctccaatcatcgcagcagttgcagctgttctggtcttgattttattgggagctcttgcagtatcatggataatcagaagaagacaaatccaaaatgtttctaccactactacgactaccaactctactagaggatctattgggacattcaggttgtcaaaaaatcaaccttttacatctactgaggttacaagaattactgatgacttcagaacagtaatcggagagggaggatttgggaaagtttactttggcaaacttgatgatggcactgaagtcgcagtaaaaatgttatctcgatcatcaaagcaaggctacaaggagtttcacgcagaggcgcaactcctgatggtcgttcaccatagaaatctggtttcactcattggatattgcgaagaatatgaaaacatggcgctgatatatgaattcatgttcaatggaaatgttcggcaatatttgtcagcacaaaacgtgaatgttttgagttggagccagagactacaaatcgcaattgatgcagctcaagggttggagtacctgcataatggctgcaaaccccccattgtccatagggatttaaagacgtccaatattttactagacaaaaacatgcaagcgaagattgctgattttggattatcgaaggcatttgtaacagggcttgagtctcatatttcgactcacccagcaggaacacctggttatctcgatccagagtttcattcatctggaaaccggggcaagaagagcgatgtgtacagctttggtgtagttttattcgagttaatcacaggccaccccgccattataagaagtccagagggcagcagcatgcacatacttcactgggtgactccactcatagaaagaggggacatccagagcattgtcgatccgaggttgaatggccaattcagcatcaattctgcatggaaagcagtggaaatagccatgtcgtgcgtaccaacgatagcggtccaaaggccagacatagatcgtgttctgtcggaactaaaagaatgcttgacagcagagatcagttcaggaagaatacagggaatgggaaatagtaagagacaagtgagtctt

SEQ ID NO: 744 - protein, 814 aa, Eucalyptus grandis
  Eucgr.J01421.2
MPVSLPSNYQRRSKNLRIFPTGQRNCYTLKPNEGKGNTYLVRASFWYGDYDGKNQTPVFDLYIDVNYWTTVNSSSWIYEEIIYTPSRDYIQVCLVNTSSGVPFLSALDLRLLDKSIYQINSGALVTSWRLNLGSNYTYRHPQDVYDRIWTGQTYEKFQSVSNKTAIETSTSDDAFKVPPEVLMTAVQTQSVTANLTLRWSSDNSANDWLMYFHFVELQLQKKDIRELTVLVQNKVVKTVMLENQRPVTLSSSPIGGPSLNLTIYATDRSTLPPLLNAVEIFTEAQLPFSPTFLDDCISLRGGLVNAMYDVKRTYEVIKASWQGDPCVPRQYSWSGLHCSNDSAPRVISLNLSFSGLKGRIDTLISHLTAVESLDLSNNSLTGSVPEFLSQMPSLKVLNLSGNNLNGSVPQTLLKKKADGTLLLRLDGNPNLCQSDNCPTSNVQPTKKGISIAPIIAAVAAVLVLILLGALAVSWIIRRRQIQNVSTTTTTTNSTRGSIGTFRLSKNQPFTSTEVTRITDDFRTVIGEGGFGKVYFGKLDDGTEVAVKMLSRSSKQGYKEFHAEAQLLMVVHHRNLVSLIGYCEEYENMALIYEFMFNGNVRQYLSAQNVNVLSWSQRLQIAIDAAQGLEYLHNGCKPPIVHRDLKTSNILLDKNMQAKIADFGLSKAFVTGLESHISTHPAGTPGYLDPEFHSSGNRGKKSDVYSFGVVLFELITGHPAIIRSPEGSSMHILHWVTPLIERGDIQSIVDPRLNGQFSINSAWKAVEIAMSCVPTIAVQRPDIDRVLSELKECLTAEISSGRIQGMGNSKRQVSL

SEQ ID NO: 745 - DNA, 2478 bp, Eucalyptus grandis
  Eucgr.J02925.1
atgcaagtgtctacccgggtcatcgacctgccctttcaacaccaatcaaagaatctcaggaccttccccaatggaacgaggaattgttacacattaacgccagatgaaggaaggggcaacacatatttggtgagggcttcattttggtatggttactatgatggcaagaatcaaactccagcatttgacctccatattgatgtcaactattggagcacagtggactctacatcttggatatacgaagagattatttacactcctccaagagattacatacaagtttgtttggtgaataccggctcgggagttccattcatatcaactctcgagttgcggttgctagataactcgacttaccagatcaattccggtgcacttgtgaccatgtggagatttaatttagggagcatagatacgtacaggcatccacaagatgtatatgatcgcatctgggccaataagacttatgaaggttggtcatcagtcagcaacacgacggccatcgtgacgagtataagcaacgatgcctataaagttccacctgaagttttgatgacagccacacaagtacaaaatgtcactgatcttttgagtctattctggaaatcagagaactccactactgtctggtctgtatactttcactttgtggaattgcaactgcaagaaaacgacatcagagaactcacggtaaatgtactaaatgaatccgtgaaaaccgtcatgctggagaacctaaagccggtgaccatagcctcatttcccattgctggactatctttggacttgaccattaaagcgacggaccgctccactctgccacctctcctcaatgccctcgagatttttcacgtgtcaccacttccaaattcaccgacttttcttgatgacttcaatgctatgtatgatatcaagagaacatatggggtgattagagctagctggcaaggtgatccatgcgtccctatgcagtactcttggagcggactacattgtagccatgatagttctccgagaatcgtctcgttgaacctgagctctagtggactaaaaggactgatagcgacatcaatctccaatttgacagcagttgtatccctggatttatccaacaattcattaactgggtccgtgccagactttttagcacaaatgccgagcttggaagttctgagtttaagtgggaacgacttgaatggctctgttcctcaaactctcttgaagaagtggacagatggatcattgcgacttagcttagatggaaatccaaatctttgccaatcagacaattgtccaaccagcaatgtgcagccaaagaaaaagggcatctctattgctccaatcattgcatcggttgcagctgttctggcgttgattttattgggagctcttgcagtattgtggataatcaaaagaagacaaatccaaaatgctgctgctaatactactaccaccacttttggaggatctactgggacacaaggatctaccgggacactaaggttgtcaaaaaatcaacattttacatccactgaggttgcaagaattactgataactttagaacagtaattggagagggaggatttgggaaagtttactttggcaggcttgacaatggcactgaagtcgcagtaaaaatgttatcccaatcatcaaagcaaggctacaagcagtttcacacagaggcccaactcctgatggtcgttcaccatagaaatctggtttcacttatcggatattgcgaagaatttgaaaacatggcgctgatttacgaatttatgtccaacggaaatgtgcggcaacatttgtcagcacacaacccaaatgttttgagttggagccagagactacaaatcgcagtcgatgcagctcaagggttggagtacctgcataacggctgcaaacctcctattatccatagagatctaaagacccccaatattttactaaacgagaacatgcaagcaaagatttgtgattttggattatcaaaagcatttgtaagggagcaggattcttatatttcgacttgtccagcagggacgcctggttatctcgatccggagtttcatatacttggacactcgagccaaaagagcgacatatacagcttcggcatagttttattcgagttaatcacaggccaccctgccattataagaagtccagagggcagcatgcacatacttcagtgggtaactccactcatagaaagaggggacatccaaagcattgtcgatccgaggttaaatgaccaattcaacatcggttctgcacggaaagcggtggaaatagccatgtcgtgtgtaccaacgaaagtggtccaaagggcagacataaaccgtgttttgtcggaactaaaagaatccttgacggtggagatcagttcaggaagaagccaaagaatgggaaatagtaagagtagtgagtttgatacaaccgcaatagagcttgatagtcctccgtcggctcgt

SEQ ID NO: 746 - protein, 826 aa, Eucalyptus grandis
  Eucgr.J02925.1
MQVSTRVIDLPFQHQSKNLRTFPNGTRNCYTLTPDEGRGNTYLVRASFWYGYYDGKNQTPAFDLHIDVNYWSTVDSTSWIYEEIIYTPPRDYIQVCLVNTGSGVPFISTLELRLLDNSTYQINSGALVTMWRFNLGSIDTYRHPQDVYDRIWANKTYEGWSSVSNTTAIVTSISNDAYKVPPEVLMTATQVQNVTDLLSLFWKSENSTTVWSVYFHFVELQLQENDIRELTVNVLNESVKTVMLENLKPVTIASFPIAGLSLDLTIKATDRSTLPPLLNALEIFHVSPLPNSPTFLDDFNAMYDIKRTYGVIRASWQGDPCVPMQYSWSGLHCSHDSSPRIVSLNLSSSGLKGLIATSISNLTAVVSLDLSNNSLTGSVPDFLAQMPSLEVLSLSGNDLNGSVPQTLLKKWTDGSLRLSLDGNPNLCQSDNCPTSNVQPKKKGISIAPIIASVAAVLALILLGALAVLWIIKRRQIQNAAANTTTTTFGGSTGTQGSTGTLRLSKNQHFTSTEVARITDNFRTVIGEGGFGKVYFGRLDNGTEVAVKMLSQSSKQGYKQFHTEAQLLMVVHHRNLVSLIGYCEEFENMALIYEFMSNGNVRQHLSAHNPNVLSWSQRLQIAVDAAQGLEYLHNGCKPPIIHRDLKTPNILLNENMQAKICDFGLSKAFVREQDSYISTCPAGTPGYLDPEFHILGHSSQKSDIYSFGIVLFELITGHPAIIRSPEGSMHILQWVTPLIERGDIQSIVDPRLNDQFNIGSARKAVEIAMSCVPTKVVQRADINRVLSELKESLTVEISSGRSQRMGNSKSSEFDTTAIELDSPPSAR

SEQ ID NO: 747 - DNA, 2457 bp, Eucalyptus grandis
  Eucgr.J02912.1
atgaagatcttgaagatgctgcatgtcttgattggttgtctagctctagcagtcattgctcgcggccaacaaaatccaggtttcataagcatcgattgcggagcacctaatgattaccatgatgaccagctcaacatatactacaaggccgatgcgggatatgtagattccggaacaaacgtgcaggtgtctacccaggtcatctaccaaaacaaccaacaacaatcaaagaatctccggatcttccctagtggaaaaaggaattgttatacattaatgccaaatgaaggaaagggcagcacgtatttggtcagggcttcattttggtatggtaattatgatggcaaagatcaaaccccagcatttgacctccatattgatgttaactattggatcaccgcgaactcttcgtcttggatatacaaagagattatttacactcctccgagagattacatacaaatttgcttggtgaatatcggcttgggagttccatttatatcagctctggagttgcggctgctggataactcgacttaccagatcaattccggtgcacttgtaaccaactggaaatataatttggggagcctaagcacatacgggcatccgcaagatgtatatgatcgcatctggaacaataagacttatagtggaggttggtcatcagttagcaacacaacggccatcatgacaagtacaagcaatgatgcctataaagttccgcccgaagttttgatgaccgccacacaagtacaaaatgtcactgatcctctgagtctgtttcggacctcggagaactccaccactgtctggtatatatacttccactttgtggaattgcaattgcaaaagggtcaattcagagaattcgccatatatgtacaagacgaattcgtggaaactgtcatgctcgagaacctaaagccagtgaccgtagcctcattgcccataagtggacataatttgaacttgactattagtgcgacggcccgctctagtctgccaccgctcctcaatgccgtcgagtttttcactgtggcacagctcccaaattcaccgacttttcttgatgattgtatatttatatctatgctcccacttaattttttttttaaaacatatggggtgatcagagctagctggcagggtgatccatgcattcctacgcagtacacatggagcggactgaattgtagctatgatagttctccaagaatcatctcattgaacctgagctccagtggactgaaaggaccgatagctacatcaatctccaatttgacagcagttgtatccctggatttatcgaacaattcattaactgggtccatgccagactttttagctcaaatgccgaacttgaaagttctgaatttaagtggaaacaacatgaatggctctgttcctcaaactctgttgaagaagaaggcagatggatcgttgctattaagcttagatggaaatccaaatctttgccaatcagacaattgtcagaccagcaatgtgcagccaaagaaaaagggcatctctgttgccccaatcattgcatcagttgcagccattctggtcttggtttcattgggagctcttgcagtgttgtggataatcaaaagaagacaaatccaagacgttactactattactacaactaccaactctagcgaaggatatactgggacattaaagttgtcaaaaaatcgaccttttacatccactgaggttacaagaattactgataactttagaactgtaattggagagggaggatttgggaaagtctactttggcagacttgatgatggcattcaagtcgcggtaaaaatgttatctcgatcatcaaagcaaggctacaaggaatttcacgcagaggcacaactcttgatggtcgttcaccacagaaatctagtttcacttatcggatattgcgaagaatttgaaaacatggcactgatttacgaattcatgtccaatggaaatgttcggcaacatttgtcagcacacaaccctagtgttttgagttggagcgagagactaaaaatcgcaatcgatgcagctcaagggttagagtacctgcataatggctgtaaacctcccgttgtccatagagatttaaagacgcccaatattttactaaacgaaaacatgcaagcgaagattgctgattttggattatcaaaggcatttgtaacagagcatgattctcatatttcgactcgcccagcaggaacgccgggttatcttgatccggagtttcatacatctggaaacttgagcaagaagagcgatgtatacagttttggtatagttttattcgagttaatcactggccaccccgccattataagaagtccagagggcagcatgcacatacttcgctgggtaactccactcatagaaagaggggacatccaaaatttagggactcgatttagtgtcgaatccggctttcgggga

SEQ ID NO: 748 - protein, 820 aa, Eucalyptus grandis
  Eucgr.J02912.1
MKILKMLHVLIGCLALAVIARGQQNPGFISIDCGAPNDYHDDQLNIYYKADAGYVDSGTNVQVSTQVIYQNNQQQSKNLRIFPSGKRNCYTLMPNEGKGSTYLVRASFWYGNYDGKDQTPAFDLHIDVNYWITANSSSWIYKEIIYTPPRDYIQICLVNIGLGVPFISALELRLLDNSTYQINSGALVTNWKYNLGSLSTYGHPQDVYDRIWNNKTYSGGWSSVSNTTAIMTSTSNDAYKVPPEVLMTATQVQNVTDPLSLFRTSENSTTVWYIYFHFVELQLQKGQFREFAIYVQDEFVETVMLENLKPVTVASLPISGHNLNLTISATARSSLPPLLNAVEFFTVAQLPNSPTFLDDCIFISMLPLNFFFKTYGVIRASWQGDPCIPTQYTWSGLNCSYDSSPRIISLNLSSSGLKGPIATSISNLTAVVSLDLSNNSLTGSMPDFLAQMPNLKVLNLSGNNMNGSVPQTLLKKKADGSLLLSLDGNPNLCQSDNCQTSNVQPKKKGISVAPIIASVAAILVLVSLGALAVLWIIKRRQIQDVTTITTTTNSSEGYTGTLKLSKNRPFTSTEVTRITDNFRTVIGEGGFGKVYFGRLDDGIQVAVKMLSRSSKQGYKEFHAEAQLLMVVHHRNLVSLIGYCEEFENMALIYEFMSNGNVRQHLSAHNPSVLSWSERLKIAIDAAQGLEYLHNGCKPPVVHRDLKTPNILLNENMQAKIADFGLSKAFVTEHDSHISTRPAGTPGYLDPEFHTSGNLSKKSDVYSFGIVLFELITGHPAIIRSPEGSMHILRWVTPLIERGDIQNLGTRFSVESGFRGS

SEQ ID NO: 749 - DNA, 2631 bp, Populus trichocarpa
  POPTR_0019s12400.1
atggatggtgggcaaatactgctttcttatataaaagtatgggtgatcctccttttgctcttagctacgtttcagaactcaaaactagctgccaaaaatactgagcaggataaaaaaagaaagcttgctgaagaaaacccaggcatcagcattgattgtggggcggatgaagattatacggataggaatactggaatatcttacaaaaccgacaaagatttcattagtacgggcaagaatatgatcgtaccaccagagcatcacttgacaattccttactttggggatatgatgaatagcttgagaacctttcctgaaggtaaaatgaattgttatacattgaaacccatacagggtaagaaccaaaactatctcgtcagagctttcttttactatggaaattacgattctgagaatcaagctcaaataaattttgatctatacctcggggtaaactattggacaacagtacagcctgtcaaagatacgccgtggaaatattacattaatattcattattcagtaactgataccatttatgtgtgtctcgtaaatacgggttccggagttcctttcatcaatggattggatttacggttcatgaatgatgattccccgtatagaagtatgaatggatcgttgcttcctgagtacttgtgttattgtttctcacatgcattcaggtacaaagatgacgtgtacgatcgcatctggtggtttgacaacctcgacgatgcagtttcaattattaacaccgaagcaaatattgatatcggcagtgataatccctgccgtctaccagtcgaagtcttgagaacagcggttcagcctcgaaatggccttaattcattgagctacaacaaaaaattatggtatccagagtatttcccacatgagtttcttgtcttctttcactttgctgaaatcgagcagattgcaccaggcgaaatacgagaattcaacattactttgaatggcttaaactatggtccctttaccatacgttcaaatatatcacaagttcaagaagatcaagttaggttttctattgatgcaacgttgcggtctcaccttccacctatcctaaatgcctttgagatcttcaaactatggccactccctgattcaccgacaaaccaaacagacgttgatgcaatcatggccatcaagaaagcatacaaaatagatcgagttaactggcaaggagatccatgtttgccacttactacgtggtctggtttgcagtgcaacaatgataatcctccaaggatcatctcgctgaatctaagttcaagtcaattatcagggaatatagatgtttcactcttgagcctcacagcaatccaatccttggatttatcaaacaatgaattgacagggacagtgccagaagcttttgcgcaactaccaaatcttactagcatatatttgagcgggaacaaactcacaggtgcagttcctcatggtctcaaggaaaagtctaacaatggacagttgcaactgagtttggaaggaaatctggatttatgcaagatggatacatgtgaaaagaagaagttttctgtttcagttattgcatctgtcatatcagtttcggtgctcctcctccttagcattataaccatcttctggaggttgaaaggagtgggcttatctagaaaagaattgtcactgaaatcaaagaatcaaccatttacatacactgaaatagttagcattaccaataatttccaaaccattattggagaaggaggatttggaaaagtatatcttggaaacctcaaagatggtcgtcaagttgctgtcaagttgttatctcaatcctcaaggcaaggttataaagaatttctagcggaggtccaactattgatgattgttcatcacagaaacttggtgtccctcattggttactgtaatgagcatgcaaatatggcacttgtttatgaatacatggcaaatgggaacttgaaggagcaattgttagaaaatagcacaaatatgttgaaatggagggaaaggctgcaaattgcagtagacacagcacaaggtttggaatatttgcataatggttgcaaaccgccaatagtccatagagatttgaaatcatccaacatcttattaactaaaaaccttcatgccaagattgctgatttcgggctgtccaaagcattcgccaccgaaggagactcgcatgtcataactgtacctgcaggcacgcccggatacattgatcctgaatttcgagcatcaggaaacttaaataagaaaagtgatgtttacagtttcggtattcttctatgtgagctaataactggtcaaccgcctttaataaggggccatcagggccacactcacatacttcaatgggtgagtcctctaattgaaataggggatatccaaagcattatcgatccaaggctgcaaggtgaattcaacactaattgtgcttggaaagctctggagatagcactgtcctgcgtgcccccgacttcaacacaaaggccggacatgagtgatattttgggagagctaaaggaatgtctggccatggagatgtcatctgaaatgagcatgcgcggttccgttgaaatgagcttggtgcttggcacagatatggctccaaatcttagg

SEQ ID NO: 750 - protein, 877 aa, Populus trichocarpa
  POPTR_0019s12400.1
MDGGQILLSYIKVWVILLLLLATFQNSKLAAKNTEQDKKRKLAEENPGISIDCGADEDYTDRNTGISYKTDKDFISTGKNMIVPPEHHLTIPYFGDMMNSLRTFPEGKMNCYTLKPIQGKNQNYLVRAFFYYGNYDSENQAQINFDLYLGVNYWTTVQPVKDTPWKYYINIHYSVTDTIYVCLVNTGSGVPFINGLDLRFMNDDSPYRSMNGSLLPEYLCYCFSHAFRYKDDVYDRIWWFDNLDDAVSIINTEANIDIGSDNPCRLPVEVLRTAVQPRNGLNSLSYNKKLWYPEYFPHEFLVFFHFAEIEQIAPGEIREFNITLNGLNYGPFTIRSNISQVQEDQVRFSIDATLRSHLPPILNAFEIFKLWPLPDSPTNQTDVDAIMAIKKAYKIDRVNWQGDPCLPLTTWSGLQCNNDNPPRIISLNLSSSQLSGNIDVSLLSLTAIQSLDLSNNELTGTVPEAFAQLPNLTSIYLSGNKLTGAVPHGLKEKSNNGQLQLSLEGNLDLCKMDTCEKKKFSVSVIASVISVSVLLLLSIITIFWRLKGVGLSRKELSLKSKNQPFTYTEIVSITNNFQTIIGEGGFGKVYLGNLKDGRQVAVKLLSQSSRQGYKEFLAEVQLLMIVHHRNLVSLIGYCNEHANMALVYEYMANGNLKEQLLENSTNMLKWRERLQIAVDTAQGLEYLHNGCKPPIVHRDLKSSNILLTKNLHAKIADFGLSKAFATEGDSHVITVPAGTPGYIDPEFRASGNLNKKSDVYSFGILLCELITGQPPLIRGHQGHTHILQWVSPLIEIGDIQSIIDPRLQGEFNTNCAWKALEIALSCVPPTSTQRPDMSDILGELKECLAMEMSSEMSMRGSVEMSLVLGTDMAPNLR

SEQ ID NO: 751 - DNA, 2343 bp, Populus trichocarpa
  POPTR_0086s00230.1
atgatcgtagctccagagtattccaataggaaattggtggatagcttgagaacctttcctgaaggtaaaaggaattgttatacattgaaacctagagagggtaagaaccaaaactattacgtcagagctttcatctactatggaaattacgattctaagaatcaaactcaaatgtttgatctgtacgtcggggtaaactattgggcaacagtggatattaatgtcgaagatatgtttgcgacatattacggaattattcattattcagtaactgataccattaatgtgtgtctcgtaaatacgggttctggagttcctttcatcaatggattggatttacggttcatgaatgattccccgtatagaagtatgaatggatcgttgcttcctagggtgcaagctgaccttggcggcctggatccaaccaaaacctccatgaggtacaaagatgacgtgtatgatcgcatctggcggcttgacgtcaacctcaacgattcagtttcaattagcaccgaaacaaatattgatatccagggcagtgataatccctgccgtctaccagtcgaagtcttgagaacagcggttcagcctcgaaatggccttaattcattgagctacaactatacacggtatacagaaaattctgagtttcatgtcttctttcactttgctgaaatcgagcagattgcaccaggcgaaatacgagaattcaccattactttgaatggtttaaactatgggctctttacccttgaatacttgaagccattgaccataggtccatataaattacaagatcaagttaggttttctattgatgcaacgttgcggtctgaccttccacctatcctaaatgcctttgagatcttcaaactagggccactccctgattcaccgacaaaccaaacagacgttgatgcaatcatggccatcaagaaagcatacaaaatagatcgagttgactggcaaggagatccatgtttgccacttcctacgtggaatctaagttcaagtcaattatcagggaatatagctgtttcactcttgaacctcagagcaatccaatccttggatttatcaaacaatgaattgacagggacagtgccagaagcttttgcgcagctgccatatcttacaatcctatatttgagcgggaacaaactcacaggtgcagttccccatagtctcaaggaaaagtctagcagtggacagttgcagctgagtttggaaggaaatccggatttatgcaagatggctacatgtgaaaagaagccgcgaagttttcctgttccagttattgcatctgtcataccagtttcagtgctcctcctccttagcattataaccatcttctggaggttgaaaagagtgggcttatccagaaaagaattgtcactgaaatcaaagaatcaaccatttacatacactgaaatagttagcattaccaataatttccaaaccattattggagaaggaggattcggaagagtataccttggcaacctgaaagatggtcatcaagttgctgtcaagttgttatctcaatcctcaaggcaaggttgtaaagaatttctggcggaggtccaactattgatgattgttcatcacaaaaacttggtgtccctcgttggttactgtaatgagcatgaaaatatggcacttgtttatgaatacatggcaaatgggaacttgaaggagcaattcacaaatatgttgaattggagggaaaggctgcaaattgcagtagacacaacacaaggtttggaatatctgcataatggttgcaggccgccaatagtccatagagatttgaaatcatccaacatcttattaactgaaaaccttcaagccaagattgctgatttcgggctgtccaaagccttcgcaaccgaaggagactctcatgtcataactgaacctgcaggcacgaacggatacattgatcctgaatttcgagcatcaggaaacttaaataagaaaagtgatgtttacagcttcggtattcttctatgtgagctaataactggtcaaccgcctttaataaggggccatcagggccacactcacatacttcaatgggtgagtcctctagttgaaagaggtgatatccagagcattatcgatccaaggttgcaaggtgaattcaacactaattgtgcttggaaagctctggagatagcattgtcctgtgtgcccccgacttcaagacaaaggcctgacatgagtgatattttgggagagctgaaggaatgtctggccatggagatgtcatctaaaatgagcatgcacgattccgttgaaatgaacttggtgcttgacacagatatgactccaaatcttagg

SEQ ID NO: 752 - protein, 781 aa, Populus trichocarpa
  POPTR_0086s00230.1
MIVAPEYSNRKLVDSLRTFPEGKRNCYTLKPREGKNQNYYVRAFIYYGNYDSKNQTQMFDLYVGVNYWATVDINVEDMFATYYGIIHYSVTDTINVCLVNTGSGVPFINGLDLRFMNDSPYRSMNGSLLPRVQADLGGLDPTKTSMRYKDDVYDRIWRLDVNLNDSVSISTETNIDIQGSDNPCRLPVEVLRTAVQPRNGLNSLSYNYTRYTENSEFHVFFHFAEIEQIAPGEIREFTITLNGLNYGLFTLEYLKPLTIGPYKLQDQVRFSIDATLRSDLPPILNAFEIFKLGPLPDSPTNQTDVDAIMAIKKAYKIDRVDWQGDPCLPLPTWNLSSSQLSGNIAVSLLNLRAIQSLDLSNNELTGTVPEAFAQLPYLTILYLSGNKLTGAVPHSLKEKSSSGQLQLSLEGNPDLCKMATCEKKPRSFPVPVIASVIPVSVLLLLSIITIFWRLKRVGLSRKELSLKSKNQPFTYTEIVSITNNFQTIIGEGGFGRVYLGNLKDGHQVAVKLLSQSSRQGCKEFLAEVQLLMIVHHKNLVSLVGYCNEHENMALVYEYMANGNLKEQFTNMLNWRERLQIAVDTTQGLEYLHNGCRPPIVHRDLKSSNILLTENLQAKIADFGLSKAFATEGDSHVITEPAGTNGYIDPEFRASGNLNKKSDVYSFGILLCELITGQPPLIRGHQGHTHILQWVSPLVERGDIQSIIDPRLQGEFNTNCAWKALEIALSCVPPTSRQRPDMSDILGELKECLAMEMSSKMSMHDSVEMNLVLDTDMTPNLR

SEQ ID NO: 753 - DNA, 2076 bp, Populus trichocarpa
  POPTR_0144s00240.1
atgcataaaatatttttaaattatatactttacgttgatagattattagcaaatctcttccatttattagttgttttttctttaattactcgtttttacaatgatgacgtgtataatcgctactggcggcttgacgtcaacctcaacgattcagtttcaattagcaccgaaacaaatattgatatccagggcagtggtaatccctgccgtctacctgtcgaagtcttgagaacagcggttcagcctcgaaatgtccttaattcattgagctacaaccgtacattatggtatccaaagaatttcacacctgagtttcttgtcttctttcactttgctgaaatcgagcagattgcaccaggcgaaatacgagaattcaccattactttgaatggcttaaactatgggctctttacccttgaatacttgaagccattgaccatacgttcaaatataacacaagttcaagaaggtcaagttaggttttctattcatgcaacgttgcggtctgaccttccacctatcctaaatgcctttgagatcttccaactatggccagtccctgattcaccgacaaaccaaacagacgttgatgcaatcatggccattaagaaagcatacaaaatagatcgagttgactggcaaggagatccatgtttgccacttcctacgtggtctggtttgcagtgcaacaatgataatcctccaaggatcatctcgctgaatctaagttcaagtcaattatcagggaatatagctgtttcactcttgaacctcagagcaatccaatccttggatttatcaaacaatgaattgacagggacagtgccagaagcttttgcgcagctgccagagcttactatcctatatttgaacgggaacaaactcacaggtgcagttccctatagtctcaaggaaaagtctaacagtggacagttgcagctgagtttggatggaaatctggatttatgcaagatggatacatgtgaaaagaagcagcgaagttttcttgttccagttattgcatctgtcatatcagtttcggtgctcctcctccttagcattataaccatcttctggaggttgaaaagagtgggcttatccagaaaagaattgtcactgaaatcaaagaatcaaccatttacatacactgaaatagttagcattaccaataatttccaaaccattattggagaaggaggattcggaaaagtatatcttggcaacctgaaagatggtcatcaagttgctgtcaagttgttatctcaatcctcaaggcaaggttataaagaatttctagcggaggtccaactattgatgattgttcatcacagaaacttggtgtccctcgttggttactgtaatgagcatgaaaatatggcacttgtttatgaatacatggcaaatgggaacttgaaggagcaattgttagaaaatagcacaaatatgttgaattggagggaaaggctgcaaattgcagtagatgcagcacaaggtttggaatatttgcataatggttgcaggccgccaatagtccatagagatttgaaatcatccaacatcttattaactgaaaaccttcaagccaagattgctgatttcgggctgtccaaagccttcgcaaccgaaggagactctcatgtcataactgatcctgcaggcacgctcggatacattgatcctgaatttcgagcatcaggaaacttaaataagaaaagtgatgtttacagcttcggtattcttatgtgtgagctaataactggtcaaccgcctttaataaggggccataagggccacactcatatacttcaatgggtgagtcctttagttgaaagaggtgatatccagagcattatcgattcaaggctgcaaggtgaattcagcactaattgtgcttggaaagctctggagatagcactgtcttgcgtgccctcgacttcaagacaaaggccggacatgagtgatattttaggagagctgaaggaatgtctggccatggagatgtcatctaaaatgagcatgtgcgattccgttgaaatgaacttggtgcttggcacagatatggctccaaatcttagg

SEQ ID NO: 754 - protein, 692 aa, Populus trichocarpa
  POPTR_0144s00240.1
MHKIFLNYILYVDRLLANLFHLLVVFSLITRFYNDDVYNRYWRLDVNLNDSVSISTETNIDIQGSGNPCRLPVEVLRTAVQPRNVLNSLSYNRTLWYPKNFTPEFLVFFHFAEIEQIAPGEIREFTITLNGLNYGLFTLEYLKPLTIRSNITQVQEGQVRFSIHATLRSDLPPILNAFEIFQLWPVPDSPTNQTDVDAIMAIKKAYKIDRVDWQGDPCLPLPTWSGLQCNNDNPPRIISLNLSSSQLSGNIAVSLLNLRAIQSLDLSNNELTGTVPEAFAQLPELTILYLNGNKLTGAVPYSLKEKSNSGQLQLSLDGNLDLCKMDTCEKKQRSFLVPVIASVISVSVLLLLSIITIFWRLKRVGLSRKELSLKSKNQPFTYTEIVSITNNFQTIIGEGGFGKVYLGNLKDGHQVAVKLLSQSSRQGYKEFLAEVQLLMIVHHRNLVSLVGYCNEHENMALVYEYMANGNLKEQLLENSTNMLNWRERLQIAVDAAQGLEYLHNGCRPPIVHRDLKSSNILLTENLQAKIADFGLSKAFATEGDSHVITDPAGTLGYIDPEFRASGNLNKKSDVYSFGILMCELITGQPPLIRGHKGHTHILQWVSPLVERGDIQSIIDSRLQGEFSTNCAWKALEIALSCVPSTSRQRPDMSDILGELKECLAMEMSSKMSMCDSVEMNLVLGTDMAPNLR

SEQ ID NO: 755 - DNA, 2373 bp, Glycine max
  Glyma08g21170.1
tttataagcattgactgtggagcaagtaacgattacttggacgaggaaacaagtaccttttataagacagacacagatttcatagaaacgggagaaaacttgttgacgtcttcccaatttattaacacaaatatccctgattatggaagacagctacgcacattgagaagcttccctgagggaaataggaactgttatactctgaagcccgagtataagcaaggtgagcagcaaagttatatgattcgggctatgttcggatatggaaactacgatggaaaaaatcatgcccctacgttcgatctctatctcggggtcaactactggaaaaatgttaacacggcaaacagatcctatatttggaccgagattattcatgctcccacaacagacaccatacaagtgtgtctggttaatattgacactggtacacctttcatttcgtcattagagttacgacctttaagcacttccatttaccaaatcattgctagagactttgttgcattgtggagatataagttgatcagtgattggaaagggagaatgaagagggaaaaagttcggatcgacaatgtttcctataggtacaaggacgatatctatgatcgcaggtggtactggcgcgatgttaaagattggtataagatcaatacaaccatagatgttaataaatctggcaatgatatttataaagtaccagctgaagtcttgaaaaccgcagtgcagtccttcaatcgctcatatgacttgcactatgactttgaaattgaatggaatcttcaattgaacaagtattccggatattatgtctactttcactttgctgaaattcaacagcttgctccagggctcagaaggataatcaacatcactctcaatgatgaaaacatactctctgagcctataactctcgaatatatgaagcctgtcactattagtaacaaaaatgcaactcaaggtttcgttcgcttttcaattagagcaactgcagaatcggatgctcccccaattctcaatgcttttgaggtttataaattagtaacagatctaaattcaccaacagatattaaagatgttgatgccatcgtgaacatcaaacgctactatgggatatccagaatagattggcaaggggacccatgtgttccagaaatattcagatggagtggcctggactgcagctacggcatcaatcctagaatcatatcattgaaccttagctcaagcaaactaggagggcagatagccgcttcagtctcagatctttcagaactacagtccctggatgtctcagataacagtttaaatggttttgtgcccgagtcattatctcaacttgagtacctgaggattttaaatataggagggaataagctatcggggtcaattcctgcaaaactaattgagagatcaaagaatgggtcactaatattaagtgttgatggaaatcaaaatctttgcacctcgactccatgccacaagagaaacagggttgtaattccgttggtagcaacacttgcgggagccttcatccttttggcagtatcattatttgtttttagaagagtacaagactcgaagaaacaagagttcagctactcagaggttcaaatgattacgaataattttgagagggttgtgggtaaaggaggatttggaactgtctactatggttgcataggtgaaacacgagtagccgtgaagatgctctctcattcaactcaaggtgttcggcaatttcagacagaggcaaatattctcacaagagtacaccatagatgctttactccacttattggatattgcaatgaaggcaccagaacagcactcatctatgaatacatgaccaacggagacctagctgagaagctatcaggttgggaacagagatttcaaattgctttggattctgcaataggcttggagtaccttcattatggttgcaagcccccaattattcacagagatgttaagactagaaatattttactcgacaagaatctccgcgccaaaatatctgattttggattgtcaagaatcttttcagatgatggtgacacccatgtatcaacagcaattgcaggcaccccaggataccttgacccagagttgaatgaaaaaagtgacgtgtatagttttgggattgttcttctagagataatcacggggaggacagtcatactaaaaacccaggtgagaactcacataatcaaatgggtaagttccatgctggctgatgatggtgaaattgatggtgttgtggatacaaggttacaaggagaatatgacagtgaggctgcaaggaaagtaatagatgttgcaatggcctgtgttgctccgagttctgttaataggccaacaatgaatcaa

SEQ ID NO: 756 - protein, 792 aa, Glycine max
  Glyma08g21170.1
FISIDCGASNDYLDEETSTFYKTDTDFIETGENLLTSSQFINTNIPDYGRQLRTLRSFPEGNRNCYTLKPEYKQGEQQSYMIRAMFGYGNYDGKNHAPTFDLYLGVNYWKNVNTANRSYIWTEIIHAPTTDTIQVCLVNIDTGTPFISSLELRPLSTSIYQIIARDFVALWRYKLISDWKGRMKREKVRIDNVSYRYKDDIYDRRWYWRDVKDWYKINTTIDVNKSGNDIYKVPAEVLKTAVQSFNRSYDLHYDFEIEWNLQLNKYSGYYVYFHFAEIQQLAPGLRRIINITLNDENILSEPITLEYMKPVTISNKNATQGFVRFSIRATAESDAPPILNAFEVYKLVTDLNSPTDIKDVDAIVNIKRYYGISRIDWQGDPCVPEIFRWSGLDCSYGINPRIISLNLSSSKLGGQIAASVSDLSELQSLDVSDNSLNGFVPESLSQLEYLRILNIGGNKLSGSIPAKLIERSKNGSLILSVDGNQNLCTSTPCHKRNRVVIPLVATLAGAFILLAVSLFVFRRVQDSKKQEFSYSEVQMITNNFERVVGKGGFGTVYYGCIGETRVAVKMLSHSTQGVRQFQTEANILTRVHHRCFTPLIGYCNEGTRTALIYEYMTNGDLAEKLSGWEQRFQIALDSAIGLEYLHYGCKPPIIHRDVKTRNILLDKNLRAKISDFGLSRIFSDDGDTHVSTAIAGTPGYLDPELNEKSDVYSFGIVLLEIITGRTVILKTQVRTHIIKWVSSMLADDGEIDGVVDTRLQGEYDSEAARKVIDVAMACVAPSSVNRPTMNQV

SEQ ID NO: 757 - DNA, 2655 bp, Glycine max
  Glyma07g15270.1
atggcaactttagttcatgcacagcaacaaataggcttcataagcattgattgcgggagtagtccaccaaataatgagtacacagatgacataactaaaataaggtacaccactgatggagcctatatacaaactggggttaataagaatatctcctctgagtatgcatacccaaagaatccgaatctgccactaccactctcagatctcagaagctttcctcagggagaaaggaactgctataggttagtagccggaagaagaggcagtttacatttgataagggcttccttcttgtatggaaactatgatggagtaaacaagccaccagagtttgatctctatgttgatgtcaagttttggtcaacagtcaaatttagaaatgcctcagaagaagttactatggaaataataagtgtggcagaatcaggtgtcacacatgtttgccttgtgaataagggagcaggaactccttttatctcaggattggaacttagaccacttaatagttctatttatagcactgagtttggggaatctgcttcactgtcacttttcaaacgatgggacattgggtcactcaatggaagtggtagatatgaagatgatatttatgatagaatatggtcccccttcaattcctcatcctgggaatctgtcagcacttccacaccaataaatgtcaatgatgatggatttagaccaccatttgaagtcattagaactgctgctagaccaaggaatggcagtgatactttggaattttcttggaccccagatgatccgagttggaaattttatgtctacttgtactttgctgaagtggaacagctggagaaaacccaactgaggaaattcaatatatcttggaatggatctccattgtttgatgattctctagtaccgcgccacttgtttgcaaccactctttccaattcaaaatccttggtagcaaatgaacataggatttctatccacaaaacaaaagattcaacgcttccacccattcttaatgcagttgagattttcgtagcaagacagctagatgcccttgcaacatttgaacaagatgttgatgctattctgtccataaaggaaagctatagaattcaaagaaattgggtgggtgatccatgtgagccaaagaactattcttgggaaggcttaaaatgcaactatagcacctcacttcctccccgaattatatctctgaatatgagctctagcagtttgagtggaataataacttctgccatttccaatctctcctcgttggaatctttggacttacataacaatagcttaactggaacaatgcctcagtttttggaagaattgaaatcccttaaatatttggatttaaaggacaatcaattttcaggttctgttcctaccattcttgtagaaagatcaagggatggattactcacgttgagagtggatgatcaaaatctcggtgactcaggagggaacaataaaaccaaggaaattgtcattcccatagtggtatcagtatcagttttagttatagtggttgctttcattctcttttggaaacttagaagaaatgaacgatcagacgaggagattagtacgctcagcaaaggaggaacaactgtaacaacgaagaactggcaatactcgtattcggaggtcttggacatcaccaacaactttgaaatggcaattggtaagggaggatttggaactgtgtactgtgggaagatgaaagatggcaaacaagttgcagtcaagatgctttctccatcatcatctcaagggccaaaggaatttcagactgaggctgagcttttgatgacagttcatcacaaaaatttggtatccttcgttggttactgtgataatgataacaagatggcactcatatacgagtacatggccaatggcagcgtgaaagattttatcttgctctcagatggaaattcacattgcttgagttggaaaaggagaatacagatagcaatcgatgctgcagaggggttggattatctacaccatggatgcaagccacctattatacacagggatgtaaagtcagccaacattcttttaagtgaagacttagaagccaagatagcagattttggcctctccagggagtttaggacagataaccaagatcaacaatctcaagtgattcacagtgatgctacaaatgaaaaatctgcagtaatgggcacaacagggtaccttgacccagagtactacaagttagggacactgaatgagaaaagtgacatctacagttttggaattgttctactggaattactcacaggtcgccctgcaatattaaaaggcaacggaataatgcacatacttgagtggataagacctgagcttgaaagacaagatttgagtaaaattatagatccaaggctacaaggaaaatttgatgctagttctggctggaaagctttaggaatagcaatggcatgctctacatcaacctccactcagagacctacaatgagtgttgtgatagctgagctgaaacagtgcctgaaattggaatcccctagtgatacttctgaaaaatttgtggcccctccaaaacaagtctacggcgaattttatagttcatctgaagcattttcctatgatagtcaatctatcacctatcctttcccaaga

SEQ ID NO: 758 - protein, 885 aa, Glycine max
  Glyma07g15270.1
MATLVHAQQQIGFISIDCGSSPPNNEYTDDITKIRYTTDGAYIQTGVNKNISSEYAYPKNPNLPLPLSDLRSFPQGERNCYRLVAGRRGSLHLIRASFLYGNYDGVNKPPEFDLYVDVKFWSTVKFRNASEEVTMEIISVAESGVTHVCLVNKGAGTPFISGLELRPLNSSIYSTEFGESASLSLFKRWDIGSLNGSGRYEDDIYDRIWSPFNSSSWESVSTSTPINVNDDGFRPPFEVIRTAARPRNGSDTLEFSWTPDDPSWKFYVYLYFAEVEQLEKTQLRKFNISWNGSPLFDDSLVPRHLFATTLSNSKSLVANEHRISIHKTKDSTLPPILNAVEIFVARQLDALATFEQDVDAILSIKESYRIQRNWVGDPCEPKNYSWEGLKCNYSTSLPPRIISLNMSSSSLSGIITSAISNLSSLESLDLHNNSLTGTMPQFLEELKSLKYLDLKDNQFSGSVPTILVERSRDGLLTLRVDDQNLGDSGGNNKTKEIVIPIVVSVSVLVIVVAFILFWKLRRNERSDEEISTLSKGGTTVTTKNWQYSYSEVLDITNNFEMAIGKGGFGTVYCGKMKDGKQVAVKMLSPSSSQGPKEFQTEAELLMTVHHKNLVSFVGYCDNDNKMALIYEYMANGSVKDFILLSDGNSHCLSWKRRIQIAIDAAEGLDYLHHGCKPPIIHRDVKSANILLSEDLEAKIADFGLSREFRTDNQDQQSQVIHSDATNEKSAVMGTTGYLDPEYYKLGTLNEKSDIYSFGIVLLELLTGRPAILKGNGIMHILEWIRPELERQDLSKIIDPRLQGKFDASSGWKALGIAMACSTSTSTQRPTMSVVIAELKQCLKLESPSDTSEKFVAPPKQVYGEFYSSSEAFSYDSQSITYPFPR

SEQ ID NO: 759 - DNA, 2376 bp, Arabidopsis thaliana
  AT1G61440.1
atggggaagaagaggatcgtgttgctcttatttataagttttagctatgcagagataacaaaagagagtcctttgtctataggacaaactctcagctcctctaatggagtgtatgaactggggttcttcagttttaataactcccaaaatcagtatgttggaatctggttcaagggaatcattccccgggtggttgtttgggtggccaatagagaaaagcctgttacagactctgcagcaaatttagttatcagcagcagtggaagtcttctgttaattaatggcaaacatgacgtcgtgtggtccactggagaaatttctgcatctaagggatctcatgcagagctttccgactatggaaatctaatggtcaaagacaacgttacaggaagaactctatgggaaagctttgagcaccttggtaatactctactccctctctcaactatgatgtataatctcgtcaccggtgagaagcgagggttgagttcttggaaaagttatactgatccatcgcctggtgacttttgggttcagatcacaccgcaagtgccatcacaggggtttgttatgcgaggctcgaccccttattatagaaccggtccatgggctaaaacaaggtataccgggataccacagatggatgaatcatatactagtccattcagcctacatcaggatgtaaatgggtcaggatacttttcgtattttgaaagagactacaaactttcacgtataatgttaacatcagagggatcaatgaaggtgttacggtataatggattggactggaaatcaagctacgagggtccagccaattcatgtgatatttacggcgtatgtgggccttttggtttttgtgttatctcagatcctccaaagtgtaaatgcttcaaaggttttgttcctaaatccattgaggaatggaaaagaggaaactggacaagtggttgtgcgaggcgtaccgaactacattgtcaaggaaactctactggcaaagatgcaaacgtcttccatactgttccaaacataaagcctccagacttttatgaatatgcaaattctgtggatgctgaaggatgctaccaaagttgcctccacaattgttcttgcttggccttcgcttatattcctggaatagggtgcttaatgtggagcaaagacctaatggacacaatgcaattttctgcaggaggagaaattctttccattcgtcttgcacattctgagctagatgtacataagcgcaagatgaccattgttgctagtacagtgagccttaccctctttgtgatcttgggctttgccacgtttggtttttggagaaacagagtaaaacatcacgatgcatggaggaatgatttgcaatcacaagacgtcccaggtttagaattttttgagatgaataccatacaaactgccaccagtaatttcagtctatcaaacaaactcggacatggtggctttggttccgtttacaagggaaaactgcaagatggaagggaaattgcggtaaaacgcctttctagcagctctgagcagggcaaacaggagttcatgaatgaaatagtactgatatcaaaactccaacacagaaacttggtacgggttttgggatgctgtgttgaaggaaaagaaaagctattgatttatgagtttatgaaaaacaaaagccttgatacctttgtttttggttcaagaaaaaggctcgagcttgattggccaaagagatttgatatcattcaaggtattgtgcgtggacttctctatctccaccgtgactcacgcctcagagtaattcacagagacctgaaggttagcaacattcttctggacgagaaaatgaacccgaaaatatcagattttgggttggctcggttgtttcagggaagccaatatcaggacaaaactcgcagggttgtgggaactctaggatatatgtctccagagtatgcatggactggagtattctctgagaaatcagacatctacagcttcggagttcttctgttagaaatcatcagcggagagaagatttcaaggttcagctatggtgaggaaggaaaagcacttcttgcatatgtatgggaatgttggtgtgaaacccgaggagttaatctcttggaccaagctcttgatgattcttctcatccagccgaagttggaaggtgtgtccagattggtttgctctgtgttcaacatcaacctgcagacagaccaaacacacttgagttgttgtctatgcttaccacaacatcagatcttcctctgccaaaacaacccacatttgcagtgcacacaagaaatgacgaaccaccgtctaatgatttgatgatcactgtcaatgagatgacagagtctgtgatcctaggacgt

SEQ ID NO: 760 - protein, 792 aa, Arabidopsis thaliana
  AT1G61440.1
MGKKRIVLLLFISFSYAEITKESPLSIGQTLSSSNGVYELGFFSFNNSQNQYVGIWFKGIIPRVVVWVANREKPVTDSAANLVISSSGSLLLINGKHDVVWSTGEISASKGSHAELSDYGNLMVKDNVTGRTLWESFEHLGNTLLPLSTMMYNLVTGEKRGLSSWKSYTDPSPGDFWVQITPQVPSQGFVMRGSTPYYRTGPWAKTRYTGIPQMDESYTSPFSLHQDVNGSGYFSYFERDYKLSRIMLTSEGSMKVLRYNGLDWKSSYEGPANSCDIYGVCGPFGFCVISDPPKCKCFKGFVPKSIEEWKRGNWTSGCARRTELHCQGNSTGKDANVFHTVPNIKPPDFYEYANSVDAEGCYQSCLHNCSCLAFAYIPGIGCLMWSKDLMDTMQFSAGGEILSIRLAHSELDVHKRKMTIVASTVSLTLFVILGFATFGFWRNRVKHHDAWRNDLQSQDVPGLEFFEMNTIQTATSNFSLSNKLGHGGFGSVYKGKLQDGREIAVKRLSSSSEQGKQEFMNEIVLISKLQHRNLVRVLGCCVEGKEKLLIYEFMKNKSLDTFVFGSRKRLELDWPKRFDIIQGIVRGLLYLHRDSRLRVIHRDLKVSNILLDEKMNPKISDFGLARLFQGSQYQDKTRRVVGTLGYMSPEYAWTGVFSEKSDIYSFGVLLLEIISGEKISRFSYGEEGKALLAYVWECWCETRGVNLLDQALDDSSHPAEVGRCVQIGLLCVQHQPADRPNTLELLSMLTTTSDLPLPKQPTFAVHTRNDEPPSNDLMITVNEMTESVILGR

SEQ ID NO: 761 - DNA, 2490 bp, Arabidopsis thaliana
  AT1G11280.1
atggatctgaaggagaactcttttgaacacatgggaatacacttgggagagattggtattgttctctttccttggtttctgtggttaagtttattcctaagttgtggctatgcagctataactatttcaagtcctttgacattgggacaaactctgagttcccctggtggattttatgagttaggattcttcagtcctaacaactctcagaatcagtatgtagggatctggttcaagaaaattacaccacgggtggttgtgtgggtggctaacagagaaaagccgatcacaacccctgtggcaaatcttactatcagcagaaatggtagtcttattttgctagacagtagtaaaaatgttgtttggtcaaccagaagaccttccatatctaataagtgtcatgcaaagctcttagatacaggaaatcttgtcatagtagatgatgtttcagaaaatcttttgtggcaaagttttgagaatcctggtgatactatgctgccttactcatcgctgatgtacaaccttgccactggggagaagcgagtattatcttcgtggaaaagccacactgatccatcccctggtgatttcgtagttcgactaacaccacaagtgccagcacagatcgttactatgagaggctcatcggtttataagagaagcggtccatgggctaagaccggtttcactggcgtaccactaatggatgaatcatacacaagtcctttcagcctttcccaagatgtaggaaatggaacagggctcttctcttatttacagagaagttctgaacttacacgagttatcataacatcagagggatatctaaagacttttcggtacaatgggacaggctgggttctggactttatcactccagcaaatttatgtgatttgtatggtgcatgtggaccttttgggctgtgtgtgacgtccaatcccacaaagtgtaaatgcatgaaagggtttgtaccaaaatacaaggaggagtggaagcgcgggaacatgacttctggatgtatgcgacgtacagaattatcttgtcaggcaaacttatctacaaagacacaaggaaaaggtgtagacgtcttctatcgtctggccaatgtaaagcctccggatctctacgaatatgcaagctttgtggatgcagatcaatgccaccagggttgtctcagcaattgctcttgctctgcttttgcgtatattactggaattggttgtttgctttggaatcatgagctaatagacacaattagatattccgttggaggagagtttctttccattcgtcttgcaagttcagaactggctggaagcaggaggaccaagattattgttggtagtatcagcctttccatttttgtgattttggcctttggctcatataagtactggagatacagagcaaaacaaaatgttgggccaacttgggcattcttcaacaattcacaagattcatggaaaaatggtttggaaccacaagaaatctcaggtttaacattctttgagatgaataccatacgagctgctaccaataacttcaatgtctcaaacaaactcggtcaaggtggatttggtccagtttataagggaacactgtcagacaagaaggatatagccgttaaacgcctttctagcagctctgggcagggtacagaagagttcatgaacgaaataaaactcatctcaaaattacaacacagaaacttggttcgacttttgggatgctgcattgatggagaagaaaaactactaatttatgagtttctagtgaacaaaagcctcgacacttttctctttgatttgacgctaaagcttcagattgattggcctaagaggttcaacatcattcaaggtgtttcacgtgggcttctctatctccatcgtgactcttgcatgagggtcatacatcgagatctgaaggtcagcaacattctcttggacgacaaaatgaacccaaaaatatcagatttcggattggctcggatgtttcaaggaacccaacatcaagacaacactcgtaaggttgttggaactctaggatacatgtctcctgagtatgcatggacaggaatgttctcagagaagtccgacatatatgcttttggagttctcctgttagaaatcataagtgggaagaagatttcaagcttttgctgtggagaggaaggcaaaacccttcttggacatgcatgggaatgttggctcgagaccggtggagtggatctattggatgaagatattagcagctcgtgttctccagttgaagttgaagtcgctcgatgtgttcagattggtctactctgcatccaacagcaagctgttgacagaccaaacatagcacaagtagtgaccatgatgacaagtgcaacagatcttccgagaccaaaacaaccactctttgcattgcagattcaagatcaagagagtgttgtgtcagtctcaaagtctgtgaatcatgttacacaaactgagatatatgggcga

SEQ ID NO: 762 - protein, 830 aa, Arabidopsis thaliana
  AT1G11280.1
MDLKENSFEHMGIHLGEIGIVLFPWFLWLSLFLSCGYAAITISSPLTLGQTLSSPGGFYELGFFSPNNSQNQYVGIWFKKITPRVVVWVANREKPITTPVANLTISRNGSLILLDSSKNVVWSTRRPSISNKCHAKLLDTGNLVIVDDVSENLLWQSFENPGDTMLPYSSLMYNLATGEKRVLSSWKSHTDPSPGDFVVRLTPQVPAQIVTMRGSSVYKRSGPWAKTGFTGVPLMDESYTSPFSLSQDVGNGTGLFSYLQRSSELTRVIITSEGYLKTFRYNGTGWVLDFITPANLCDLYGACGPFGLCVTSNPTKCKCMKGFVPKYKEEWKRGNMTSGCMRRTELSCQANLSTKTQGKGVDVFYRLANVKPPDLYEYASFVDADQCHQGCLSNCSCSAFAYITGIGCLLWNHELIDTIRYSVGGEFLSIRLASSELAGSRRTKIIVGSISLSIFVILAFGSYKYWRYRAKQNVGPTWAFFNNSQDSWKNGLEPQEISGLTFFEMNTIRAATNNFNVSNKLGQGGFGPVYKGTLSDKKDIAVKRLSSSSGQGTEEFMNEIKLISKLQHRNLVRLLGCCIDGEEKLLIYEFLVNKSLDTFLFDLTLKLQIDWPKRFNIIQGVSRGLLYLHRDSCMRVIHRDLKVSNILLDDKMNPKISDFGLARMFQGTQHQDNTRKVVGTLGYMSPEYAWTGMFSEKSDIYAFGVLLLEIISGKKISSFCCGEEGKTLLGHAWECWLETGGVDLLDEDISSSCSPVEVEVARCVQIGLLCIQQQAVDRPNIAQVVTMMTSATDLPRPKQPLFALQIQDQESVVSVSKSVNHVTQTEIYGR

SEQ ID NO: 763 - DNA, 2463 bp, Arabidopsis thaliana
  AT1G61360.1
atgcgtattgttgcatgcttgctcttgataacagccttattctcaagctatggctatgcagctattaccacgtcaagtcctttgtcgataggggtaactttgagctctcctggtggatcatatgagcttggtttcttcagttctaacaactctgggaatcagtatgttggaatctggttcaagaaagtcactcctcgggttattgtttgggtggctaacagagaaaagccagtctctagtactatggcgaatctcacaatcagcagcaatggaagtcttatcttgcttgatagcaaaaaagatctggtgtggtcatctggaggagatcccacatctaacaagtgtcgtgctgagcttttagacaccggaaatcttgtcgtcgtagataatgttactggaaattatttgtggcaaagttttgagcatcttggtgatacaatgctacctcttacatctctcatgtacgatattcctaacaacaagaaacgtgtgctgacttcttggaagagtgagaccgatccatcgcctggggagtttgtagctgagattacaccacaagtaccctcgcaaggccttataaggaaaggctcgtcaccttattggagaagcggtccatgggcgggaacaaggttcactgggataccagaaatggatgcatcgtatgtgaatccattgggaatggtccaagatgaagtcaacggcacaggagttttcgctttttgtgttctgagaaatttcaatttgtcatacatcaagctaacgccagaaggatcattgaggattacacggaataatggaaccgactggatcaagcactttgagggtccgctaacctcgtgtgatctatatggtagatgtggaccttttggcttgtgtgtgagatccggtactccaatgtgccaatgcttaaaagggttcgaaccaaaatcagatgaggagtggagaagtgggaattggagtcgtggatgtgtgagacgcacaaacttatcttgtcaaggaaactcttctgtagaaacgcagggcaaggacagagacgtattctatcatgtatccaacataaagcctccagattcatacgaattagcaagctttagcaatgaagaacaatgccaccaaggctgtctcaggaactgttcttgcacagccttttcctatgtcagtggaataggatgtttggtgtggaaccaggagctgttggacacagtgaaatttattggcggaggagagactctttcccttcgtcttgcacattctgaattgactggaagaaagcgaatcaagattatcactgttgccactctcagcctttctgtttgcttgattttggtgcttgttgcatgtgggtgctggagatacagagtaaaacaaaatggttcaagtcttgtatccaaagacaatgtagaaggcgcttggaagagtgatttacaatcacaagatgtctcaggtttaaatttctttgagattcatgacctacaaaccgccacgaataatttcagcgtgttaaataaactcggtcagggtggatttggtacggtttataaggggaagcttcaggacggaaaggaaatagctgtaaaacgtcttactagcagctctgtacagggcacagaggagttcatgaacgagataaaactcatctcgaaattacaacacagaaacttgcttcggcttttgggatgctgcatcgatggagaagagaagctattggtctatgaatatatggtgaacaaaagccttgatatctttatatttgatttgaagaaaaagcttgagattgattgggctacgagattcaatatcattcaaggaatcgctcgtggacttctctatctccatcgtgactcattcctcagagttgtacaccgcgatctgaaggtcagcaatattctcttggatgagaaaatgaacccaaaaatatcggattttggattggctcggctgtttcatggaaatcaacatcaagacagcactggtagtgttgtaggcactctaggatacatgtctcccgagtatgcttggactggtacgttctctgaaaaatccgacatttacagcttcggagttctgatgctcgaaatcatcactggcaaggagatttcaagtttcagctatggcaaagataacaaaaaccttctttcatatgcatgggactcgtggagcgaaaacgggggagtgaatctactggaccaagatcttgatgattctgattcagttaattcagttgaagcaggaagatgtgttcatattggtctgctctgtgttcagcatcaagctattgatagaccaaacatcaaacaagttatgtcaatgctgacttcaacaacggatcttcctaagccaacacaaccaatgtttgtattggagacaagtgatgaggattcttctctgtctcactctcaacgctccaatgatctctcctctgttgatgaaaacaaatcttctgaagagctaaatgcttcctca

SEQ ID NO: 764 - protein, 821 aa, Arabidopsis thaliana
  AT1G61360.1
MRIVACLLLITALFSSYGYAAITTSSPLSIGVTLSSPGGSYELGFFSSNNSGNQYVGIWFKKVTPRVIVWVANREKPVSSTMANLTISSNGSLILLDSKKDLVWSSGGDPTSNKCRAELLDTGNLVVVDNVTGNYLWQSFEHLGDTMLPLTSLMYDIPNNKKRVLTSWKSETDPSPGEFVAEITPQVPSQGLIRKGSSPYWRSGPWAGTRFTGIPEMDASYVNPLGMVQDEVNGTGVFAFCVLRNFNLSYIKLTPEGSLRITRNNGTDWIKHFEGPLTSCDLYGRCGPFGLCVRSGTPMCQCLKGFEPKSDEEWRSGNWSRGCVRRTNLSCQGNSSVETQGKDRDVFYHVSNIKPPDSYELASFSNEEQCHQGCLRNCSCTAFSYVSGIGCLVWNQELLDTVKFIGGGETLSLRLAHSELTGRKRIKIITVATLSLSVCLILVLVACGCWRYRVKQNGSSLVSKDNVEGAWKSDLQSQDVSGLNFFEIHDLQTATNNFSVLNKLGQGGFGTVYKGKLQDGKEIAVKRLTSSSVQGTEEFMNEIKLISKLQHRNLLRLLGCCIDGEEKLLVYEYMVNKSLDIFIFDLKKKLEIDWATRFNIIQGIARGLLYLHRDSFLRVVHRDLKVSNILLDEKMNPKISDFGLARLFHGNQHQDSTGSVVGTLGYMSPEYAWTGTFSEKSDIYSFGVLMLEIITGKEISSFSYGKDNKNLLSYAWDSWSENGGVNLLDQDLDDSDSVNSVEAGRCVHIGLLCVQHQAIDRPNIKQVMSMLTSTTDLPKPTQPMFVLETSDEDSSLSHSQRSNDLSSVDENKSSEELNASS

SEQ ID NO: 765 - DNA, 2442 bp, Arabidopsis thaliana
  AT1G61370.1
atgggaaagattggtattgttttctttgcttcgttgctcttcttgctaattatattcccaagttgtgcctttgcagctataaccagagcaagtcctttgtcaataggacaaactctgagctcccctaatggaacttatgagttagggttcttcagtccaaacaactctcggaatcagtatgttgggatctggttcaagaacatcacccctcgggttgttgtctgggtggctaacagagataagccagttacaaacaacgcagcgaatctcactatcaacagcaatgggagccttatcttggttgagagagaacaaaatgttgtttggtcaataggagaaactttctcttctaacgagcttcgtgctgagctattagaaaacggaaatcttgtactcattgatggagtttcagaaagaaacttatgggaaagtttcgagcatcttggtgatactatgttacttgaatcatctgtgatgtatgatgttccgaataacaagaaacgtgttttatcttcttggaaaaatcccaccgatccttcacctggagaattcgtagctgagcttacgacacaagtacctccgcaaggctttataatgagaggatccaggccttactggagaggtggtccatgggcaagggtaaggttcaccggcataccagaaatggatggatcacatgtaagcaaattcgacatttcccaagatgttgcagccggcacaggatctttgacttattcattagaacgaagaaattcgaacctgtcgtacactacgctcacatcagcgggatcgttaaagatcatttggaataatggctctggttgggttactgacttggaggcccctgtaagctcatgtgatgtttataatacatgtggaccttttggcttgtgtataagatctaatcccccaaagtgtgaatgcttgaaaggctttgtaccaaaatcagatgaggagtggaataaaaggaattggactggtggttgtatgagaagaacaaatttatcttgtgatgtgaactcttctgcaacagcacaagccaataatggagacatcttcgacatagttgcaaatgtgaagcctccagacttttatgaatatctaagtttgatcaatgaagaggattgccaacaacgttgtcttggaaactgttcttgcacggcattttcctatattgaacaaattggatgtttggtatggaatcgagagcttgtggatgtaatgcagtttgttgctggaggagaaactctttccattcgtcttgcaagttctgagttagctggaagcaatcgagtgaagattattgttgctagcattgtcagcatttctgttttcatgatcttggtttttgcctcttattggtactggagatacaaagccaaacaaaatgattcaaatcctataccattggagacatcacaagatgcatggagggaacaactgaaaccacaagatgtaaatttctttgatatgcaaaccatattaactatcaccaataactttagcatggaaaataagcttggtcaaggtggattcggtccagtgtataagggaaatctacaagatgggaaagaaatagccataaaacgcctttcgagcacctctggacagggtctagaggagttcatgaatgaaataatactcatctcgaaactccaacacagaaacttggtccgccttttgggatgttgcattgaaggagaagaaaagctattgatttatgagtttatggcgaacaaaagcctcaatacctttatctttgattcgacgaaaaagcttgagcttgattggcccaagcggtttgaaatcattcaaggtattgcttgcggacttctttatcttcaccgcgactcatgtcttagggttgtacaccgagatatgaaggtcagcaacatccttttagacgaggaaatgaacccaaaaatatcagattttggattggctcggatgtttcaaggaacccaacatcaagccaacactcgcagggttgttggaacgctcggatacatgtctccagagtatgcttggacaggcatgttctctgagaaatccgacatctacgcatttggagttctgctattggaaatcataaccggcaagaggatttcaagtttcaccattggagaggaaggcaaaactcttcttgaatttgcatgggattcttggtgcgaaagcggtggatcggatctactggaccaagatatctctagctcgggttctgaatccgaagtagcgagatgtgttcagattggtttgctctgtattcaacaacaagccggggatagacccaacattgcacaagtaatgtcaatgcttacaaccacaatggatcttccgaaaccaaaacaacccgtattcgcaatgcaagtccaagagagtgattcagagtctaagactatgtactctgtcaataatataacacaaactgctatagttggtcga

SEQ ID NO: 766 - protein, 814 aa, Arabidopsis thaliana
  AT1G61370.1
MGKIGIVFFASLLFLLIIFPSCAFAAITRASPLSIGQTLSSPNGTYELGFFSPNNSRNQYVGIWFKNITPRVVVWVANRDKPVTNNAANLTINSNGSLILVEREQNVVWSIGETFSSNELRAELLENGNLVLIDGVSERNLWESFEHLGDTMLLESSVMYDVPNNKKRVLSSWKNPTDPSPGEFVAELTTQVPPQGFIMRGSRPYWRGGPWARVRFTGIPEMDGSHVSKFDISQDVAAGTGSLTYSLERRNSNLSYTTLTSAGSLKIIWNNGSGWVTDLEAPVSSCDVYNTCGPFGLCIRSNPPKCECLKGFVPKSDEEWNKRNWTGGCMRRTNLSCDVNSSATAQANNGDIFDIVANVKPPDFYEYLSLINEEDCQQRCLGNCSCTAFSYIEQIGCLVWNRELVDVMQFVAGGETLSIRLASSELAGSNRVKIIVASIVSISVFMILVFASYWYWRYKAKQNDSNPIPLETSQDAWREQLKPQDVNFFDMQTILTITNNFSMENKLGQGGFGPVYKGNLQDGKEIAIKRLSSTSGQGLEEFMNEIILISKLQHRNLVRLLGCCIEGEEKLLIYEFMANKSLNTFIFDSTKKLELDWPKRFEIIQGIACGLLYLHRDSCLRVVHRDMKVSNILLDEEMNPKISDFGLARMFQGTQHQANTRRVVGTLGYMSPEYAWTGMFSEKSDIYAFGVLLLEIITGKRISSFTIGEEGKTLLEFAWDSWCESGGSDLLDQDISSSGSESEVARCVQIGLLCIQQQAGDRPNIAQVMSMLTTTMDLPKPKQPVFAMQVQESDSESKTMYSVNNITQTAIVGR

SEQ ID NO: 767 - DNA, 2415 bp, Arabidopsis thaliana
  AT1G61380.1
atgggtatggttttatttgcttgcttgcttttactaatcatattcccaacttgtggctatgcagctataaacacatcaagtcctttgtcaataagacaaactctgagttctcctggtggattttatgagttaggcttcttcagtcctaataatactcagaatcagtatgtcgggatctggttcaagaagattgttcctcgtgtagttgtgtgggtggctaacagagatacgccagttactagctctgcagcaaatctcactatcagcagcaatgggagcctgatcttgcttgatgggaaacaagatgttatttggtcaacaggaaaagctttcacatccaacaaatgtcatgcggagctcttagataccggaaattttgttgtaattgatgatgtttcagggaataaattatggcaaagcttcgagcatcttggtaatactatgctgcctcagtcatcattgatgtatgatacttctaatggcaagaagcgtgtgttgactacatggaaaagtaacagcgatccttcgcctggggagttctcactggagattacaccacaaatccccacacaaggccttataagaagaggctcagtaccttactggagatgtggtccttgggcaaaaacaagattctctgggatatctggaattgatgcatcatatgtaagtccattcagcgttgtccaggatacagcagccggcacaggatctttctcttattccacattaagaaactataatctctcatatgttacgctaacaccagaagggaaaatgaagatcctctgggatgatggaaataattggaagcttcacttgtctctcccagagaacccatgtgatctatatggtagatgcgggccttatggtttgtgtgtgagatctgatcccccaaagtgtgaatgcttgaaagggtttgtaccaaagtctgatgaggagtggggaaaaggaaactggacaagtgggtgtgtgagacgtacaaaattatcttgccaagcaaaatcttctatgaaaacacaaggcaaagacacagacatcttctatcgtatgacagatgtaaagactccggatctgcaccaatttgcaagctttctcaatgccgaacagtgctatcaaggttgtctaggcaactgttcttgcacagccttcgcctatattagtggaattggatgtttggtatggaatggggagctagcagacaccgttcaatttttgtctagcggagagtttctcttcattcgtcttgcaagttcagaattggctggaagcagtcgaaggaagattatcgtaggcactactgtcagcctttccattttcttgatcttggtatttgctgcaattatgttgtggagatacagagcgaaacaaaatgatgcatggaagaatggttttgaacgacaagatgtctccggcgtcaatttctttgagatgcatacaatacgaactgccaccaataacttcagtccttcaaataaacttggtcaaggtggatttggtccagtttacaagggaaagttggtagatgggaaggaaataggtgttaaacgccttgctagtagttccggtcagggtacagaggagttcatgaatgaaataacactgatctcaaaattgcaacacagaaacttggttcggcttttgggatactgcatcgacggagaagagaagctactgatctatgagttcatggtgaacaaaagtctcgatatttttatatttgatccatgtctaaagtttgagcttgattggccaaagagatttaatatcattcaaggtattgcgcgtggacttctctatctccaccgtgactcacgcctcagagttattcaccgagacctgaaggtcagcaatattcttctggacgacagaatgaatccaaaaatatcagattttggattggctcggatgttccagggaacccaatatcaagacaacactcgcagagttgtaggaactctaggatatatgtctcccgagtatgcatgggcaggattgttctctgagaagtctgatatctatagcttcggagttctgatgttagaaatcatcagcggaaagagaatttcacggttcatctatggtgatgaaagcaaaggccttcttgcttatacatgggattcttggtgcgagaccgggggatcaaatctacttgacagagatcttactgatacatgccaagcattcgaagttgcgagatgtgttcagattggtctgctctgtgttcaacacgaagccgtcgacagacccaacactcttcaagtactatccatgcttacttcagcaacagatcttccagtaccaaaacagccaatatttgcagtgcatactctaaacgatatgccaatgttacaggctaattctcaagatttcttatctgtaaatgagatgacagaatctatgatccaaggaagg

SEQ ID NO: 768 - protein, 805 aa, Arabidopsis thaliana
  AT1G61380.1
MGMVLFACLLLLIIFPTCGYAAINTSSPLSIRQTLSSPGGFYELGFFSPNNTQNQYVGIWFKKIVPRVVVWVANRDTPVTSSAANLTISSNGSLILLDGKQDVIWSTGKAFTSNKCHAELLDTGNFVVIDDVSGNKLWQSFEHLGNTMLPQSSLMYDTSNGKKRVLTTWKSNSDPSPGEFSLEITPQIPTQGLIRRGSVPYWRCGPWAKTRFSGISGIDASYVSPFSVVQDTAAGTGSFSYSTLRNYNLSYVTLTPEGKMKILWDDGNNWKLHLSLPENPCDLYGRCGPYGLCVRSDPPKCECLKGFVPKSDEEWGKGNWTSGCVRRTKLSCQAKSSMKTQGKDTDIFYRMTDVKTPDLHQFASFLNAEQCYQGCLGNCSCTAFAYISGIGCLVWNGELADTVQFLSSGEFLFIRLASSELAGSSRRKIIVGTTVSLSIFLILVFAAIMLWRYRAKQNDAWKNGFERQDVSGVNFFEMHTIRTATNNFSPSNKLGQGGFGPVYKGKLVDGKEIGVKRLASSSGQGTEEFMNEITLISKLQHRNLVRLLGYCIDGEEKLLIYEFMVNKSLDIFIFDPCLKFELDWPKRFNIIQGIARGLLYLHRDSRLRVIHRDLKVSNILLDDRMNPKISDFGLARMFQGTQYQDNTRRVVGTLGYMSPEYAWAGLFSEKSDIYSFGVLMLEIISGKRISRFIYGDESKGLLAYTWDSWCETGGSNLLDRDLTDTCQAFEVARCVQIGLLCVQHEAVDRPNTLQVLSMLTSATDLPVPKQPIFAVHTLNDMPMLQANSQDFLSVNEMTESMIQGR

SEQ ID NO: 769 - DNA, 2493 bp, Arabidopsis thaliana
  AT1G61390.1
atgtacaaacttccacaaagaaattgtgcagacaaacaggagtacactgtacacatgagaaagatgggtatggttatatttgcttgcttgctcttgctgattatatttccaacttttggctatgcagatataaacacatcaagtcctttgtcaataggacaaactctgagttcccctgatggagtttatgagctaggcttcttcagtcctaataattctcggaaacagtatgttgggatctggttcaagaacatcgctcctcaagtggttgtctgggtggctaacagagataagccagtcacaaaaactgcggcgaatctaactattagcagcaatgggagtctgatcttgcttgatggtacgcaagatgttatttggtcaacaggagaggctttcacatccaacaagtgtcatgctgagcttttagacaccggaaatcttgttgtaattgatgatgtttccggaaaaactttatggaaaagcttcgagaatcttggtaatactatgctgcctcagtcttctgtgatgtatgatattccccgtggaaagaatcgtgtgttgacctcatggagaagtaacagcgatccatcgcctggggaattcacactggagtttacgccacaagtccccccacaaggccttataaggagaggctcatcgccctactggagaagtggtccatgggcaaaaacaagattctctggtatacctggaattgatgcatcatatgtaagtccattcactgttctccaagatgtagcaaagggcacagcatccttttcttattccatgttaagaaactataaactgtcgtatgtaacgctaacatcagaggggaaaatgaagatcctctggaatgatggaaaaagttggaagcttcactttgaggctccaacaagctcatgtgatctatatcgtgcttgtggtccttttggtttgtgtgtgagatccagaaatccaaagtgcatatgcttgaaagggtttgtaccaaagtcagatgacgagtggaaaaaagggaattggacaagtgggtgtgtgagacgtacacaattatcttgccatacgaattcttctacaaaaacacaaggcaaagaaacagacagcttctaccatatgacccgtgttaagactccagatctgtaccaacttgcaggcttcctcaatgcagaacagtgctaccaagattgcctaggcaactgttcctgcacagcttttgcttatattagtggaattggatgcttggtatggaaccgggagctggtagacacagttcaatttttatctgatggggaatctctctcccttcggcttgcaagttcagaattggctggtagcaatcgaacaaagattattctaggtactactgtcagcctatctattttcgtaatcttggtctttgccgcttataagtcctggagatacagaacaaaacaaaatgaaccaaatcctatgttcatccacagttcacaagatgcatgggcgaaggatatggaaccacaagatgtctcaggcgtaaatttatttgatatgcatactatacgtactgccaccaataacttcagttcctcaaataaacttgggcaaggtggatttggtccagtgtataagggaaagttggtagatggaaaggaaatagccgttaaacgcctttctagcagctctggacagggtacagatgagttcatgaatgaaataagactaatctccaaactgcaacataaaaacttggttcggcttttgggatgctgcatcaaaggagaagagaaactgttgatttatgagtatctggtgaacaaaagcctcgacgtgttcctctttgattcaactctgaagtttgagattgattggcaaaagaggttcaacatcattcaaggtgttgcacgtggacttctctatctccaccgtgactcacgcctcagggtaattcaccgagacctgaaggtcagcaacattcttctggacgagaaaatgatcccgaaaatatcagatttcggattggctcggatgtctcagggaacgcaataccaggacaacactcgcagggtcgtaggaactctaggatatatggctcctgagtatgcatggactggggtattctctgagaaatcagacatctacagctttggagttctactgttagaaatcatcattggagagaagatctcaagattcagcgaagagggaaaaactcttcttgcatatgcatgggaatcttggtgtgaaaccaaaggagttgatcttcttgatcaagctcttgcggattcttctcatccagctgaagttggaaggtgtgtccagattggtctactctgtgttcaacatcaacctgcagacagaccaaacacacttgagttgatgtcaatgctcaccacaatatcagaacttccatcaccaaaacaacctacgtttacagtgcactctagagatgacgactctacatctaatgatttgatcaccgtcaatgagattacacaatctgtgattcaagggcgt

SEQ ID NO: 770 - protein, 831 aa, Arabidopsis thaliana
  AT1G61390.1
MYKLPQRNCADKQEYTVHMRKMGMVIFACLLLLIIFPTFGYADINTSSPLSIGQTLSSPDGVYELGFFSPNNSRKQYVGIWFKNIAPQVVVWVANRDKPVTKTAANLTISSNGSLILLDGTQDVIWSTGEAFTSNKCHAELLDTGNLVVIDDVSGKTLWKSFENLGNTMLPQSSVMYDIPRGKNRVLTSWRSNSDPSPGEFTLEFTPQVPPQGLIRRGSSPYWRSGPWAKTRFSGIPGIDASYVSPFTVLQDVAKGTASFSYSMLRNYKLSYVTLTSEGKMKILWNDGKSWKLHFEAPTSSCDLYRACGPFGLCVRSRNPKCICLKGFVPKSDDEWKKGNWTSGCVRRTQLSCHTNSSTKTQGKETDSFYHMTRVKTPDLYQLAGFLNAEQCYQDCLGNCSCTAFAYISGIGCLVWNRELVDTVQFLSDGESLSLRLASSELAGSNRTKIILGTTVSLSIFVILVFAAYKSWRYRTKQNEPNPMFIHSSQDAWAKDMEPQDVSGVNLFDMHTIRTATNNFSSSNKLGQGGFGPVYKGKLVDGKEIAVKRLSSSSGQGTDEFMNEIRLISKLQHKNLVRLLGCCIKGEEKLLIYEYLVNKSLDVFLFDSTLKFEIDWQKRFNIIQGVARGLLYLHRDSRLRVIHRDLKVSNILLDEKMIPKISDFGLARMSQGTQYQDNTRRVVGTLGYMAPEYAWTGVFSEKSDIYSFGVLLLEIIIGEKISRFSEEGKTLLAYAWESWCETKGVDLLDQALADSSHPAEVGRCVQIGLLCVQHQPADRPNTLELMSMLTTISELPSPKQPTFTVHSRDDDSTSNDLITVNEITQSVIQGR

SEQ ID NO: 771 - DNA, 2457 bp, Arabidopsis thaliana
  AT1G61400.1
atggatttcttgttcttgttattggagagaaaaaataaacacatggggaagaagagggtcgtgttgctttggcttagcatctttataagttttagctctgcagagataacggaagagagccctttgtcaataggacaaactctcagctcctccaatggagtttatgaactgggcttcttcagttttaataactcccaaaatcagtatgtcggaatctccttcaagggtatcattccccgggtggttgtgtgggtggcaaatagagaaaagcctgttacagactctgcggcaaatctggttatcagcagcaacggaagtcttcagttatttaatggcaaacatggtgttgtgtggtccagtggaaaagctcttgcatctaacgggtctcgtgtagagcttttagacagtggaaatctagttgtcatagaaaaagtttcgggaagaactctatgggaaagttttgagcatcttggtgatactctgctccctcactcaactatcatgtataatgtccacaccggtgagaagcgagggttgacttcttggaaaagttacactgatccatcgcctggtgactttgtcgttctgattacaccgcaagtgccatcacaggggtttcttatgagaggctcgaccccttattttagatctggtccatgggctaaaacaaagttcaccgggttacctcaaatggatgaatcatacacaagtccattcagcttaacacaggatgtaaatgggtcaggatactattcgtattttgatagagacaacaaacgttcacgtattaggttaacaccagatggatcaatgaaggcgttacggtataatggaatggactgggacacaacctacgagggtcctgccaattcatgtgatatttatggcgtatgtggaccttttggtttttgtgttatctcagttcctccaaagtgtaaatgcttcaaaggttttattcctaaatccattgaggagtggaaaacaggaaactggactagtggttgtgtgaggcgtagcgaactacattgtcaaggaaactctactggcaaagatgcaaatgtcttccatactgttcccaacataaagcctccagacttttacgaatacgcagattctgtggatgcggaagaatgccaacaaaattgcctcaacaattgttcttgcttggccttcgcttatattcctggaatagggtgcttaatgtggagcaaggacctaatggacacagttcaatttgctgcaggaggagaacttctttccattcgtcttgcacgttctgagctagacgtaaataagcgcaagaagaccatcattgctattacagtgagccttaccctttttgtgatcttgggctttactgcgtttggtttctggagacgcagagtggaacaaaatgctcttatatcagaagatgcatggaggaatgatctgcaaacacaagacgtcccaggtctagaatattttgagatgaataccatacaaactgccaccaataatttcagtctatcaaacaaactcggtcatggtggatttggttcaggaaaactgcaagatggaagggaaattgcggtaaaacgcctttctagcagctctgagcagggcaaacaggagttcatgaatgaaatagtactgatatcaaaactccaacacagaaacttagtccgggttttgggatgctgcgtcgaaggaacagagaagctattgatttatgagtttatgaaaaacaaaagccttgatacttttgtctttgtttttacacggtgtttttgcttagattcaaaaaaaaggcttgagatagattggccaaagagatttgatatcattcaaggtattgcacgtggacttctctatctccatcgtgactcacgcctcagaataattcaccgagacctgaaggtcagcaacattcttctggacgagaaaatgaacccgaaaatatcagattttgggttggctcggatgtttcatggaaccgaatatcaggataaaactcgcagggttgtcggaactctaggttatatgtctcctgagtatgcatgggctggagtattctctgagaaatcagacatctacagcttcggagttctactgctagaaatcatcagcggagagaagatctcgaggttcagctatggcgaagaaggaaaaacacttcttgcatatgcatgggaatgttggtgtggagcccgaggagttaatcttttggaccaagctcttggtgattcttgtcacccatatgaagttggaaggtgtgtccagattggtttgctttgtgttcaataccagcctgcagacagaccaaacacacttgagttgctttctatgcttaccacaacatcagatcttcctctgccaaaacaacctacatttgtagtgcacacgagagatggcaaatctccgtcaaatgattcgatgatcactgtcaatgagatgacagagtctgtgatccatggacgt

SEQ ID NO: 772 - protein, 819 aa, Arabidopsis thaliana
  AT1G61400.1
MDFLFLLLERKNKHMGKKRVVLLWLSIFISFSSAEITEESPLSIGQTLSSSNGVYELGFFSFNNSQNQYVGISFKGIIPRVVVWVANREKPVTDSAANLVISSNGSLQLFNGKHGVVWSSGKALASNGSRVELLDSGNLVVIEKVSGRTLWESFEHLGDTLLPHSTIMYNVHTGEKRGLTSWKSYTDPSPGDFVVLITPQVPSQGFLMRGSTPYFRSGPWAKTKFTGLPQMDESYTSPFSLTQDVNGSGYYSYFDRDNKRSRIRLTPDGSMKALRYNGMDWDTTYEGPANSCDIYGVCGPFGFCVISVPPKCKCFKGFIPKSIEEWKTGNWTSGCVRRSELHCQGNSTGKDANVFHTVPNIKPPDFYEYADSVDAEECQQNCLNNCSCLAFAYIPGIGCLMWSKDLMDTVQFAAGGELLSIRLARSELDVNKRKKTIIAITVSLTLFVILGFTAFGFWRRRVEQNALISEDAWRNDLQTQDVPGLEYFEMNTIQTATNNFSLSNKLGHGGFGSGKLQDGREIAVKRLSSSSEQGKQEFMNEIVLISKLQHRNLVRVLGCCVEGTEKLLIYEFMKNKSLDTFVFVFTRCFCLDSKKRLEIDWPKRFDIIQGIARGLLYLHRDSRLRIIHRDLKVSNILLDEKMNPKISDFGLARMFHGTEYQDKTRRVVGTLGYMSPEYAWAGVFSEKSDIYSFGVLLLEIISGEKISRFSYGEEGKTLLAYAWECWCGARGVNLLDQALGDSCHPYEVGRCVQIGLLCVQYQPADRPNTLELLSMLTTTSDLPLPKQPTFVVHTRDGKSPSNDSMITVNEMTESVIHGR

SEQ ID NO: 773 - DNA, 2418 bp, Arabidopsis thaliana
  AT1G61430.1
atggggaagaagaggatagtgttctttgcttatttgcccttttttaccatctttatgagttttagctttgcagggataaccaaagagagtcccttttcaattggacaaactctcagctcctctaatggtgtttatgaattgggattcttcagtcttaataactcccaaaatcagtatctcggaatttggttcaagagtatcattccccaggtggttgtgtgggtggctaatagagaaaagcctgttacagactctgcggcaaatctcggtatcagcagcaatggtagtcttctgttatctaatggcaaacatggcgttgtgtggtctaccggagatatttttgcatctaatgggtctcgtgcagagcttacagaccatggaaatcttgttttcatagacaaagtttcgggaaggactctatggcaaagctttgagcatcttggtaatactctgctccctacgtcaattatgatgtataatctcgtcgctggtgagaagcgaggattgactgcttggaaaagttacaccgatccatcgcctggcgaatttgtggctctgattacaccgcaagtgccatcacaggggattattatgagaggctcgacacgttattatagaaccggtccatgggctaaaacaaggttcactggatcaccacaaatggatgaatcatacacaagtccattcatcttaacacaggatgtaaatgggtcaggatacttttcatttgttgaaagaggcaaaccttcacgcatgattttaacatcagagggaacaatgaaggtcttagtgcataatggaatggactgggaatcaacctacgagggtccagccaattcatgtgatatatatggcgtatgtggaccttttgggctttgtgttgtatcaattcctccaaaatgtaaatgcttcaaaggttttgttcctaaattcgctaaggagtggaagaaaggaaactggactagtggttgtgtgaggcgtaccgaactacattgtcaaggaaactccagtggcaaagatgcaaatgtcttctatactgttcccaacataaagcctccagacttttacgagtatgcaaattctcagaatgctgaagaatgccaccaaaattgcctccacaattgttcttgcttggcgttttcttatattcctggaatagggtgcttaatgtggagcaaggatctaatggacacaaggcaattttctgcagcaggagaacttctttccattcgtcttgcacgttctgagctagatgtaaataagcgcaagatgaccattgttgctagtacagtgagcctgaccctattcgtgatctttggatttgctgcatttggtttctggagatgcagagtggaacataatgctcatatatcaaacgatgcatggaggaattttctgcaatcacaagacgtcccaggtttagaattttttgagatgaatgccatacaaactgccaccaataatttcagtctatcaaacaaactcggtcctggtggatttggttctgtttacaaggcgagaaacggaaaactgcaagatggaagagaaattgcggtaaaacgtctttctagcagctctgggcagggcaaacaggagttcatgaatgaaatagtactgatatcaaaactccaacacagaaacttagtccgggttttgggatgctgcgtcgaaggaacagagaagctattgatttatgggttcttgaaaaacaaaagcctggatacttttgtctttgatgcaagaaaaaagctcgaacttgattggccaaagagatttgagatcattgaaggtattgcacgtggacttctctatctccaccgtgactcacgcctcagagtaattcaccgagacctgaaggtcagcaacattcttctggatgagaaaatgaacccgaaaatatcagattttggtttggctcggatgtttcagggaacccaatatcaggaaaaaactcgcagggttgtcggaactctaggatatatgtctcctgagtatgcatggactggcgtattctctgagaaatccgatatctacagtttcggagttctgttgttagaaatcatcagcggaaagaagatctcaagtttcagctatggcgaggagggaaaagcacttcttgcatatgcatgggaatgttggtgtgaaacccgagaagttaattttttggaccaagctcttgctgattctagtcacccatctgaagttggaaggtgtgtacagattggtttgctctgtgttcaacacgagcctgcagacagaccaaacacacttgagttgctgtctatgcttaccacaacatcagatcttcctctgcccaaaaaacccacatttgtagtgcacactagaaaagacgaatcaccgtcaaatgattcgatgatcactgtcaatgagatgacagagtctgtgatccaaggacgt

SEQ ID NO: 774 - protein, 806 aa, Arabidopsis thaliana
  AT1G61430.1
MGKKRIVFFAYLPFFTIFMSFSFAGITKESPFSIGQTLSSSNGVYELGFFSLNNSQNQYLGIWFKSIIPQVVVWVANREKPVTDSAANLGISSNGSLLLSNGKHGVVWSTGDIFASNGSRAELTDHGNLVFIDKVSGRTLWQSFEHLGNTLLPTSIMMYNLVAGEKRGLTAWKSYTDPSPGEFVALITPQVPSQGIIMRGSTRYYRTGPWAKTRFTGSPQMDESYTSPFILTQDVNGSGYFSFVERGKPSRMILTSEGTMKVLVHNGMDWESTYEGPANSCDIYGVCGPFGLCVVSIPPKCKCFKGFVPKFAKEWKKGNWTSGCVRRTELHCQGNSSGKDANVFYTVPNIKPPDFYEYANSQNAEECHQNCLHNCSCLAFSYIPGIGCLMWSKDLMDTRQFSAAGELLSIRLARSELDVNKRKMTIVASTVSLTLFVIFGFAAFGFWRCRVEHNAHISNDAWRNFLQSQDVPGLEFFEMNAIQTATNNFSLSNKLGPGGFGSVYKARNGKLQDGREIAVKRLSSSSGQGKQEFMNEIVLISKLQHRNLVRVLGCCVEGTEKLLIYGFLKNKSLDTFVFDARKKLELDWPKRFEIIEGIARGLLYLHRDSRLRVIHRDLKVSNILLDEKMNPKISDFGLARMFQGTQYQEKTRRVVGTLGYMSPEYAWTGVFSEKSDIYSFGVLLLEIISGKKISSFSYGEEGKALLAYAWECWCETREVNFLDQALADSSHPSEVGRCVQIGLLCVQHEPADRPNTLELLSMLTTTSDLPLPKKPTFVVHTRKDESPSNDSMITVNEMTESVIQGR

SEQ ID NO: 775 - DNA, 2412 bp, Arabidopsis thaliana
  AT1G61490.1
atggggaagaagaggattgtgttctttgcttgtttgctcttgtttaccgtcctattacgttttagctatgcagggataacgacagaaagtcctttgtcagtcgaacaaacactcagctcctctaatggaatttatgaattggggtttttcagtcctaataactcccaaaatctgtatgtgggaatctggttcaagggtatcattccccgggtggttgtgtgggtggcaaatagagaaacacctactacagacacatcggcaaatcttgctatcagcagcaatggtagtcttctattgtttaatggcaaacatggtgttgtgtggtccatcggagaaaattttgcatctaatgggtctcgtgcagagcttacagacaacggaaatctagttgtcatagacaatgcttcgggaagaactttatgggaaagctttgagcactttggtgacactatgctacctttctcaagcctgatgtataatctcgccacaggtgagaagcgggtgttgacttcttggaaaactgacactgatccatcgcctggcgtatttgtgggtcagattacaccacaagtgccatcacaggtgcttattatgagaggctcgacgcgttattatagaaccggtccatgggctaaaacaaggttcacagggataccactaatggatgacacatatgcaagtccattcagccttcagcaggatgctaacgggtcaggattctttacttattttgatagaagtttcaaactttcacgtataattatatcatcagaaggatcaatgaaaaggtttcggcataatggaacggactgggaattaagctacatggctccagccaattcatgcgatatttacggtgtatgtggaccatttgggttgtgtattgtgtcagtacctttaaagtgcaaatgcttgaaaggatttgttcctcattccactgaggaatggaaaagaggaaactggactggtggttgtgcgaggcttacggaactacattgtcaaggaaactctactggcaaagatgtaaatatcttccatcctgttaccaacgtaaagcttccagacttttacgaatatgaaagttctgtggatgctgaagaatgccaccaaagttgcctccacaattgttcttgcttggcctttgcttatatccatggaatagggtgcttaatctggaaccagaacctaatggacgctgtgcaattttctgctggaggagaaattctgtccattcgtcttgcacactctgaactaggtggaaataagcgcaacaaaatcattgttgctagtactgtgagcctttctctgtttgtgatattgacttctgctgcatttggtttctggagatacagagtgaaacataaagcctatacgttaaaggatgcctggaggaatgatctgaaatcaaaggaggtcccaggtttagaattttttgagatgaataccatacaaactgccaccaataatttcagtctatcaaacaaactcggacaaggtggatttggttctgtttacaagggaaagttacaagatgggaaagaaattgctgtaaaacagctttctagcagctccggacagggaaaagaggagttcatgaatgaaatagtactgatatcaaaactccaacacagaaacttagtccgggttttgggatgttgcatcgaaggagaagagaaactactgatctatgagtttatgttgaacaaaagccttgatacttttgtctttgatgcaagaaaaaagctcgaggttgattggccaaagagatttgatatcgttcaaggtattgcacgtggacttctttatcttcaccgtgactcacgcctcaaggtaattcaccgagacctgaaggtcagcaacattcttctggatgagaaaatgaacccgaaaatatcagattttggattggctcggatgtatgagggaacccaatgtcaggacaaaactcgcagggttgtaggaactctaggatatatgtctcctgagtatgcatggaccggagtattctctgagaaatcagacatttacagcttcggagttctactgctagaaattatcatcggagagaagatctcaaggttcagctatggcgaagaaggaaaaacacttctcgcatatgcatgggaatcttggggtgaaaccaaaggaattgatcttttggaccaagatcttgctgattcatgtcgtccgttagaagttggaaggtgtgttcagattggtctgctctgtgtacaacaccaacctgcagacagaccaaacacacttgagttgctggctatgctcacgacaacatcagatcttccatcaccaaaacaacccacatttgtagtgcactctagggatgatgaatcatctctgtctaaggatttgtttaccgtcaatgagatgacacaatctatgatccttgggcgt

SEQ ID NO: 776 - protein, 804 aa, Arabidopsis thaliana
  AT1G61490.1
MGKKRIVFFACLLLFTVLLRFSYAGITTESPLSVEQTLSSSNGIYELGFFSPNNSQNLYVGIWFKGIIPRVVVWVANRETPTTDTSANLAISSNGSLLLFNGKHGVVWSIGENFASNGSRAELTDNGNLVVIDNASGRTLWESFEHFGDTMLPFSSLMYNLATGEKRVLTSWKTDTDPSPGVFVGQITPQVPSQVLIMRGSTRYYRTGPWAKTRFTGIPLMDDTYASPFSLQQDANGSGFFTYFDRSFKLSRIIISSEGSMKRFRHNGTDWELSYMAPANSCDIYGVCGPFGLCIVSVPLKCKCLKGFVPHSTEEWKRGNWTGGCARLTELHCQGNSTGKDVNIFHPVTNVKLPDFYEYESSVDAEECHQSCLHNCSCLAFAYIHGIGCLIWNQNLMDAVQFSAGGEILSIRLAHSELGGNKRNKIIVASTVSLSLFVILTSAAFGFWRYRVKHKAYTLKDAWRNDLKSKEVPGLEFFEMNTIQTATNNFSLSNKLGQGGFGSVYKGKLQDGKEIAVKQLSSSSGQGKEEFMNEIVLISKLQHRNLVRVLGCCIEGEEKLLIYEFMLNKSLDTFVFDARKKLEVDWPKRFDIVQGIARGLLYLHRDSRLKVIHRDLKVSNILLDEKMNPKISDFGLARMYEGTQCQDKTRRVVGTLGYMSPEYAWTGVFSEKSDIYSFGVLLLEIIIGEKISRFSYGEEGKTLLAYAWESWGETKGIDLLDQDLADSCRPLEVGRCVQIGLLCVQHQPADRPNTLELLAMLTTTSDLPSPKQPTFVVHSRDDESSLSKDLFTVNEMTQSMILGR

SEQ ID NO: 777 - DNA, 2412 bp, Arabidopsis thaliana
  AT1G61500.1
atgatgacgaggtttgcttgtttgcacctctttaccatgttcttgtttaccttgctctcaggttcaagttctgcagttataacgacagaaagtcctttgtcaatgggacaaactctcagctccgctaatgaggtttatgaattggggttcttcagtcctaataacacccaagatcagtatgttggaatctggttcaaggataccattccccgggttgttgtgtgggtggccaatagagagaagcctgttacagactctacggcatatctagctataagcagcagtggaagtcttctgttacttaatggcaaacatggcactgtgtggtctagtggagtaactttttcctctagcgggtgtcgtgcagagctttcagatagcggaaatcttaaggtcatagataatgtttcggaaagagctctgtggcaaagctttgatcatcttggggatacactgctacatacctcatccctgacgtataacctcgccaccgctgagaagcgggtgttgacttcttggaaaagttacaccgatccatcacctggcgactttttgggccagattacacctcaagtgccatcacaggggttcgttatgagagggtcaacgccttactggagaagcggtccatgggctaaaacaaggttcactgggataccgtttatggatgaatcatacacaggtccattcacccttcaccaggatgtaaacgggtcaggatacttgacttattttcaaagagactacaaactttcacgtataactttaacatcagagggatcaataaagatgtttcgggataatggaatgggctgggaattgtactatgaggctccaaaaaaattatgcgatttttatggtgcgtgtggaccatttgggttgtgtgttatgtcaccttctcccatgtgtaaatgcttcagaggttttgtaccaaaatctgttgaggagtggaaaaggggaaactggactggtggttgtgtgaggcataccgaactagattgtctaggaaactctactggcgaagatgcagatgacttccatcaaattgccaacataaagcctccagacttttatgaatttgcaagttctgtgaatgctgaagaatgccaccaacgttgcgtccacaattgttcttgcttggcatttgcttatattaagggaatagggtgcctagtgtggaaccaggacctaatggatgccgtacaattttctgcaacaggagaacttctttccattcgtcttgcacgatctgagctagatggaaataagcgcaagaagactattgttgctagtatagtgagcctgactctattcatgatcttgggcttcactgcgtttggtgtctggagatgcagagtggaacatatcgctcatatatcaaaggatgcatggaagaatgatctgaaaccacaagatgtcccaggtttagatttctttgatatgcataccattcaaaacgccaccaataattttagtctatcaaacaaactcggacaaggtggatttggttcagtttacaagggaaagctgcaagatgggaaagaaattgctgttaaacggctttctagcagctctggacagggaaaagaggagtttatgaatgaaatagtactcatctcaaaactccaacacagaaacttagtcagggttttgggatgttgcatcgaagaagaagagaagctattgatttatgagtttatggtgaacaaaagccttgatacctttctctttgattcaagaaaaaggctggagattgattggccaaaaagatttgatatcattcaaggtattgcacgtggacttctctatctccaccatgactcacgcctcagagttattcaccgagacctgaaggtcagcaacatccttctggatgagaaaatgaacccaaaaatatcagattttggattggctcggatgtatcaggggaccgaatatcaggataacactcgcagggttgtaggaactctaggatatatgtctccagagtatgcatggactgggatgttctctgagaaatctgacatctacagcttcggagttctaatgttagaaatcatcagtggagagaagatctcaagattcagctatggcgtagaaggaaaaacccttattgcatatgcgtgggaatcttggtctgaatacagaggaattgatcttttggaccaagatcttgctgattcatgtcacccattagaagttgggagatgtattcaaatcggcttgctctgtgtacaacaccaacctgcagacagacccaacacacttgagttgctggctatgctcaccacaacatcagatcttccatcaccaaaacaacccacatttgcatttcacacgagagatgacgaatcactgtctaacgatttgatcaccgtcaatgggatgacgcaatctgtgatccttgggcgt

SEQ ID NO: 778 - protein, 804 aa, Arabidopsis thaliana
  AT1G61500.1
MMTRFACLHLFTMFLFTLLSGSSSAVITTESPLSMGQTLSSANEVYELGFFSPNNTQDQYVGIWFKDTIPRVVVWVANREKPVTDSTAYLAISSSGSLLLLNGKHGTVWSSGVTFSSSGCRAELSDSGNLKVIDNVSERALWQSFDHLGDTLLHTSSLTYNLATAEKRVLTSWKSYTDPSPGDFLGQITPQVPSQGFVMRGSTPYWRSGPWAKTRFTGIPFMDESYTGPFTLHQDVNGSGYLTYFQRDYKLSRITLTSEGSIKMFRDNGMGWELYYEAPKKLCDFYGACGPFGLCVMSPSPMCKCFRGFVPKSVEEWKRGNWTGGCVRHTELDCLGNSTGEDADDFHQIANIKPPDFYEFASSVNAEECHQRCVHNCSCLAFAYIKGIGCLVWNQDLMDAVQFSATGELLSIRLARSELDGNKRKKTIVASIVSLTLFMILGFTAFGVWRCRVEHIAHISKDAWKNDLKPQDVPGLDFFDMHTIQNATNNFSLSNKLGQGGFGSVYKGKLQDGKEIAVKRLSSSSGQGKEEFMNEIVLISKLQHRNLVRVLGCCIEEEEKLLIYEFMVNKSLDTFLFDSRKRLEIDWPKRFDIIQGIARGLLYLHHDSRLRVIHRDLKVSNILLDEKMNPKISDFGLARMYQGTEYQDNTRRVVGTLGYMSPEYAWTGMFSEKSDIYSFGVLMLEIISGEKISRFSYGVEGKTLIAYAWESWSEYRGIDLLDQDLADSCHPLEVGRCIQIGLLCVQHQPADRPNTLELLAMLTTTSDLPSPKQPTFAFHTRDDESLSNDLITVNGMTQSVILGR

SEQ ID NO: 779 - DNA, 2421 bp, Arabidopsis thaliana
  AT1G61420.1
atggggaagaagtggatcgtgttctttgcttatttgctcttatctagcttctttataagttctagctctgcagggataacgaaagaaagtcctttgccaataggacaaactctcagctcctctaatggtttttatgaactggggttcttcaattttaataactcccagaatcagtatgtcggaatctggttcaagggtattattccccgggtggttgtgtgggtggccaatagagaaaagcctgttacagattccacggcaaatctcgctatcagcaacaatggaagtcttctgttatttaatggcaaacatggcgttgcatggtccagtggagaagctcttgtttctaacgggtctcgtgcagagctttcagacaccggaaatcttattgtcatagacaatttttcgggaagaactctatggcaaagctttgaccatcttggtgatactatgcttccttcctcaaccctgaagtataacctcgccactggcgagaagcaggtgttgagttcttggaaaagttacactgatccatcggttggcgactttgtgcttcagattacgccacaagtgccaacgcaggtgcttgttacgaaaggatcaacgccttattatagaagcggtccatgggctaaaacaaggttcacggggataccgctaatggatgacacatttacaggtccagtcagcgttcagcaggatacaaatgggtcaggatctctcacttatttaaacagaaacgatagacttcaacgtacaatgctaacatcaaagggcacacaggagttgtcttggcataatgggacggactgggtattgaactttgtggctccagaacactcatgtgattactacggtgtatgtggaccttttgggttatgtgtgaagtctgttcctccaaaatgtacgtgtttcaaagggtttgttcctaaactcattgaggagtggaaaagaggaaactggactggtggttgtgtgaggcgtaccgaactatattgtcaaggaaactctactggcaaatatgcaaacgtgttccatcctgttgccaggataaagcctccagacttttacgaatttgcaagttttgtgaatgttgaagaatgccagaaaagttgcctccacaattgttcttgcttggcctttgcttatatcgatggaattgggtgcttaatgtggaaccaagacctaatggacgcagtgcaattttctgaaggaggagaacttctctccattcgtctggcacgttctgaactaggtggaaataagcgcaagaaggccattactgctagtattgtgagcctttctcttgttgtgataattgcgtttgttgcgttttgtttctggagatatagagtgaaacataatgctgatataacaacggatgcttcacaagtttcatggaggaatgatctgaaaccacaagatgtcccaggtttagatttctttgatatgcataccattcaaactgccaccaataatttcagtatatcaaacaaactcggacaaggtggatttggccctgtttataagggtaagctgcaagatgggaaagaaattgctgtaaaacggctttctagcagctcgggccagggcaaagaggagttcatgaatgaaatagtactcatctcaaaactacaacataaaaacttagttcggattttgggatgttgcattgaaggagaagagaagctattgatttatgagttcatgttgaacaatagccttgatacctttctcttcgattcaagaaaaaggcttgagattgactggccaaagagattggatatcattcaaggtattgcgcgtggaattcactatctccatcgtgactcacacctcaaggttattcaccgagatctgaaggttagcaatattcttcttgacgagaagatgaatccaaagatatcagattttggattggctcggatgtatcagggaaccgaatatcaggacaatactcgcagggttgtaggaactctaggatatatggctcctgagtatgcatggactgggatgttttctgaaaagtccgacatctatagctttggagttctaatgttagaaatcataagcggggagaagatctcaagattcagctatggcaaagaagaaaaaacccttattgcatatgcgtgggaatcttggtgtgatactggaggaattgatctcttggacaaagatgtcgccgattcatgtcgcccactggaagttgagagatgtgttcagatcggtctgctctgtgttcaacaccaacctgcagatagacccaacacacttgagttgctgtctatgctcaccacaacatcagatcttccaccaccagaacaaccgacatttgtagtgcacaggagagatgacaaatcatcgtctgaggatttgatcactgtgaatgagatgacaaagtctgtgatcttagggcgt

SEQ ID NO: 780 - protein, 807 aa, Arabidopsis thaliana
  AT1G61420.1
MGKKWIVFFAYLLLSSFFISSSSAGITKESPLPIGQTLSSSNGFYELGFFNFNNSQNQYVGIWFKGIIPRVVVWVANREKPVTDSTANLAISNNGSLLLFNGKHGVAWSSGEALVSNGSRAELSDTGNLIVIDNFSGRTLWQSFDHLGDTMLPSSTLKYNLATGEKQVLSSWKSYTDPSVGDFVLQITPQVPTQVLVTKGSTPYYRSGPWAKTRFTGIPLMDDTFTGPVSVQQDTNGSGSLTYLNRNDRLQRTMLTSKGTQELSWHNGTDWVLNFVAPEHSCDYYGVCGPFGLCVKSVPPKCTCFKGFVPKLIEEWKRGNWTGGCVRRTELYCQGNSTGKYANVFHPVARIKPPDFYEFASFVNVEECQKSCLHNCSCLAFAYIDGIGCLMWNQDLMDAVQFSEGGELLSIRLARSELGGNKRKKAITASIVSLSLVVIIAFVAFCFWRYRVKHNADITTDASQVSWRNDLKPQDVPGLDFFDMHTIQTATNNFSISNKLGQGGFGPVYKGKLQDGKEIAVKRLSSSSGQGKEEFMNEIVLISKLQHKNLVRILGCCIEGEEKLLIYEFMLNNSLDTFLFDSRKRLEIDWPKRLDIIQGIARGIHYLHRDSHLKVIHRDLKVSNILLDEKMNPKISDFGLARMYQGTEYQDNTRRVVGTLGYMAPEYAWTGMFSEKSDIYSFGVLMLEIISGEKISRFSYGKEEKTLIAYAWESWCDTGGIDLLDKDVADSCRPLEVERCVQIGLLCVQHQPADRPNTLELLSMLTTTSDLPPPEQPTFVVHRRDDKSSSEDLITVNEMTKSVILGR

SEQ ID NO: 781 - DNA, 1794 bp, Arabidopsis thaliana
  AT1G61460.1
atgcttcctttctcagctctgatgtataacctcgccactggcgagaagcaggtcttgacttcttggaaaagttacactaatccagcggttggtgactttgtgcttcagattacaacgcaagtgccaacacaagctttaactatgagaggctcgaagccttattggagaagcggtccatgggctaaaacaagaaacttcaaacttccacgtatagtgataacatcgaagggttcactggagatttctaggcatagtgggactgattgggtattgaactttgtggctccagcgcactcatgtgattattacggtgtatgtggaccttttgggatttgtgtcaagtcagtgtgtaaatgcttcaaagggtttataccaaaatatattgaggagtggaaaagaggaaattggactgatggttgtgtgaggcgtaccaaactacattgtcaggaaaactcaactaaaaaagatgcaaacttcttccatccagttgccaacataaagcctccagacttttacgaatttgcaagtgctgtggatgcagaaggatgctacaaaatttgcctccacaactgttcttgcttggccttttcttatattcatggaattgggtgcttaatatggaaccaagacttcatggacacagtgcaattttctgcaggaggagagattctttccattcgtcttgcacgttctgaattaggtgggaataagcgcaagaagaccattactgctagtattgtcagcctttctctttttctgatattgggttctactgcgtttggtttctggagatacagagttaaacataatgcttcacaagatgcaccgaaatatgatttggaaccacaagatgtctcaggttcatatttgtttgagatgaacaccattcaaactgccaccaataatttcagtctctcaaataaactgggacaaggtggatttggttcagtttacaagggaaagctgcaagatgggaaagaaattgctgtaaaacggctttctagcagctcagggcagggcaaagaggagttcatgaatgaaatagtactcatctcaaaactacaacacaaaaacttagttcggattttaggatgttgcattgaaggagaagagaggctgttgatttatgagtttatgttgaacaaaagccttgatacttttctcttcgattcaagaaaaaggcttgagattgactggccaaagagatttgatatcattcaaggtattgcgcgtggaattcactatctccatcgtgactcatgcctcaaggtaattcaccgtgatctgaaggtcagcaatattcttcttgacgagaagatgaatccaaagatatcagattttggattggctcggatgtatcagggaaccgaatatcaggacaatactcgcagggtcgtaggaactctaggatatatgtctccagaggatatattagaaatcataagcggagagaagatctcaagattcagctatggcaaagaagaaaaaacccttattgcatatgcatgggaatcttggtgtgaaactggaggagttgatcttttggataaagatgttgctgattcatgtcgcccattagaagttgagagatgtattcagattggtcttctctgtgttcaacaccaacctgcagacagaccaaacacacttgagttgatgtctatgctcacgacaacatcagatcttccatcaccaaaacaacccacatttgtagtgcactggagagatgacgaatcatcgtctaaggatttgatcactgtgaatgagatgacaaagtctgtgatcttagggcgt

SEQ ID NO: 782 - protein, 598 aa, Arabidopsis thaliana
  AT1G61460.1
MLPFSALMYNLATGEKQVLTSWKSYTNPAVGDFVLQITTQVPTQALTMRGSKPYWRSGPWAKTRNFKLPRIVITSKGSLEISRHSGTDWVLNFVAPAHSCDYYGVCGPFGICVKSVCKCFKGFIPKYIEEWKRGNWTDGCVRRTKLHCQENSTKKDANFFHPVANIKPPDFYEFASAVDAEGCYKICLHNCSCLAFSYIHGIGCLIWNQDFMDTVQFSAGGEILSIRLARSELGGNKRKKTITASIVSLSLFLILGSTAFGFWRYRVKHNASQDAPKYDLEPQDVSGSYLFEMNTIQTATNNFSLSNKLGQGGFGSVYKGKLQDGKEIAVKRLSSSSGQGKEEFMNEIVLISKLQHKNLVRILGCCIEGEERLLIYEFMLNKSLDTFLFDSRKRLEIDWPKRFDIIQGIARGIHYLHRDSCLKVIHRDLKVSNILLDEKMNPKISDFGLARMYQGTEYQDNTRRVVGTLGYMSPEDILEIISGEKISRFSYGKEEKTLIAYAWESWCETGGVDLLDKDVADSCRPLEVERCIQIGLLCVQHQPADRPNTLELMSMLTTTSDLPSPKQPTFVVHWRDDESSSKDLITVNEMTKSVILGR

SEQ ID NO: 783 - DNA, 2427 bp, Arabidopsis thaliana
  AT1G61480.1
atggggaagaagaggatcatgttctttgcttccttgctcttaattaccatctttttaagtttcagctatgcagggataacgagagaaagtcctctgtcaataggaaaaactctcagctcctctaatggagtttatgaattgggattcttcagttttaataactcccaaaatcagtatgttggaatctggttcaagggtatcattccccgggtggttgtgtgggtggccaatagagaaaagcctgttacagactctgcagcaaatttaactatcagcagcaatggaagtcttctgttgtttaatgaaaatcatagcgttgtgtggtccattggagaaacttttgcatctaacgggtctcgtgcggagcttacagacaacggaaatttagttgtcatagacaataattcgggaagaactctatgggaaagctttgagcattttggtgacactatgctacctttctcaaacctgatgtataatcttgccacaggtgagaagcgggtgttgacttcttggaaaagtcacactgatccatcgcctggcgattttacggttcagattacaccgcaagttccatcccaggcgtgtactatgagaggctcaaagacttattggagaagcggtccatgggctaaaacaaggttcaccgggatacctgtaatggatgacacatatacaagtccattcagccttcagcaagatacaaacgggtcaggatccttcacttattttgaaagaaacttcaaactttcatatataatgataacatcagaaggctcactgaagatttttcagcataatggaatggactgggaattaaacttcgaggctccagaaaattcatgcgatatttacggcttttgtggaccttttggaatttgtgttatgtcagtacctccaaagtgtaaatgcttcaaagggtttgtaccaaaatccattgaggagtggaaaagaggaaactggactgatggttgtgtgaggcatactgaactacattgccaaggaaacactaatggtaaaactgtaaacggcttctatcacgttgccaacataaagcctccagacttttacgaatttgcaagttttgtggatgctgaaggatgctaccaaatttgcctccacaattgttcttgcttggcctttgcttatatcaatggaataggttgcttaatgtggaaccaagacctaatggacgcagtgcaattttctgcagggggagaaattctttccattcgccttgcaagttctgaactaggtggaaataagcgcaacaaaatcattgttgctagtattgtgagcctttctctttttgtgatactggcttttgctgcgttttgtttcttgagatacaaagtgaaacataccgtttcagcgaagatatcaaagattgcttcaaaagaggcatggaataatgatctagagccacaagatgtctcaggtttaaagttctttgagatgaataccattcaaactgccactgataatttcagtctctcaaataaactaggacaaggtggatttggctcagtttacaagggaaagctgcaagatgggaaagaaattgctgtaaaacggctttctagcagctccggacagggaaaagaggagttcatgaatgaaatagtactcatctcgaaactacaacataaaaacttggttaggattctgggatgttgcattgaaggagaagagaggctgttggtatatgagtttttgctgaacaaaagccttgatacttttctcttcgattcaagaaaaaggcttgagattgactggcctaagagatttaatatcattgaaggcattgcgcgtgggcttcactatctccaccgtgactcatgcctcagggtcattcaccgtgatcttaaggttagcaatattcttctggatgagaagatgaacccaaaaatatcagactttggattggctcggatgtatcagggaaccgaatatcaggacaacactcgtagggttgcaggaactctaggatatatggctcccgagtatgcatggactgggatgttctctgagaaatcagatatctacagttttggagttatactgttggaaatcatcaccggggagaagatctcaagattcagctatggtagacaaggaaaaacccttcttgcatatgcatgggaatcttggtgtgaaagtggaggaatcgatcttttggataaagatgttgctgattcatgtcacccattagaagttgagagatgtgtgcagattggtttgctatgtgttcaacaccaacctgctgatagaccaaacacaatggagttgttgtctatgctcaccacaacatcagatcttacatcaccaaaacagcccacatttgtagtgcacacgagagatgaagaatctctgtctcagggtttgatcaccgtcaatgagatgacccaatctgtgatccttgggcgt

SEQ ID NO: 784 - protein, 809 aa, Arabidopsis thaliana
  AT1G61480.1
MGKKRIMFFASLLLITIFLSFSYAGITRESPLSIGKTLSSSNGVYELGFFSFNNSQNQYVGIWFKGIIPRVVVWVANREKPVTDSAANLTISSNGSLLLFNENHSVVWSIGETFASNGSRAELTDNGNLVVIDNNSGRTLWESFEHFGDTMLPFSNLMYNLATGEKRVLTSWKSHTDPSPGDFTVQITPQVPSQACTMRGSKTYWRSGPWAKTRFTGIPVMDDTYTSPFSLQQDTNGSGSFTYFERNFKLSYIMITSEGSLKIFQHNGMDWELNFEAPENSCDIYGFCGPFGICVMSVPPKCKCFKGFVPKSIEEWKRGNWTDGCVRHTELHCQGNTNGKTVNGFYHVANIKPPDFYEFASFVDAEGCYQICLHNCSCLAFAYINGIGCLMWNQDLMDAVQFSAGGEILSIRLASSELGGNKRNKIIVASIVSLSLFVILAFAAFCFLRYKVKHTVSAKISKIASKEAWNNDLEPQDVSGLKFFEMNTIQTATDNFSLSNKLGQGGFGSVYKGKLQDGKEIAVKRLSSSSGQGKEEFMNEIVLISKLQHKNLVRILGCCIEGEERLLVYEFLLNKSLDTFLFDSRKRLEIDWPKRFNIIEGIARGLHYLHRDSCLRVIHRDLKVSNILLDEKMNPKISDFGLARMYQGTEYQDNTRRVAGTLGYMAPEYAWTGMFSEKSDIYSFGVILLEIITGEKISRFSYGRQGKTLLAYAWESWCESGGIDLLDKDVADSCHPLEVERCVQIGLLCVQHQPADRPNTMELLSMLTTTSDLTSPKQPTFVVHTRDEESLSQGLITVNEMTQSVILGR

SEQ ID NO: 785 - DNA, 2406 bp, Arabidopsis thaliana
  AT1G61550.1
atgacgaggtttgcttgctttctcttctctaccttgctcttaagttttagctatgcagctataacaccaacaagtcctttgtcaattggacaaactctcagctcccctaatggaattttcgaactggggtttttcagtcctaataactctcggaatttgtatgttggaatctggttcaagggtatcattccccggacggttgtgtgggtggccaatagagaaaattctgttacagacgccactgcggatctagctatcagtagcaatggaagtcttctcttatttgatggcaaacatagcactgtctggtccaccggagaaacttttgcatctaacgggtctagtgcagagctttcagacagcggaaatcttttggtcatagacaaagtttcgggaataactctatggcaaagctttgagcatcttggtgatactatgctaccttactcctccctgatgtataaccccggcactggtgagaagcgggtattgtcttcttggaaaagttacactgatccattgcctggtgagtttgtgggttatattacaacacaagtgccaccacaggggtttattatgagaggctcgaagccttattggagaagcggtccttgggctaaaacaaggtttactggcgtaccactaacggatgaatcatacacacatccatttagcgttcagcaagatgcaaacgggtcagtatacttctctcatttacaaagaaacttcaaacgttcattgttagtattaacatcagaggggtcactgaaggttactcatcataatggcacggactgggtattgaacattgatgttccagctaacacatgtgatttttacggtgtatgtggaccttttggattgtgtgtaatgtccattcctccaaagtgtaaatgctttaaaggctttgtaccacaattcagtgaggaatggaaaagaggaaattggactggtggttgtgtgaggcgtactgaactactttgtcaaggaaactctactgggagacatgtaaacgtcttccatcctgttgccaacataaaacctccagacttttacgaatttgtgtcctccgggagtgcagaagaatgctaccaaagttgcctccacaattgttcatgcttggcctttgcttatattaatggaatagggtgcttaatttggaaccaggagctaatggatgtaatgcaattctctgtgggaggagagcttctttctatacgtcttgcaagttctgaaatgggtggaaaccagcgcaagaagaccattattgctagtattgttagcatttctctttttgtgacattggcttctgctgcgtttggtttctggagatacagattgaaacataatgcaattgtatcgaaggtttctttacaaggtgcatggaggaatgatttgaaatcagaagatgtctcaggtttatatttctttgagatgaagaccattgaaattgccaccaataatttcagtctcgtaaacaaactcggacaaggtggatttggtccagtttacaagggaaagttacaagatgggaaagaaatagctgtaaaacggctttccagcagctctggacagggaaaggaggagttcatgaatgaaatactactcatctcaaaactccaacacataaacttggttcggattttaggatgttgcattgaaggagaagagcgactgttggtttatgagttcatggtgaacaaaagccttgatacttttatctttgattcaagaaaaagggttgagattgattggcctaagaggttcagtattattcaaggaattgcgcgtggtcttctctatctccaccgtgactcacgcctcaggataattcaccgagatgtgaaggttagcaatattcttcttgacgataaaatgaacccgaaaatatcagattttggattggctcggatgtatgaaggaaccaaatatcaggacaacactcgcaggattgtaggaactctaggatatatgtctcctgagtatgcatggactggagttttctctgagaagtccgacacctacagctttggagttctcttgttagaagttatcagcggagagaagatctcgaggtttagctatgataaagagcgcaaaaaccttcttgcatatgcgtgggaatcttggtgcgaaaatggaggagttggttttttggataaagatgctactgattcatgtcacccatctgaagttggaaggtgtgttcagattggtctgctttgtgttcagcaccaacctgctgatagacccaacacacttgagttgttgtctatgctcacaacaacatcagatcttccactacctaaagaacccacatttgcagtgcatactagcgatgacggatcccgcactagtgatttgattacagtcaatgaggtgacacaatctgtggtgctagggcgt

SEQ ID NO: 786 - protein, 802 aa, Arabidopsis thaliana
  AT1G61550.1
MTRFACFLFSTLLLSFSYAAITPTSPLSIGQTLSSPNGIFELGFFSPNNSRNLYVGIWFKGIIPRTVVWVANRENSVTDATADLAISSNGSLLLFDGKHSTVWSTGETFASNGSSAELSDSGNLLVIDKVSGITLWQSFEHLGDTMLPYSSLMYNPGTGEKRVLSSWKSYTDPLPGEFVGYITTQVPPQGFIMRGSKPYWRSGPWAKTRFTGVPLTDESYTHPFSVQQDANGSVYFSHLQRNFKRSLLVLTSEGSLKVTHHNGTDWVLNIDVPANTCDFYGVCGPFGLCVMSIPPKCKCFKGFVPQFSEEWKRGNWTGGCVRRTELLCQGNSTGRHVNVFHPVANIKPPDFYEFVSSGSAEECYQSCLHNCSCLAFAYINGIGCLIWNQELMDVMQFSVGGELLSIRLASSEMGGNQRKKTIIASIVSISLFVTLASAAFGFWRYRLKHNAIVSKVSLQGAWRNDLKSEDVSGLYFFEMKTIEIATNNFSLVNKLGQGGFGPVYKGKLQDGKEIAVKRLSSSSGQGKEEFMNEILLISKLQHINLVRILGCCIEGEERLLVYEFMVNKSLDTFIFDSRKRVEIDWPKRFSIIQGIARGLLYLHRDSRLRIIHRDVKVSNILLDDKMNPKISDFGLARMYEGTKYQDNTRRIVGTLGYMSPEYAWTGVFSEKSDTYSFGVLLLEVISGEKISRFSYDKERKNLLAYAWESWCENGGVGFLDKDATDSCHPSEVGRCVQIGLLCVQHQPADRPNTLELLSMLTTTSDLPLPKEPTFAVHTSDDGSRTSDLITVNEVTQSVVLGR

SEQ ID NO: 787 - DNA, 2370 bp, Eucalyptus grandis
  Eucgr.B01362.1
atgaaaccggcatctcgtagccctccgtctcgtgaacgacatatagccagtggcgcagttcacaatattactacatcggagccgctctttcagaaccaaactctcatctcctcaggccaaatcttcgagcttggcttcttcacgccgaatgggttggaaaatcagtatgttggcatatggtacaagaacttgactccttctaaaatcgtgtgggtggccaatagggattcaccactcgcgtcggcagatcggtctgcaaaattaacgatcggcggtgatgggaatttgaagctcgtggatggacaacagaacatagtttggtccaccaatgtttctgtccagtcaaataatacagcagcaatgctttcagatggtggaaagttttttctacaagacaggaattctactgaagtatgggcaagctttgatgatccaactgatacaattctaccaaacatgaagataggactaaacaagagaacaggagagagacgagttttagtttcctggaaaaacaacaacgatccatcatcgggaaatttcaccactgcgcttacatcagagactccgccgcaacttctcactcggaatggctccacctcttattggagaagtggaccatgggataaatcgatattcatcggcataccagaaatgaaatcctcataccataccgggtacagtctccagaacgatcctcagcagggaaccgcttatttctctgctgattttgataacaactcttttcttgcttatgccttcatttcacccgaaggaattctagcacaaatgatatgggattatggatccaatggttggttgaaaaatttggcagcaccgagcaccagttgtgacatttatggaacttgcggtccctttggcatctgcaactcaaaaaactctcctatctgccgttgcgtaaaagggtttatgccgcgatcgaaagaagaatggaacagaaggaattggaccagggggtgcattagagaaacagaattgaactgccagaagaacacaagcaggtcgccttcaacgcagatgaagaaagatgtctttgtacacacgaaacagatgaaagtgcctgattctgcagaatatttatcagaccctggagatgtaggaaaatgccaaagctggtgcatgaataattgttcttgcttggcttattcttatgtccaaacgatagggtgtttggtctgggctaaagatctcatggattttcaggagttttcaactgctgggcaagatgtatatattcgggtcgcgcatgacaatacaggagaaatgtctcctggaaatgcatggaaagatcagctgaagcaaaaggacgcatccgaatttacgctgttcagttttagtagcttacttcttgcgactaacaactttgatgcaacaaataaacttggccaaggagggtttggacccgtttataagggaatgctgaatgatggaaaggagatagctgtcaaaagactttccagtagctcaggccaaggcatggaggagtttgagaatgagattgttctaatatcaaaacttcagcaccgaaatctggtcagactcatgggatgctgtgtcgaaggagaagaaaagattttagtatacgaatacttgtcaaacaaaagtttagattcctttctgtttggtcacgaattctttctttttcttccttgcttagattcaaaaaggaaagcagaactcaactgggatacacgtttccgcatcattcaagggatcgcaagtgggcttctatatctgcatcgcgattcttaccttcgagttatccatcgagatttgaaggcaagcaatattctcttggacgagaaaatgaacccaaaaatttcggactttgggctggcgcgaatgttcgaaggcacacaagttttgctaaatactcacaaagttgcaggaacactaggatatatgtctcctgagtacgtcatgggagggatattttctgagaaatccgatatttatagctttggggtgttgctacttgagattgttgctggcaaaaagaacacaagcttatactaccgtggccagcatttcaatcttctttcctatgcatggcaattgtggagtgaagatagaggaccagacctaagggatgaagctatagttaatacttgtccgccatcagaagcaatgagatgcattcaggtggggcttctctgtgtgcaggaccaaatgacggaccgacccaacatgctatctgtagttcggatgctgagcggtgagtcagatcttcctcagccgagacctccaacgttcaccttccaaagggaaaatccaagtcacgataaggaggcacaaggggaaagtattttctccgtgaacactatgacgaattctgtggtcgaaggaaga

SEQ ID NO: 788 - protein, 790 aa, Eucalyptus grandis
  Eucgr.B01362.1
MKPASRSPPSRERHIASGAVHNITTSEPLFQNQTLISSGQIFELGFFTPNGLENQYVGIWYKNLTPSKIVWVANRDSPLASADRSAKLTIGGDGNLKLVDGQQNIVWSTNVSVQSNNTAAMLSDGGKFFLQDRNSTEVWASFDDPTDTILPNMKIGLNKRTGERRVLVSWKNNNDPSSGNFTTALTSETPPQLLTRNGSTSYWRSGPWDKSIFIGIPEMKSSYHTGYSLQNDPQQGTAYFSADFDNNSFLAYAFISPEGILAQMIWDYGSNGWLKNLAAPSTSCDIYGTCGPFGICNSKNSPICRCVKGFMPRSKEEWNRRNWTRGCIRETELNCQKNTSRSPSTQMKKDVFVHTKQMKVPDSAEYLSDPGDVGKCQSWCMNNCSCLAYSYVQTIGCLVWAKDLMDFQEFSTAGQDVYIRVAHDNTGEMSPGNAWKDQLKQKDASEFTLFSFSSLLLATNNFDATNKLGQGGFGPVYKGMLNDGKEIAVKRLSSSSGQGMEEFENEIVLISKLQHRNLVRLMGCCVEGEEKILVYEYLSNKSLDSFLFGHEFFLFLPCLDSKRKAELNWDTRFRIIQGIASGLLYLHRDSYLRVIHRDLKASNILLDEKMNPKISDFGLARMFEGTQVLLNTHKVAGTLGYMSPEYVMGGIFSEKSDIYSFGVLLLEIVAGKKNTSLYYRGQHFNLLSYAWQLWSEDRGPDLRDEAIVNTCPPSEAMRCIQVGLLCVQDQMTDRPNMLSVVRMLSGESDLPQPRPPTFTFQRENPSHDKEAQGESIFSVNTMTNSVVEGR

SEQ ID NO: 789 - DNA, 2088 bp, Eucalyptus grandis
  Eucgr.B01368.1
atgcgactcataattgcttggtgctcttgcttggtcttcttcttcctacttccggcgagacatatagccagtggcgcggttcacaatattactacatcggagccgctctttcagaaccaaactctcgtctcctcaggccaaatcttcgagcttggcttcttcaggccgaatgggtcggaaaaccagtatgttggcatatggtacaagaacttgacgccttctaaaaccgtgtgggtggccaatagggattcgccactcacgtccgcagatcggtctgcgaaattaacgataggcagtgatgggaatttgaagctcgtggatggacagcagaacatagtttggtccaccaatgtttctgtccagtcaaataatacagcagcaatgctttcagatggtggaaagtttgttctacaagacaggaattctactgaaagaacaggagagagacgggttttagtttcctggaaaaacaacaacgatccatcatcgggaaatttcaccactgcgcttacatcagagactccgccgcaacttctcactcggaatggctccacctcttattggagaacaccgagcaccagttgtgacatttatggaacttgtggtccctttggcatctgcaactcaaaaaactctcctatctgccgttgcgtaaaagggtttatgccgcgatcgaaagaagaatggaacagaaggaattggaccagggggtgcattagagaaacagaattgaactgccagaagaacacaagcaggtcgccttcaacgcagatgaagaaagatgtctttgtacacatgaaacagatgaaagtgcctgattctgcagaatattcatcagaccctggagatgtaggaaaatgccaaagctggtgcatgaataattgttcttgcttggcttattcttttgtccagacgatagggtgtttggtctgggctgaagatctcatggattttcaggagttttcaacagctgggcaagatgtatatattcgggtcgcgcatgacaatacagatataactgataaaagaggagaaatgtcttttggaaatgcatggaaagatcagctgaagcaaaatgacgcatcccaatttaagctgttcagttttagtagcttacttcttgcaactaacaactttgatgcaacaaataaacttggccaaggagggtttggacccgtttataagggaatgctgaatgatggaaaggagatagctgtcaaaagactttccagtagctcaggccaaggcatggaggagtttgagaatgagattgttctaatatcgaaacttcagcaccgaaatctggtcagactcatgggctgctgtgtcgaaggagaagaaaagattttagtatacgaatacttgtcaaacaaaagtttagatttctttctgtttgattcaaaaaggaaagcagaactcaactgggatacacgtttctgcatcattcaagggatcgcaagtgggcttctatatctgcatcgcgattcttaccttcgagttatccatcgagatttgaaggcaagcaatattctcttggatgagaaaatgaacccaaaaatttcggactttgggctggcgcgaatctttgaaggcacacaagttttgctaaatactcacaaagttgcaggaacactaggatatatgtctcccgagtacatcatgggagggatattttctgagaaatccgatgtttatagctttggggtgttgctacttgagatcgtagctggaaaaaagaacacgagcttatactaccgtggccagcatttcaatcttctttcctatgcatggcaattgtggagcgaagatagaggaccagacctgagggatgaagctatagttaatacttgtccgccatcagaagcaatgagatgcattcaggtggggcttctctgtgtgcaggaccaaatgacggaccgacccaacatgctatccgtagttcggatgttgagcggtgagtcagatcttcctcagccgagacctccaacattcaccttccaaactggaaatccaagtcacgataacgaggcacaaggggaaagtattttctccgtgaacaccgtgacgaattctgtagtcaaaggaaga

SEQ ID NO: 790 - protein, 696 aa, Eucalyptus grandis
  Eucgr.B01368.1
MRLIIAWCSCLVFFFLLPARHIASGAVHNITTSEPLFQNQTLVSSGQIFELGFFRPNGSENQYVGIWYKNLTPSKTVWVANRDSPLTSADRSAKLTIGSDGNLKLVDGQQNIVWSTNVSVQSNNTAAMLSDGGKFVLQDRNSTERTGERRVLVSWKNNNDPSSGNFTTALTSETPPQLLTRNGSTSYWRTPSTSCDIYGTCGPFGICNSKNSPICRCVKGFMPRSKEEWNRRNWTRGCIRETELNCQKNTSRSPSTQMKKDVFVHMKQMKVPDSAEYSSDPGDVGKCQSWCMNNCSCLAYSFVQTIGCLVWAEDLMDFQEFSTAGQDVYIRVAHDNTDITDKRGEMSFGNAWKDQLKQNDASQFKLFSFSSLLLATNNFDATNKLGQGGFGPVYKGMLNDGKEIAVKRLSSSSGQGMEEFENEIVLISKLQHRNLVRLMGCCVEGEEKILVYEYLSNKSLDFFLFDSKRKAELNWDTRFCIIQGIASGLLYLHRDSYLRVIHRDLKASNILLDEKMNPKISDFGLARIFEGTQVLLNTHKVAGTLGYMSPEYIMGGIFSEKSDVYSFGVLLLEIVAGKKNTSLYYRGQHFNLLSYAWQLWSEDRGPDLRDEAIVNTCPPSEAMRCIQVGLLCVQDQMTDRPNMLSVVRMLSGESDLPQPRPPTFTFQTGNPSHDNEAQGESIFSVNTVTNSVVKGR

SEQ ID NO: 791 - DNA, 2283 bp, Eucalyptus grandis
  Eucgr.L01618.1
atgagagacaattcggggaagccactctttcagaaccaaactctcgtctcctcaggccaaatcttcgagcttggcttcttcacgccgaatgggtcggaaaaccagtatgttggcatatggtacaagaacttgacgccttctaaaaccgtgtgggtggccaatagggattcgccactcacgtccgcagatcggtctgcgaaattaacgataggcagtgatgggaatttgaagctcgtggatggacagcagaacatagtttggtccaccaatgtttctgtccagtcaaataatacagcagcaatgctttcagatggtggaaagtttgttctacaagacaggaattctactgaaagaacaggagagagacgggttttagtttcctggaaaaacaacaacgatccatcatcgggaaatttcaccactgcgcttacatcagagactccgccgcaacttctcactcggaatggctccacctcttattggagaagtggaccatgggataaatcgatattcatcggcataccagaaatgaaatcctcataccataccgggtacagtctccagaacgatcctcagcagggaaccgcttatttctctgctgattttgataacaactcttttcttgcttatgccttcatttcacccgaaggaattctagcacaaatgatatgggattatggatccaatggttggttgaaaaatttggcagcaccgagcaccagttgtgacatttatggaacttgcggtccctttggcatctgcaactcaaaaaactctcctatctgccattgcgtaaaagggtttatgccgcgatcgaaagaagaatggaacagaaggaattggaccagggggtgcattagagaaacagaattgaactgccagaagaacacaagcaggtcgccttcaacgcagatgaagaaagatgtctttgtacacatgaaacagatgaaagtgcctgattctgcagaatattcatcagaccctggagatgtaggaaaatgccaaagctggtgcatgaataattgttcttgcttggcttattcttttgtccagacgatagggtgtttggtctgggctgaagatctcatggattttcaggagttttcaacagctgggcaagatgtatatattcgggtcgcgcatgacaatacaggcatgtcaacagaagcaaaacttatcatcagcataagtaccatcctaggcagcatgttcgttggaactgctattttcggtctctggaagtggagagccagcaaaagagatataactgataaaagaggagaaatgtcttttggaaatgcatggaaagatcagctgaagcaaaatgacgcatcccaatttaagctgttcagttttagtagcttacttcttgcaactaacaactttgatgcaacaaataaacttggccaaggagggtttggacccgtttataagggaatgctgaatgatggaaaggagatagctgtcaaaagactttccactagctcaggccaaggcacggatgagtttaagaatgagatcgttctaatatcgaaacttcagcatcgaaatctggtcagactcatgggctgctgcgtcgagggagaagaaaagattttagtatacgagtacttgtcaaacaaaagcttagattcctttctgtttgggatcgcaagtgggcttctatatctgcatcacgattcttaccttcgagttatccatcgagatttgaaggcaagcaatattctcttggatgagaaaatgaacccaaaaatttcggactttgggctggcgcggatcttcgaaggcactcaagttttgctaaatactcacaaagttgtaggaacactaggatatatgtctcctgagtacgtcatgggagggattttttctgagaaatccgatgtttatagctttggggcgttgctacttgagattgttgctggcaaaaagaacacgagcttatactacaatggccagcatttcaatcttctttcctatgcatggcaattgtggagcgaagatagaggaccagacctaagggatgaagctatagttaatacttgttcgccatcagaagcaatgagatgcattcaggtggggcttctctgtgtgcaggaccaaatgacggaccgacccaacatgctatccgtagttcggatgctgagcggtgagtcagatcttcgtcagccgagacctccaacgttcaccttccaaaggggaaatccaagtcacgataaggaggcacaaggggaaagtattttctccgtgaacaccatgacgaattctgtggtcgaaggaaga

SEQ ID NO: 792 - protein, 761 aa, Eucalyptus grandis
  Eucgr.L01618.1
MRDNSGKPLFQNQTLVSSGQIFELGFFTPNGSENQYVGIWYKNLTPSKTVWVANRDSPLTSADRSAKLTIGSDGNLKLVDGQQNIVWSTNVSVQSNNTAAMLSDGGKFVLQDRNSTERTGERRVLVSWKNNNDPSSGNFTTALTSETPPQLLTRNGSTSYWRSGPWDKSIFIGIPEMKSSYHTGYSLQNDPQQGTAYFSADFDNNSFLAYAFISPEGILAQMIWDYGSNGWLKNLAAPSTSCDIYGTCGPFGICNSKNSPICHCVKGFMPRSKEEWNRRNWTRGCIRETELNCQKNTSRSPSTQMKKDVFVHMKQMKVPDSAEYSSDPGDVGKCQSWCMNNCSCLAYSFVQTIGCLVWAEDLMDFQEFSTAGQDVYIRVAHDNTGMSTEAKLIISISTILGSMFVGTAIFGLWKWRASKRDITDKRGEMSFGNAWKDQLKQNDASQFKLFSFSSLLLATNNFDATNKLGQGGFGPVYKGMLNDGKEIAVKRLSTSSGQGTDEFKNEIVLISKLQHRNLVRLMGCCVEGEEKILVYEYLSNKSLDSFLFGIASGLLYLHHDSYLRVIHRDLKASNILLDEKMNPKISDFGLARIFEGTQVLLNTHKVVGTLGYMSPEYVMGGIFSEKSDVYSFGALLLEIVAGKKNTSLYYNGQHFNLLSYAWQLWSEDRGPDLRDEAIVNTCSPSEAMRCIQVGLLCVQDQMTDRPNMLSVVRMLSGESDLRQPRPPTFTFQRGNPSHDKEAQGESIFSVNTMTNSVVEGR

SEQ ID NO: 793 - DNA, 2373 bp, Eucalyptus grandis
  Eucgr.B01365.1
atgcgactcataattgcttggtgctcttgcttggtcttcttcttcctacttccggcaagacatatagccagtggcggggttcacaatattactacatcggagccgctctttcagaaccaaactctcgtctcctcaggccaaatcttcgagcttggcttcttcacgccgaatgggtcggaaaaccagtatgttggcatatggtacaagaacttgacgccttctaaaaccgtgtgggtggccaatagggattcgccactcacgtccgcagatcggtctgcgaaattaacgataggcagtgatgggaatttgaagctcgtggatggacagcagaacatagtttggtccaccaatgtttctgtccagtcaaataatacagcagcaatgctttcagatggtggaaagtttgttctacaagacaggaattctactgaagtatgggcaagctttgatgatccaactgatacaattctaccaaacatgaagataggactaaacaagagaacaggagagagacgagttttagtttcctggaaaaacaacaacgatccatcatcaggaaatttcaccactgcgattacatcagagactccgccacaacttctcacttcgaatggctccacctcttattggagaagtggacctctccagaacgatcctcagcagggaaccgcttatttctctgctgattttgataacaactcttttcttgcttatggcttcatttcacccggaggaattctagcactaatgatatgggattatggatccaatggttggttgaaaaagtgggcagcactgagcaccagttgtgacatttatggaacttgcggtccctttggcatctgcaactcaaaaaactctcctatctgccgttgcgtaaaagggtttatgccacaatcgaaagaagaatggaacagaaggaattggaccagggggtgcattagagaaacagaattgaactgccagaagaacacaagcaggtcgccttcaacgcagatgaagaaagatgtctttgtacacatgaaacagatgaaagtgcctgattctgcagaatatttatcagaccctggagatgtaggaaaatgccaaagctggtgcattaataattgttcttgcttggcttattcttatgtccacacgatagggtgtttggtctgggctaaagatctcatggattttcaggagttttcaacagctgggcaagatgtatatattcgggtcgcgcatgacaatacaggcatgtcaacagaagcaaaacttatcttcagcataagtaccatcctaggcatcatgttcgttggaactgctattttcggtctctggaagtggagagccagcaaaagagatcagctgaagcaaaaggacgcatccgaatttacactgttcagttttagtagcttacttcttgcaactaacaactttgatgcaacaaataaacttggccaaggagggtttggacccgtttataagggaatgctgaatgatggaaaggagatagctgtcaaaagactttccagtagctcaggccaaggcatggaggagtttgagaacgagattgttctaatatcgaaacttcagcaccgaaatctggtcagactcatgggatgctgtgtcgaaggagaagaaaagattttagtatacgaatacttgtcaaacaaaagtttagattcctttctgtttgattcaaaaaggaaagcagaattcaactgggatacacgtttccgcatcattcaagggatcgcaagtgggcttctatatctgcatcgcgattcttaccttcgagttatccatcgagatttgaaggcaagcaatattctcttggatgagaaaatgaacccaaaaatttcggactttgggttggcacggatcttcgaaggcactcaagttttgctaaatactcacaaagttgcaggaacactaggatatatgtctcctgagtacatcatgggagggatattttctgagaaatccgatatctatagctttggggtgttgctaattgagatcatcgctggcaaaaagaacacgagcttatactaccatggccagcatttcaatcttctttcctatgcatggcaattgtggagcgaagatagaggaccagacctaagggatgaagctatagttaatacttgtctgccatcagaagcaatgagatgcattcaggtggggcttctctgtgtgcaggaccaaatgacggaccgacccaacatgctatccgtagttcagatgctgagcagtgagtcagatcttcctcagccgagacctccaacgttcaccttccaaaggggaaatccaagtcacgataacgaggcacaaggggaaagtattttctccgtgaacaccatgacaaattctgtagtcgaaggaaga

SEQ ID NO: 794 - protein, 791 aa, Eucalyptus grandis
  Eucgr.B01365.1
MRLIIAWCSCLVFFFLLPARHIASGGVHNITTSEPLFQNQTLVSSGQIFELGFFTPNGSENQYVGIWYKNLTPSKTVWVANRDSPLTSADRSAKLTIGSDGNLKLVDGQQNIVWSTNVSVQSNNTAAMLSDGGKFVLQDRNSTEVWASFDDPTDTILPNMKIGLNKRTGERRVLVSWKNNNDPSSGNFTTAITSETPPQLLTSNGSTSYWRSGPLQNDPQQGTAYFSADFDNNSFLAYGFISPGGILALMIWDYGSNGWLKKWAALSTSCDIYGTCGPFGICNSKNSPICRCVKGFMPQSKEEWNRRNWTRGCIRETELNCQKNTSRSPSTQMKKDVFVHMKQMKVPDSAEYLSDPGDVGKCQSWCINNCSCLAYSYVHTIGCLVWAKDLMDFQEFSTAGQDVYIRVAHDNTGMSTEAKLIFSISTILGIMFVGTAIFGLWKWRASKRDQLKQKDASEFTLFSFSSLLLATNNFDATNKLGQGGFGPVYKGMLNDGKEIAVKRLSSSSGQGMEEFENEIVLISKLQHRNLVRLMGCCVEGEEKILVYEYLSNKSLDSFLFDSKRKAEFNWDTRFRIIQGIASGLLYLHRDSYLRVIHRDLKASNILLDEKMNPKISDFGLARIFEGTQVLLNTHKVAGTLGYMSPEYIMGGIFSEKSDIYSFGVLLIEIIAGKKNTSLYYHGQHFNLLSYAWQLWSEDRGPDLRDEAIVNTCLPSEAMRCIQVGLLCVQDQMTDRPNMLSVVQMLSSESDLPQPRPPTFTFQRGNPSHDNEAQGESIFSVNTMTNSVVEGR

SEQ ID NO: 795 - DNA, 2484 bp, Eucalyptus grandis
  Eucgr.B01621.1
atgcgactcataattgcttggtgctcttgcttggtcttcttcttcctacttccggcgagacatatagccagtggcgcggttcacaatattactacatcggagccgctctttcagaaccaaactctcgtctcctcaggccaaatcttcgagcttgggttcttcacgccgaatgggtcggaaaaccagtatgttggcatatggtacaagaacttgacgccttctaaaaccgtgtgggtggccaatagggattcgccactcacgtccgcagatcggtctgcgaaattagcgataggcagtgatgggaatttgaagctggtggatggacaacagaacatagtttggtccaccaatgtttctgtccagtcaaataatacagcagcaatgctttcagatggtggaaagtttgttctacaagagaggaattctactgaagtatgggcaagctttgatgatccaactgatacaattctaccaaacatgaagataggactaaacaagagaacaggagagagacgggttttagtttcctggaaaaacgacaacgatccatcatcgggaaatttcgccactgggattacatcagagactccaccgcaacttttctcttggaatggctcgaccccttattggagaagtggaccgtgggataaatcgacattcatcggcgtaccagaaatggaatcctcatactataacgggtacagtctccagcacgatcctcagcagggaaccgcttatttctctgctgattctgataacaactcttttcttgcttatggcttcatttcacccgaaggagttctagcactaatgttatggtattatggatccaatggttggtcaaaaaattgggcagcaccgagcaccggttgtgacatttatggaacttgcggtccctttggcatctgcaactcaaaaaactctcctatctgccgttgcgtaaaagggtttatgccacaatcgaaagaagaatggaacagaaggaattggaccagggggtgcattagagaaacagaattgaactgccagaagaacacaagcaggtcgccttcaacgcagatgaagaaagatgtctttgtacacacgaaacagatgaaagtgcctgattctgcagcatatttatcagaccctggagatgtaggaaaatgccaaagctggtgcatgaataattgttcttgcttggcttattcttatgtccaaacgatagggtgtttggtctgggctaaagatctcatggattttcaggagttttcaacagctgggcaagatgtatatattcgaatcgcgcatgacaatacaggcatgtcaacagaagcaaaacttatcatcagcataagtaccatcctaggcatcatgttcgttggaactgctattttcggtctctggaagtggagagccagcaaaagagatataactgataaaagaggagaaatgtcttttggaaatgcatggaaagatcagctgaagcaaaatgacgcatcccaattcaagctgttcagttttagtagcttaattcttgcaactaacaactttgatgcaacaaataaacttggccaaggagggtttggacccgtttataagggaatgctgaatgatggaaaggagatagctgtcaaaagactttccagtagctcaggccaaggcatggatgaatttaagaatgagatcattctaatatcgaaacttcagcatcgaaatctggtcagactcatgggctgctgcgtcgaaggagaagaaaagattttagtatacgaatacttgtcaaacaaaagcttagattcctttctgtttgattcaaaaaggaaagcagaactcaactgggatgcacgtttccacatcattcaagggattgcgagtgggctcctgtatctgcatcgcgattcttaccttcgagttatccatcgagatttgaaggcaagcaatattctcttggatgagaaaatgaacccaagaatttcggactttgggctggcgcggatcttcgaaggcactcaagttttgctaaatactcacaaagttgtaggaacaataggatatatgtctcctgagtacgtcatgggagggatattttctgagaaatccgatgtttatggctttggggtgttgctacttgagattgttgctggcaaaaagaacacgagcttatactaccgtggtcagcatttcaatctcctttcctatgcatggcaattgtggagcgaagatagaggaccagacctaagggatgaagctatagttaatacttgtccgccatcagaagcaatgagatgcattcaagtggggcttctctgtgtgcaggaccaaatgacggaccgacccaacatgctatccgtagttcggatgctgagcggtgagtcagatcttcatcagccgagacctccaacgttcaccttccaaaggggaaatccaagtcacaataacgaggcacaaggggaaagtattttctccgtgaacaccatgacgaattctgtggtcgaaggaaga

SEQ ID NO: 796 - protein, 828 aa, Eucalyptus grandis
  Eucgr.B01621.1
MRLIIAWCSCLVFFFLLPARHIASGAVHNITTSEPLFQNQTLVSSGQIFELGFFTPNGSENQYVGIWYKNLTPSKTVWVANRDSPLTSADRSAKLAIGSDGNLKLVDGQQNIVWSTNVSVQSNNTAAMLSDGGKFVLQERNSTEVWASFDDPTDTILPNMKIGLNKRTGERRVLVSWKNDNDPSSGNFATGITSETPPQLFSWNGSTPYWRSGPWDKSTFIGVPEMESSYYNGYSLQHDPQQGTAYFSADSDNNSFLAYGFISPEGVLALMLWYYGSNGWSKNWAAPSTGCDIYGTCGPFGICNSKNSPICRCVKGFMPQSKEEWNRRNWTRGCIRETELNCQKNTSRSPSTQMKKDVFVHTKQMKVPDSAAYLSDPGDVGKCQSWCMNNCSCLAYSYVQTIGCLVWAKDLMDFQEFSTAGQDVYIRIAHDNTGMSTEAKLIISISTILGIMFVGTAIFGLWKWRASKRDITDKRGEMSFGNAWKDQLKQNDASQFKLFSFSSLILATNNFDATNKLGQGGFGPVYKGMLNDGKEIAVKRLSSSSGQGMDEFKNEIILISKLQHRNLVRLMGCCVEGEEKILVYEYLSNKSLDSFLFDSKRKAELNWDARFHIIQGIASGLLYLHRDSYLRVIHRDLKASNILLDEKMNPRISDFGLARIFEGTQVLLNTHKVVGTIGYMSPEYVMGGIFSEKSDVYGFGVLLLEIVAGKKNTSLYYRGQHFNLLSYAWQLWSEDRGPDLRDEAIVNTCPPSEAMRCIQVGLLCVQDQMTDRPNMLSVVRMLSGESDLHQPRPPTFTFQRGNPSHNNEAQGESIFSVNTMTNSVVEGR

SEQ ID NO: 797 - DNA, 2229 bp, Eucalyptus grandis
  Eucgr.B01363.1
atgaatgcttggtgctcttgcttggtcttcatctttctactttcggcgagacacatagcgagcggcgcggttcacaatattaccacatcgaagccgctctttcagaaccaaactctcgtctcctcaggccaaatcttcgagcttgggttcttcatgccgaatgggtcggaaaaccattatgttggcatatggtacaagaacttgacgccttctaaaatcgtgtgggtggccaatagggattcgccactcacggccgcagatcagtctgcgaaattaacgataggcaataggataaacacgagaaccagagagagacgggttttagtttcctggaaaaacaacaacgatccatcatcgggaaatttcgccactgggattacgtcggagactccgccgcaacttttcacttggaatggctcgaccccttactggagaagtggaccatgggataaatcaacattcagcggcataccagaaatgcaatcctcatactctagctcgttcactctccagcaagatcctaagcagggaaccacctatttctctgccgatactgataacaactcttttcttgcttatgccttcatttcacccggaggaattctagcactaatgacatgggattatggatccaatagttggttgaaaaattctgcaacaccgagcaacagttgcgaagtttatggaacttgcagtccttttggcatctgcaactcaataaactctcctatctgccgttgcgtaaaagggtttacgccacaatcaaaagaaaaatggaacagagggatttggaccagggggtgcattagagaaacagaattgaattgccagaagaacacaagcaggtcgccttcaacgcaggtgaagaaagatgtctttgtacacatgaaccagatgaaagtgcctgattctgcggaatatttatcagacatcagagatgtaggaggatgccaaagctggtgcatgaataattgttcttgcttggcttattcttatgtccgcccaatagggtgtttggtctgggctaaagatctcatcgattttcaggagttttcgacagctgggcaagatgtatatattcgggtcgcacatgacaatacaggcatgtcgacagaagcaaaacttgtcatcagcataagtaccatcctgggcatcatgtttgttggaactgctattttcggtctctggaagtggagagccagcaaaagaggagaaatgtcacctggaaatgcatggaaagatcagctgaagcaaaaggacgcatccgaatttacgctgttcagttttagtagcttgcttcttgcaactaacaactttgatgcaacaaataaacttggccaaggagggtttggacccgtttttaagggaatgctgaatgatggaaaggagatagctgtcaaaagactttccagtagctcaggccaaggaagggatgagtttaagaatgagatcgttctaatatcgaaacttcagcatcgaaatctggtcagactcatgggctgccgcgtcgaaggagaagaaaagattttagtatacgaattcttgtcaaacaaaagcttagattcctttctgtttgattcaaaaaggaaagcagaactcaattgggatacacgtttccgcatcattcaagggattgcgagtgggctcctgtatctgcatcgcgattcttaccttcgagttatccatcgagatttgaaggcaagcaatgtgctcttggatgagaaaaagaacccaaaaatttcagactttggactggcgcggatcttcgaaggcactcaagttttgctaaatactcacaaagttgtaggaacactaggatatatgtctcctgagtacatcatgggagggatattttctgagaaatccgatgtttatagctttggggcattgctacttgagattgttgctggcaaaaataacacaagcttatactacacatggcaattgtggagcgaagatagaggactagacctaagggatgaagctatagttaatacttgtccgccatcagaagcaatgagatgcattcaggtggggcttctctgtgtgcaggaccaaatgacggaccgacccaacatgctatccgtagttcggatgctgagcggtgagtcagatcttcatcagctgagacctccaacgttcaccttccaaaggggaaatccaagtcacgataacgaggcacaaggggaaagtattttctctgtgaacaccatgacgaattctgtggtc

SEQ ID NO: 798 - protein, 743 aa, Eucalyptus grandis
  Eucgr.B01363.1
MNAWCSCLVFIFLLSARHIASGAVHNITTSKPLFQNQTLVSSGQIFELGFFMPNGSENHYVGIWYKNLTPSKIVWVANRDSPLTAADQSAKLTIGNRINTRTRERRVLVSWKNNNDPSSGNFATGITSETPPQLFTWNGSTPYWRSGPWDKSTFSGIPEMQSSYSSSFTLQQDPKQGTTYFSADTDNNSFLAYAFISPGGILALMTWDYGSNSWLKNSATPSNSCEVYGTCSPFGICNSINSPICRCVKGFTPQSKEKWNRGIWTRGCIRETELNCQKNTSRSPSTQVKKDVFVHMNQMKVPDSAEYLSDIRDVGGCQSWCMNNCSCLAYSYVRPIGCLVWAKDLIDFQEFSTAGQDVYIRVAHDNTGMSTEAKLVISISTILGIMFVGTAIFGLWKWRASKRGEMSPGNAWKDQLKQKDASEFTLFSFSSLLLATNNFDATNKLGQGGFGPVFKGMLNDGKEIAVKRLSSSSGQGRDEFKNEIVLISKLQHRNLVRLMGCRVEGEEKILVYEFLSNKSLDSFLFDSKRKAELNWDTRFRIIQGIASGLLYLHRDSYLRVIHRDLKASNVLLDEKKNPKISDFGLARIFEGTQVLLNTHKVVGTLGYMSPEYIMGGIFSEKSDVYSFGALLLEIVAGKNNTSLYYTWQLWSEDRGLDLRDEAIVNTCPPSEAMRCIQVGLLCVQDQMTDRPNMLSVVRMLSGESDLHQLRPPTFTFQRGNPSHDNEAQGESIFSVNTMTNSVV

SEQ ID NO: 799 - DNA, 2307 bp, Eucalyptus grandis
  Eucgr.B01366.1
atgaatgcttggtgctcttgcttggtcttcatcttcctactttcggcgagacacatagcgagcggcgcggttaacaatattaccacatcgaagccgctctttcagaaccaaactctcgtctcctcaggccaaatcttcgagcttgggttcttcatgccgaatgggtcggaaaaccattatgttggcatatggtacaagaacttgacgccttctaaaatcgtgtgggtggccaatagggattcgccactcacgtccgcagatcagtctgcgaaattaacgataggcagtgatgggaatttgaagctcgtggatggacaacagaacatagtttggtccaccaatgtttctgtccagtcaaattatacagcagcaatgcttttagatggtggaaaatttgttcttcatgacagtaattctattgaagtatgggcaagctttgatgatccaactgatacaattctaccacacatgaagataggactaaacactagaaccggagagagacgggttttagtttcctggaaaaacaacaacgatccatcatcgggaaatttcgccactaggattacgtcggagactccgccgcaacttttcacttggaatggctccaccccttactggagaagtggaccatgggataaatcaacattcagcggcataccagaaatgcaatcctcatactctagctcttggttgaaaaattctgcagcaccgagcaacagttgcgaagtttatggaacttgcggtccttttggcatctgcaactcaataaactctcctatctgccgttgcataaaagggtttacgccacaatcaaaagaagaatggaacagagggatttggaccagggggtgcattagagaaacagaattgaattgccagaagaacacaagcaggtcgccttcaacgcaggtgaagaaagatgtctttgtacacatgaaccagatgaaagtgcctgattctgcggaatatttatcagacatcagagatgtaggagcatgccaaagctggtgcatgaataattgttcttgcttggcttattcttatgtccgcccaatagggtgtttggtctgggctaaagatctcatcgattttcaggagttttcgacagctgggcaagatgtatatattcgggtcgcacatgacaatacaggcatgtcgacagaagcaaaacttctcatcagcataagtaccatcctgggcatcatgtttgttggaactgctattttcggtctctggaagtggagagccagcaaaagaggagaaatgtcacctggaaatgcatggaaagatcagctgaagcaaaaggacgcatccgaatttacgctgttcagttttagtagcttgcttcttgcaactaacaactttgatgcaacaaataaacttggccaaggagggtttggacccgtttataagggaatgctgaatgatggaaaggagatagctgtcaaaagactttccagtagctcaggccaaggaatggatgagtttaagaatgagatcgttctaatatcgaaacttcagcatcgaaatctggtcagactcatgggctgctgcgtcgaaggagaagaaaagattttagtatacgaatacttgtcaaacaaaagcttagattcctttctgtttggtcacgaattctttctctttcttccttgcttagattcaaaaaggaaagcagaactcaactgggatacacgtttccgcatcattcaagggattgcgagtgggctcctgtatctgcatcgcaattcttaccttcgagttatccatcgagatttgaaggcaagcaatattctcttggatgagaaaatgaacccaagaatttcggactttgggctggcgcagatcttcgaaggcactcaagttttgctaaatactcacaaagttgtaggaacactaggatatatgtctcctgagtacgtcatgggagggatattttctgagaaatccgatgtttatagctttggggtgttgctacttgagatcgttgctggcaaaaagaacacaagcttatactaccgtggccagcatttcaatcttctttcctatgcatggcaattgtggagcgaagatagaggaccagacctaagggatgaagctatagttaatacttgtccgccattagaagcaatgagatgcattcaggtggggcttctcttttggatgctgagcggtgagtcagatcttcatcagccgagacctccaacgttcaccttccaaaggggaaatccaagtcacgataaggaggcacaaggggaaagtattttctccgtgaacaccatgacgaattctgtggtcgaaggaaga

SEQ ID NO: 800 - protein, 769 aa, Eucalyptus grandis
  Eucgr.B01366.1
MNAWCSCLVFIFLLSARHIASGAVNNITTSKPLFQNQTLVSSGQIFELGFFMPNGSENHYVGIWYKNLTPSKIVWVANRDSPLTSADQSAKLTIGSDGNLKLVDGQQNIVWSTNVSVQSNYTAAMLLDGGKFVLHDSNSIEVWASFDDPTDTILPHMKIGLNTRTGERRVLVSWKNNNDPSSGNFATRITSETPPQLFTWNGSTPYWRSGPWDKSTFSGIPEMQSSYSSSWLKNSAAPSNSCEVYGTCGPFGICNSINSPICRCIKGFTPQSKEEWNRGIWTRGCIRETELNCQKNTSRSPSTQVKKDVFVHMNQMKVPDSAEYLSDIRDVGACQSWCMNNCSCLAYSYVRPIGCLVWAKDLIDFQEFSTAGQDVYIRVAHDNTGMSTEAKLLISISTILGIMFVGTAIFGLWKWRASKRGEMSPGNAWKDQLKQKDASEFTLFSFSSLLLATNNFDATNKLGQGGFGPVYKGMLNDGKEIAVKRLSSSSGQGMDEFKNEIVLISKLQHRNLVRLMGCCVEGEEKILVYEYLSNKSLDSFLFGHEFFLFLPCLDSKRKAELNWDTRFRIIQGIASGLLYLHRNSYLRVIHRDLKASNILLDEKMNPRISDFGLAQIFEGTQVLLNTHKVVGTLGYMSPEYVMGGIFSEKSDVYSFGVLLLEIVAGKKNTSLYYRGQHFNLLSYAWQLWSEDRGPDLRDEAIVNTCPPLEAMRCIQVGLLFWMLSGESDLHQPRPPTFTFQRGNPSHDKEAQGESIFSVNTMTNSVVEGR

SEQ ID NO: 801 - DNA, 2391 bp, Eucalyptus grandis
  Eucgr.B01614.1
atggttcacaatattactacatcgaagccgctctttcagaaccaaactctcgtctcctcaggccaaatctttgagcttgggttcttcacgccgaatgggtcggaaaaccagtatgttggcatatggtacaagaacttgaagccttctaaaaccgtgtgggtggccaatagggattcgccgctcatgtccgcagatcggtctgcgaaattaacgataggcagtgatgggaatttgaagctcgtggatggacaacagaacatagtttggtccaccaatgtttctgtccagtcaaataatacagcagcaatgctttcagatggtggaaagtttgttctacaagacaggaattctactgaagtatgggcaagctttgatgatccaactgatacaattctaccacacatgaagataggactaaacacgagaaccggagagagacgggttttagtttcctggaaaaacaacaacgatccatcatctggaaatttcaccactgggattacgttggagactccgccgcaacttttctcttggaatggctcgaccccttattggagaagtggaccgtgggataaatcgacatttagtggcataccagaaatgcaatcctcatactatagctcgttcactctccagcaagatcccaagcagggaaccacttatttctctgccgatactgataacaactcttttcttgcttatgccttcatttcacccggaggaattctagcactaatgacatgggattatggatccaatagttggttgaaaaattctgcagcaccaagcaacagttgcgaagtttatggaacttgcggtccttttggcatctgcaactcaataaactctcctatctgccattgcgtaaaggggtttacgccacgatcaaaagaagattggaacagagggatttggactggggggtgcattagagaaacagaattgaattgccagaagaacacaagcaggtcgccttcaacgcaggtgaagaaagatgtctttgtacacatgaaccagatgaaagtgcctgattctgcggaatatttatcagacatcagagatgtaggaggatgccaaagctggtgcatgaataattgttcttgcttggcttattcttatgtccgcccaatagggtgtttggtctgggctaaagatctcattgattttcaggagttttcaacagcagggcaagatgtatatattcgggtcgcacatgacaatacaggcatgtcgacagaagcaaaacttatcatcagcataactaccatcttgggcatcatgtttgttggaactgctattttcagtctctggaagtggagagccagcaaaagaggagaaatgtctcttggaaatgcatggaaagatcagctgaagcaaaaggacacatctgaatttactctgttcagttttagtagcttacttcttgcaactaacaactttgatgcaacaaataaacttggccaaggagggtttggacctgtttataagggaatgctgaatgatggaaagcagatagctgtcaaaagactttccagtagctcaggccaaggcatggatgagtttaagaatgagatcgttctaatatcgaaacttcagcatcgaaatttggtcagactcatgggctgctgcgtcaaaggagaagaaaagattttagtatacgaatacttgtcaaacaaaagcttagattcctttctgtttgattcacaaaggaaagcagaactcaactgggatacacgtttccgcatcatttcagggattgcgagtgggcttttgtatctgcatcgtgattcttaccttcgagttatccatcgagatttgaaggcaagcaatattctcttggatgagaaaatgaacccaagaatttcggactttgggctagcgcggatcttcgaaggcactcaagttttgctaaatactcacaaagttgtaggaacactaggatatatgtctcctgagtacgtcatgggagggatattttctgagaaatccgatgtttatagctttggggtgttgctacttgagatcgttgctggcaagaagaacacaagcttatactaccgtggccagcatttcaatttgctttcctatgcatggcaattgtggagcgaagatagaggaccagacctaagggatgaagctatagttaatacttgtccgccatcagaagcaatgagatgcattcaggtggagcttctctgtgtgcaggaccaaatgacggaccgacccaacatgctatttgtagttcggatgctgagcggtgagtcggatcttcctcagccgagacctcctacattcaccttccaaaggggaaatccaagtcacgataacgaggcacaaggggaaagtattttctccgtgaacaccatgacgaattctgtggtcgaaggaaga

SEQ ID NO: 802 - protein, 797 aa, Eucalyptus grandis
  Eucgr.B01614.1
MVHNITTSKPLFQNQTLVSSGQIFELGFFTPNGSENQYVGIWYKNLKPSKTVWVANRDSPLMSADRSAKLTIGSDGNLKLVDGQQNIVWSTNVSVQSNNTAAMLSDGGKFVLQDRNSTEVWASFDDPTDTILPHMKIGLNTRTGERRVLVSWKNNNDPSSGNFTTGITLETPPQLFSWNGSTPYWRSGPWDKSTFSGIPEMQSSYYSSFTLQQDPKQGTTYFSADTDNNSFLAYAFISPGGILALMTWDYGSNSWLKNSAAPSNSCEVYGTCGPFGICNSINSPICHCVKGFTPRSKEDWNRGIWTGGCIRETELNCQKNTSRSPSTQVKKDVFVHMNQMKVPDSAEYLSDIRDVGGCQSWCMNNCSCLAYSYVRPIGCLVWAKDLIDFQEFSTAGQDVYIRVAHDNTGMSTEAKLIISITTILGIMFVGTAIFSLWKWRASKRGEMSLGNAWKDQLKQKDTSEFTLFSFSSLLLATNNFDATNKLGQGGFGPVYKGMLNDGKQIAVKRLSSSSGQGMDEFKNEIVLISKLQHRNLVRLMGCCVKGEEKILVYEYLSNKSLDSFLFDSQRKAELNWDTRFRIISGIASGLLYLHRDSYLRVIHRDLKASNILLDEKMNPRISDFGLARIFEGTQVLLNTHKVVGTLGYMSPEYVMGGIFSEKSDVYSFGVLLLEIVAGKKNTSLYYRGQHFNLLSYAWQLWSEDRGPDLRDEAIVNTCPPSEAMRCIQVELLCVQDQMTDRPNMLFVVRMLSGESDLPQPRPPTFTFQRGNPSHDNEAQGESIFSVNTMTNSVVEGR

SEQ ID NO: 803 - DNA, 1989 bp, Eucalyptus grandis
  Eucgr.B01620.1
atgagaatttttcaatcaagtggaatcacccacaatttgatcacatatctcagtcgaatcgacctatcttcgatttctgatcgatctttgacgctgtcacaacttttctcttggaatggctcgaccccttattggagaagtggaccgtgggataaatcgacattcagcggcataccaaaactgcaatcctcatactatagctcgttcactctcgagcaagatcctaagcagggaaccacttatttctctgccgatactgataacaactcttttcttgcttatgccttcatttcacccggaggaattctagcactaatgacatgggattatggatccaatagttggttgaaaaatgtcacagtaccgagcagcatttgcggagtttatggaacttgcggtccttttggcgtctgcaactcaataagccctcctatctgccattgcgtaaaagggtttacgccgcggtcaaaagaagaatggaacatagggatttggaccggggggtgcattagagaaacagaattgaactgccagaagaacacaagcaggtcgccttcaacgcaggtgaagaaagatgtctttgtacacatgaaccagatgaaagtgcctgattctgcggaatatttatcagacatcagagatgtaggaggatgccaaagctggtgcatgaataattgttcttgcttggcttattcttatgtccgcccaatagggtgtttggtctgggctaaagatctcatcgattttcaagagttttcaacagcagggcaagatgtatatattcgggtcgcacatgacaatacaggcatgtcgacagaagcaaaactaatcatcagcataagtaccatcctgggaatcatgtttgttggaactgctattttcggtctctggaagtggagagccagcaaaagagatataactgataaaacgggagaaatgtctcctggaaatgcatggaaagatcagctgaagcaaaagggcgcatccgaatttacgctgttcagttttagtagcttacttcttgcaactaacaactttgatgcaacaaataaacttggccaaggagggtttggacccgtttttaagggaatgctgaatgatggaaaggagatagctgtcaaaagactttccagtagctcaggccaaggcatggatgagtttaagaatgagatcgttctaatatcgaaacttcagcatcgaaatctggtcagactcatgggctgctgcgtcgaaggagaagaaaagattttagtatacgaatacttgtcaaacaaaagcttagattcctttctgtttgattcaaaaaggaaagcagaactcaactgggatacacgttttcgcatcattcaagggattgcgagtgggctcctgtatctgcatcgcgattcttaccttcgagttatccatcgagatttgaaggcaagcaatattctcttggatgagaaaatgaacccaagaatttcggactttgggctggcgcggatcttcgaaggcactcaagttttgctaaatactcacaaagttgtaggaacactaggatatatgtctcctgagtacatcatgggagggatattttctgagaaatccgatgtttatagctttggggtgttgctacttgagatcgttgtcggcaaaaagaacacgagcttatactaccgtggccagcatttcaatcttctttcctatgcatggcaactgtggagtgaagatagaggaccagacctaagggatgaagctatagttaatacttgtccgccatcagaagcaatgagatgcattcaggtggggcttctctgtgtgcaggaccaaatgacggacctacccaacatgctatccgtagttcggatgctgagcggtgagtcagatcttcctcagccgagacctccaacgttcaccttccaaaggggaaatccaagtcaagataaggaggcacaaggggaaagtattttttccatgaacaccatgacgaattctgtggtggaaggaaga

SEQ ID NO: 804 - protein, 663 aa, Eucalyptus grandis
  Eucgr.B01620.1
MRIFQSSGITHNLITYLSRIDLSSISDRSLTLSQLFSWNGSTPYWRSGPWDKSTFSGIPKLQSSYYSSFTLEQDPKQGTTYFSADTDNNSFLAYAFISPGGILALMTWDYGSNSWLKNVTVPSSICGVYGTCGPFGVCNSISPPICHCVKGFTPRSKEEWNIGIWTGGCIRETELNCQKNTSRSPSTQVKKDVFVHMNQMKVPDSAEYLSDIRDVGGCQSWCMNNCSCLAYSYVRPIGCLVWAKDLIDFQEFSTAGQDVYIRVAHDNTGMSTEAKLIISISTILGIMFVGTAIFGLWKWRASKRDITDKTGEMSPGNAWKDQLKQKGASEFTLFSFSSLLLATNNFDATNKLGQGGFGPVFKGMLNDGKEIAVKRLSSSSGQGMDEFKNEIVLISKLQHRNLVRLMGCCVEGEEKILVYEYLSNKSLDSFLFDSKRKAELNWDTRFRIIQGIASGLLYLHRDSYLRVIHRDLKASNILLDEKMNPRISDFGLARIFEGTQVLLNTHKVVGTLGYMSPEYIMGGIFSEKSDVYSFGVLLLEIVVGKKNTSLYYRGQHFNLLSYAWQLWSEDRGPDLRDEAIVNTCPPSEAMRCIQVGLLCVQDQMTDLPNMLSVVRMLSGESDLPQPRPPTFTFQRGNPSQDKEAQGESIFSMNTMTNSVVEGR

SEQ ID NO: 805 - DNA, 2502 bp, Eucalyptus grandis
  Eucgr.E03453.1
atgcggctcatgatttcttggtgctcttgcttggtcatcttctgccttctgcaggcaagtcataggaccagcggtgtagcttacaatattactccatcggagccgctctttccgaaccaaactcttgtctcctctggcaatatattcgagcttgggttcttcacgctgagcgggtcagaaaatcagtatattggcatacggtacaagaacttgacgccttctaagattgtgtgggtggccaatagggaacagccacttccgtacacggatcggtctgcaaaattaacgataggcagtgatgggaatttgaagctcatggatggacaagaaaatatagtttggtctaccaatgtctctagtcggtccaattatacgttggcggtgctattagatagtgggaattttgttctgcaagatggcatttatggcgaaatatggggaagcttcgaggatccgacagacactcttcttccaacaatgaagataggagtaaatgtcaggactggagtgaaaaagttcttaatttcctggagaagcgacagtgatccattccctggaagtttctcgactggaatgacatccgagacgccgcctcaagctttcacttggaatggtttgaccccttactggagaggcgggcaatgggacaaatcgaaatttatcggcatagcaaccatggaccaatcatactcgagtggcttcactgtccagcaggatactcaaaagggaaccacttactattcggtaaatagatacgatatctttctatacatgttcatttctcccggaggatctctcacgataatgtactgggatgatggagctagggcatggttgatggattgggcagcaccgaacaatacttgtgagatttatggaacttgtggtccatttggagtttgtaactcattgaattcgcctatttgcagatgcatagatgggtttgtgccaaagtcaaatgaagaatggaacagtttaaactggaccagaggatgtgaaagagagatggaattgaattgccagaaaaacacaagcacatcgacttatacaaatgtaaagaaagatgcattttggcaaatgagccagatgaaactacccgactctgggaactatatatcagacattggagatgaagaagaatgtgaaagctggtgccggagcaattgttcttgcttggcttattcttacgtcagcaccattggatgcatggtttggagtaaagacctcattgatcttcaggaatttcccacagctggggaagatctatttgttcgagttgcacatgtaaaagcaggaggatcgcgacacaaagcagttatcatcagcctgagtactattgcagggattattttctttgcagtatttgtttttgttctttgcaaatggagagctaacaaaacaggaaactttcgaaggctccttgactcagcagatacacctgaaaaatcgaccgagctgacacaaggaaatgcatggcaaaagcagttgaagcaagatgattcactggaattgaccctttatagttttgatagcatactacttgctacaaacaagttcagcacgacaagtaaactcgggcaaggagggtttggctctgtttataaggggaagctgaaagatgggaaagaggtagctgtgaaaagactttccagtacctcagcccaaggcgttgaagagttcaagaatgagatcatccttatatcgaaactccagcatcgaaatcttgttaaactcgtgggttactgcattgaaggagaagaaaagattttggtatatgagtacttgtcgaataaaagcttggacacctttctttttgattcaagaaagaaggcagaacttgactggggcaaacgatttcaaataattcaggagattgcaagggggctgctctacctccatcgagattcttgccttagggtcatacatcgagacttgaaagtaagcaacattctcttggatgaaaagatgaacccgaaaatttcagattttgggctagcacgaatgtttgagggcactcaagttttggtgaacactcaaaaaattgttggaacacttggctatatgtctcctgagtacgccatgggtggaatattttccgagaggtccgatgtctatagctttggagtgttgctacttgagatagtaagcggcaaaaagaacacggccctgtatgaccagggacatctgaatctcctttcctacgcatggcaattgtggagtgatggcaaagcattggacctaacggatgtagcaatggctgttagctctcatttggaggtaacgagatgcatccatgttgggcttctctgtgttcaggaccatgccacggatagaccaaacatgtcgaatgtggttctgatgttaagtggcgagtcagatcttcctcagccgaggcagcctatattcactttccaagctgaaatgccaaatcgttctattccatcacagcaagaaagcatccggtctgttaacactatcactaatacagtggtcgaaggaaga

SEQ ID NO: 806 - protein, 834 aa, Eucalyptus grandis
  Eucgr.E03453.1
MRLMISWCSCLVIFCLLQASHRTSGVAYNITPSEPLFPNQTLVSSGNIFELGFFTLSGSENQYIGIRYKNLTPSKIVWVANREQPLPYTDRSAKLTIGSDGNLKLMDGQENIVWSTNVSSRSNYTLAVLLDSGNFVLQDGIYGEIWGSFEDPTDTLLPTMKIGVNVRTGVKKFLISWRSDSDPFPGSFSTGMTSETPPQAFTWNGLTPYWRGGQWDKSKFIGIATMDQSYSSGFTVQQDTQKGTTYYSVNRYDIFLYMFISPGGSLTIMYWDDGARAWLMDWAAPNNTCEIYGTCGPFGVCNSLNSPICRCIDGFVPKSNEEWNSLNWTRGCEREMELNCQKNTSTSTYTNVKKDAFWQMSQMKLPDSGNYISDIGDEEECESWCRSNCSCLAYSYVSTIGCMVWSKDLIDLQEFPTAGEDLFVRVAHVKAGGSRHKAVIISLSTIAGIIFFAVFVFVLCKWRANKTGNFRRLLDSADTPEKSTELTQGNAWQKQLKQDDSLELTLYSFDSILLATNKFSTTSKLGQGGFGSVYKGKLKDGKEVAVKRLSSTSAQGVEEFKNEIILISKLQHRNLVKLVGYCIEGEEKILVYEYLSNKSLDTFLFDSRKKAELDWGKRFQIIQEIARGLLYLHRDSCLRVIHRDLKVSNILLDEKMNPKISDFGLARMFEGTQVLVNTQKIVGTLGYMSPEYAMGGIFSERSDVYSFGVLLLEIVSGKKNTALYDQGHLNLLSYAWQLWSDGKALDLTDVAMAVSSHLEVTRCIHVGLLCVQDHATDRPNMSNVVLMLSGESDLPQPRQPIFTFQAEMPNRSIPSQQESIRSVNTITNTVVEGR

SEQ ID NO: 807 - DNA, 2055 bp, Eucalyptus grandis
  Eucgr.E03453.2
atgcggctcatgatttcttggtgctcttgcttggtcatcttctgccttctgcaggcaagtcataggaccagcggtgtagcttacaatattactccatcggagccgctctttccgaaccaaactcttgtctcctctggcaatatattcgagcttgggttcttcacgctgagcgggtcagaaaatcagtatattggcatacggtacaagaacttgacgccttctaagattgtgtgggtggccaatagggaacagccacttccgtacacggatcggtctgcaaaattaacgataggcagtgatgggaatttgaagctcatggatggacaagaaaatatagtttggtctaccaatgtctctagtcggtccaattatacgttggcggtgctattagatagtgggaattttgttctgcaagatggcatttatggcgaaatatggggaagcttcgaggatccgacagacactcttcttccaacaatgaagataggagtaaatgtcaggactggagtgaaaaagttcttaatttcctggagaagcgacagtgatccattccctggaagtttctcgactggaatgacatccgagacgccgcctcaagctttcacttggaatggtttgaccccttactggagaggcgggcaatgggacaaatcgaaatttatcggcatagcaaccatggaccaatcatactcgagtggcttcactgtccagcaggatactcaaaagggaaccacttactattcggtaaatagatacgatatctttctatacatgttcatttctcccggaggatctctcacgataatgtactgggatgatggagctagggcatggttgatggattgggcagcaccgaacaatacttgtgagatttatggaacttgtggtccatttggagtttgtaactcattgaattcgcctatttgcagatgcatagatgggtttgtgccaaagtcaaatgaagaatggaacagtttaaactggaccagaggatgtgaaagagagatggaattgaattgccagaaaaacacaagcacatcgacttatacaaatgtaaagaaagatgcattttggcaaatgagccagatgaaactacccgactctgggaactatatatcagacattggagatgaagaagaatgtgaaagctggtgccggagcaattgttcttgcttggcttattcttacgtcagcaccattggatgcatggtttggagtaaagacctcattgatcttcaggaatttcccacagctggggaagatctatttgttcgagttgcacatgtaaaagcaggaggatcgcgacacaaagcagttatcatcagcctgagtactattgcagggattattttctttgcagtatttgtttttgttctttgcaaatggagagctaacaaaacaggaaactttcgaaggctccttgactcagcagatacacctgaaaaatcgaccgagctgacacaaggaaatgcatggcaaaagcagttgaagcaagatgattcactggaattgaccctttatagttttgatagcatactacttgctacaaacaagttcagcacgacaagtaaactcgggcaaggagggtttggctctgtttataaggggaagctgaaagatgggaaagaggtagctgtgaaaagactttccagtacctcagcccaaggcgttgaagagttcaagaatgagatcatccttatatcgaaactccagcatcgaaatcttgttaaactcgtgggttactgcattgaaggagaagaaaagattttggtatatgagtacttgtcgaataaaagcttggacacctttctttttgattcaagaaagaaggcagaacttgactggggcaaacgatttcaaataattcaggagattgcaagggggctgctctacctccatcgagattcttgccttagggtcatacatcgagacttgaaagtaagcaacattctcttggatgaaaagatgaacccgaaaatttcagattttgggctagcacgaatgtttgagggcactcaagttttggtgaacactcaaaaaattgttggaacactg

SEQ ID NO: 808 - protein, 685 aa, Eucalyptus grandis
  Eucgr.E03453.2
MRLMISWCSCLVIFCLLQASHRTSGVAYNITPSEPLFPNQTLVSSGNIFELGFFTLSGSENQYIGIRYKNLTPSKIVWVANREQPLPYTDRSAKLTIGSDGNLKLMDGQENIVWSTNVSSRSNYTLAVLLDSGNFVLQDGIYGEIWGSFEDPTDTLLPTMKIGVNVRTGVKKFLISWRSDSDPFPGSFSTGMTSETPPQAFTWNGLTPYWRGGQWDKSKFIGIATMDQSYSSGFTVQQDTQKGTTYYSVNRYDIFLYMFISPGGSLTIMYWDDGARAWLMDWAAPNNTCEIYGTCGPFGVCNSLNSPICRCIDGFVPKSNEEWNSLNWTRGCEREMELNCQKNTSTSTYTNVKKDAFWQMSQMKLPDSGNYISDIGDEEECESWCRSNCSCLAYSYVSTIGCMVWSKDLIDLQEFPTAGEDLFVRVAHVKAGGSRHKAVIISLSTIAGIIFFAVFVFVLCKWRANKTGNFRRLLDSADTPEKSTELTQGNAWQKQLKQDDSLELTLYSFDSILLATNKFSTTSKLGQGGFGSVYKGKLKDGKEVAVKRLSSTSAQGVEEFKNEIILISKLQHRNLVKLVGYCIEGEEKILVYEYLSNKSLDTFLFDSRKKAELDWGKRFQIIQEIARGLLYLHRDSCLRVIHRDLKVSNILLDEKMNPKISDFGLARMFEGTQVLVNTQKIVGTL

SEQ ID NO: 809 - DNA, 2469 bp, Eucalyptus grandis
  Eucgr.G01877.1
gcaagtcatacagcctgcggtgcgggttacaatcttactacatcaaagccgctctttctgaaccaaactctcatctcccctggccaaatcttcgagcttgggttcttcacgccgaacgggtctgaaaatcagtatgttggcatatggtacaagaacttcacaccttctaaaatagtgtgggtggccaataggtatgtaccgcttgtgtacacagatagatctgcgaaattaacgataggcagtgatgggaatttgaagctcgtggatggacaacagagtacagtttggtctacgaatgtctctggtctgtccaattatatgtcagcgaccctattagataatgggaattttgttctgcaagacgcaaattatagtaaaatatggggaagcttcgaggatccaacagacactcttcttccgagcatgaagtcggaagtaaatgtcaggactggagtgaaacagtatttaatttcctggagaagtgacagtgatccctcccctggaagtttcttgactggaatgtcgtcagagatgccgcctcaggctttcacttggattggttcgacccctcactggagaggcgggcaatgggacaaatcgaaatttatcggcatagaagacatggaccaaacgtacttgagtgggtactttgtccagcaagatattcagcagggtaccacttacttttggatagatacttacaacagctcgttctttgcatacatgttcatttcgcctggaggatctcttaagttggtgtactgggatgatggagctaaggcgtggttgacgtattggacgggaccaaacaatacttgcgagatttatggaacttgtggtccttttggagtttgtaactcatcaaattcgcctatttgcaaatgcataaatgggtttgtgccaaagtcaaatgaggaatggaataggggaaactggaccggaggatgtgtaagagagacagaattgaattgccaccaaaacacaagcacatcggcttcaacaaatgtaaagaatgataccatttggcaaatgagccagatgaaactacccgactctggggactatttgttaggcgttggagatcaagaatgtgtaagctggtgccagagcaattgttcttgcttggcttattcttatgtcagcaccatcgggtgtatggtttggactaaaggcctcatcgatcttcaggaattttccaccagcggggaagatctatttgttcgagttgcatatgtagaaacaggtggctcatcagattcatcaaacaaagcaggatcatcagattcatcacacaaagcaggatcatcagattcatcacacaaagcagttagcatcagcctgagtactattgccgggatcatgttctttgccgtattgatttttggtctttacaagtggagagctaggaaaagaggtgaactggtacaaggaaacgcatggaaagataagttgaagaatgatgattctctggatttgacccttttcagttttgatagcatactactagctacaaacaagttcagcatgacaagtaaactcggccaaggagggtttggctccgtttacaagggaaagctgaatgatgggaaagaggtagctgtgaaaagactttctagtagctcggcccaaggggttgaagagttcaagaacgagattgtccttatatcgaaactccaacatcgaaatcttgttaaactcatgggctactgcattgaaggagaagaaaagattctggtgtacgagtacctgtcgaacaaaagcttggacacctttctttttgattcaagaaagaaggcagaactcgattggggaaaacgatttcgaattattcaggggattgcaagggggcttctctacctccatcgagattcttgcctcagggtcatacatcgagacttgaaagtgagcaatattctcttggatgaaaagatgaacccaaaaatttcggattttgggctggcccgaatgtttgagggcactcaagttttggtgaacactcacaaaattgtgggaacacttggctatatgtctcctgagtatgccatgggcggaatgttttcagagaagtccgatgtctatggctttggagtgttactactggagattgttagcggcaaaaagaacacggccctatatgaccagggacaatatctcaatctcctttccttcgcatggcatttatggagtacggggagagcattggacctactggatgaaacaattgccgttagctctccgttggagataacaagatgcatccatatggcgcttctctgtgttcaggaccacaccatggatagaccgaacatgtccgatgtggttctgatgctaagcggtgaatcagatcttcctcagcctagacagcctacattcactttccaaactgaaatgccaaatggtggtattcgaccacagcaagaaagcatctggtctgtcaacaatgtcaccgacacgacgatcgaaggaaga

SEQ ID NO: 810 - protein, 823 aa, Eucalyptus grandis
  Eucgr.G01877.1
ASHTACGAGYNLTTSKPLFLNQTLISPGQIFELGFFTPNGSENQYVGIWYKNFTPSKIVWVANRYVPLVYTDRSAKLTIGSDGNLKLVDGQQSTVWSTNVSGLSNYMSATLLDNGNFVLQDANYSKIWGSFEDPTDTLLPSMKSEVNVRTGVKQYLISWRSDSDPSPGSFLTGMSSEMPPQAFTWIGSTPHWRGGQWDKSKFIGIEDMDQTYLSGYFVQQDIQQGTTYFWIDTYNSSFFAYMFISPGGSLKLVYWDDGAKAWLTYWTGPNNTCEIYGTCGPFGVCNSSNSPICKCINGFVPKSNEEWNRGNWTGGCVRETELNCHQNTSTSASTNVKNDTIWQMSQMKLPDSGDYLLGVGDQECVSWCQSNCSCLAYSYVSTIGCMVWTKGLIDLQEFSTSGEDLFVRVAYVETGGSSDSSNKAGSSDSSHKAGSSDSSHKAVSISLSTIAGIMFFAVLIFGLYKWRARKRGELVQGNAWKDKLKNDDSLDLTLFSFDSILLATNKFSMTSKLGQGGFGSVYKGKLNDGKEVAVKRLSSSSAQGVEEFKNEIVLISKLQHRNLVKLMGYCIEGEEKILVYEYLSNKSLDTFLFDSRKKAELDWGKRFRIIQGIARGLLYLHRDSCLRVIHRDLKVSNILLDEKMNPKISDFGLARMFEGTQVLVNTHKIVGTLGYMSPEYAMGGMFSEKSDVYGFGVLLLEIVSGKKNTALYDQGQYLNLLSFAWHLWSTGRALDLLDETIAVSSPLEITRCIHMALLCVQDHTMDRPNMSDVVLMLSGESDLPQPRQPTFTFQTEMPNGGIRPQQESIWSVNNVTDTTIEGR

SEQ ID NO: 811 - DNA, 2511 bp, Eucalyptus grandis
  Eucgr.E03632.1
atgaacgtgtggtcttccgaaaaccattgtgtttcagccccctttgagctccaaggcctctcgcctcacgggaaagctcgttcatctatccttgatcgacagaaagtgcagaatcaaccgacccaccgaactcaccaggttcattcattcattcttattatgcggctcatgatgtcttggtggtcttgcttggtcgtcgtctttctacttcaggtaagtcatggaaccagcggttcggcttactatattactgcatcggagccactatttccgaaccaaaccctcgtctcctctggcaaaatcttcgagcttgggttctttacgccaaacgggtcagcaaatcagtatgttgggatatggtacaagaacttggcgcctccaaaaatcgtgtgggtggccaacagggaattgccgcttgtgtacccagatccgtctgcgaaattaatgataggcagtgatgggaatttgaaactcgtggatggaaaacagaatatattttggtctaccaatgccactagtcagtccaattataggtcagcggcgctattagataatggaaattttgtactgcaggatgcaaattatagtaaattatggggaagcttcgatgatccaacagatactcttcttccgggcatgaagatgggagtaaatgccaggactggggagaaactctatttaatttcctggagaagcgacagtgatccgtcccctggaaggttcttgactgggataacatcggagacgccgcctcaacctttcacttggaatggttccaccccttactggagaggcggacaatgggacaaatcgaaatttatcggcataaaaaacatggtccgatcgtactcgagtgcattcaatgtcgagcaagatattcagcaggggaccacttacttatctttttatttacacaagcatacttatacatacatgtctgttttgcctggaggattgcttaagataatgtactgggatgatggagctaagtcaaatgaggaatggaacagtggaaactggaccggaggatgtgtaagagagacagaattgtattgccagaaaaacacaagcacatcggcttcaacaattgtaaagaaagatgccttttggcaaatgagccggatgaaactacctgactctgaggattatttatcagacattggagatcaaggaggatgtttaagctggtgcctaagcaactgttcttgcttggcttattcttatgtcagcaccatcgggtgtatggtttggactaaagaaaacctcatcgatcttgaggaattttccacagatggagaaaatctatttgttcgagttgcacacgtaaaaacaggaggatcgttgcagaaagccgttgtcatcagcctgagtactgttgctgggatcctgttctttgcagtatttgtatttggtctttgcaaatggagagctaagaaaagaggtaaacctgaaaagccgggcaaactgctacaaggaaatgcatggaaagagcaattgaaggaagatgatgcactggaattgactgttttcagttttgatagcatactacttgctacaaacaagttcagcacgacaagtaaactcgggcaaggagggtttggctctgtttacaagggaaagatgaatgatgggaaagaggtagctgtgaaaagactttctagtagctcggcccaaggtgttcaagagttcgagaatgagatagtcctaatatcaaaactccaacatcgaaatctggttaaactcattggttgctgcaatgaaggagatgaaaaaattttggtatacgagtacttgccaaacaaaagcttggactcctttctttttgattcaaaaaagaaggtagaactcaaatggggcaaacgattccaaatcattgagggaattgcaagggggctcctctacctccatcgagattcttgccttagggtcatacaccgtgacttaaaagtgagcaatattctcttggatgaaaagatgaacccaaaaatttcagattttgggctggcacgaatgttcgagggcactcaaattttggtgaacactcacaaaattgttggaacctttggttatatgtctcctgagtacgctatgggcggaatattttccgaggggtctgatgtgtatagcttcggagtgttgctactggagattgttagtggcagaaagaactcagccctgtatgatcagggatatctcaatctcctttcctacgcatggcaattatggagtgaagaaaaagcattggacctactggatgaagcaattgctgttagctttccattggaggtaataagatgcatccacattgggcttctctgtgtccaggaccatgctatggatagaccaaacatgacgaatgtggttctaatgctaagcggtgaatcagatcttcctcggccaagacagcctatattcactttccaaactgaaatgcgaaatcacgctattccaccgcaacaacaaagcatttggtctgttaacactgtcactaatacaatggtcgaaggaaga

SEQ ID NO: 812 - protein, 837 aa, Eucalyptus grandis
  Eucgr.E03632.1
MNVWSSENHCVSAPFELQGLSPHGKARSSILDRQKVQNQPTHRTHQVHSFILIMRLMMSWWSCLVVVFLLQVSHGTSGSAYYITASEPLFPNQTLVSSGKIFELGFFTPNGSANQYVGIWYKNLAPPKIVWVANRELPLVYPDPSAKLMIGSDGNLKLVDGKQNIFWSTNATSQSNYRSAALLDNGNFVLQDANYSKLWGSFDDPTDTLLPGMKMGVNARTGEKLYLISWRSDSDPSPGRFLTGITSETPPQPFTWNGSTPYWRGGQWDKSKFIGIKNMVRSYSSAFNVEQDIQQGTTYLSFYLHKHTYTYMSVLPGGLLKIMYWDDGAKSNEEWNSGNWTGGCVRETELYCQKNTSTSASTIVKKDAFWQMSRMKLPDSEDYLSDIGDQGGCLSWCLSNCSCLAYSYVSTIGCMVWTKENLIDLEEFSTDGENLFVRVAHVKTGGSLQKAVVISLSTVAGILFFAVFVFGLCKWRAKKRGKPEKPGKLLQGNAWKEQLKEDDALELTVFSFDSILLATNKFSTTSKLGQGGFGSVYKGKMNDGKEVAVKRLSSSSAQGVQEFENEIVLISKLQHRNLVKLIGCCNEGDEKILVYEYLPNKSLDSFLFDSKKKVELKWGKRFQIIEGIARGLLYLHRDSCLRVIHRDLKVSNILLDEKMNPKISDFGLARMFEGTQILVNTHKIVGTFGYMSPEYAMGGIFSEGSDVYSFGVLLLEIVSGRKNSALYDQGYLNLLSYAWQLWSEEKALDLLDEAIAVSFPLEVIRCIHIGLLCVQDHAMDRPNMTNVVLMLSGESDLPRPRQPIFTFQTEMRNHAIPPQQQSIWSVNTVTNTMVEGR

SEQ ID NO: 813 - DNA, 2445 bp, Eucalyptus grandis
  Eucgr.E03656.1
atgactagtcggtgttcttgctttgtcttcttcatcctagttcaggcaagtcaaacagccagaggcgtggtttacaatatcacgacatcggagccactcttccctaaccaaactctcgtctcttctggccaaatcttcgagcttgggttctttacgccaaatgggtcagcaaatcagtatgttgggatatggtacaagaacttggcgcctcctaaaatcgtgtgggtggccaatagggcattgccgcttgtgtacccagatcagtctgcgaaattaatgataggcagtgatgggaatttgaagctcgtggatggaaaacagaatatattttggtctaccaatgcctctcgtcgttccaattataggtcagcggcgctattagatagtggaaattttgtactgcaggatgcaaattatagtgaaatatggggaagcttcgatgatccgacagatactcttcttccgggcatgaagatgggtgcaaatgccaggactggggagaaactctatttaatttcctggagaagcgacagtgatccgtcccctggaaggttcttgactgggataacatcggagacgctgcctcaacctttcacttggaatggttccaccccttactggagaggcggacaatgggacaaatcgaaatttatcggcataaaaaacatggtccggtcgtacgcgagtgcaatcaatgtcgagcaagatattcggcaggggaccacttacttatctatcgatttacaaaagcagacctatatatacatgtctgttttgcctggaggattacttaagataatgtactgggatgatggagctaaggtgtggttggaactttgggcaggaccgaacaatacttgtgagacttatggaacttgtggtccttttggagtttgtaactcaatgagtttgcctatttgcagatgcttaaatgggtttctgccaaagtcaaatgaagaatggaacagtggaaactggaccggaggatgtgtaagagagacagaattgtattgccagaaaaacacaagcacatcggcttcaacaattgtaaagaaagatgacttttggcaaatgagccagatgaaactacctgactctgaggattatttatcagacattggagatcaagaaggatgtttaagctggtgcctaagcaactgttcttgcttggcttattcttatgtcagcaccatcgggtgtatggtttggactaaaaaaaacctcatcgatcttgaggaattttccacagctggagaaaatctatttgttcgagttgcacatgtagaaacaggaggatcgtcgcagaaagccgttatcatcagcctgagtactgttgctgggatcctgttctttgcagtatttgtttttggtctttgcaaatggagagctaagaaaagaggtaaacctgaaaagccgggcaaactgctacaaggaaatgcatggaaagagcaattgaaggaagatgatgcactgaaattgacttttttcagttttgatagcatactacttgctacaaacaagttcaacacgacaagtaaacttgggcaaggagggtttggctctgtttacaagggaaagatgaatgatgggaaagaggtagctgtgaaaagactttctagtagctcggcccaaggtgttcaagagttcgagaatgagatagtcctaatatcaaaactccaacatcgaaatctggttaaactcattggttgttgcactgaaggagatgaaaaaattttggtatacgagtacttgccaaacaaaagcttggactcctttctttttgattcaaaaaagaaggcagaactcgactggggcaaacgattccaaattattgagggaattgcaagggggcttctctacctccatcgagattcttgccttagggtcatacaccatgaactcaaaatttcagattttgggctggcacgaatgttcaaggcactcaaattttgttcaaatcaatgcagtggttatatgtctcctgagtacgctatgggcggaatattttccgagaggtctgatgtgtatagcttcggagtgttgctactggagattgttagtggcagaaagaactcagccttgtttgatcagggatatctcaatctcctttcctacgtaagcatgccgattatttttttttataagaaaaagccacgtaatcattttggtcggaatattttgccggcatggcaattatggagtgaaggcaaagcattggacctactggatgaggcaattgctgttagctttccattggaggaccatgctatggatagaccaaacatgacaaatgtggttctaatgctaggcggtgaatcagatcttcctcagccgagacagcctatattcactttccaaactgaaatgccaaatcatgctattccaccgcagcaacaaagcatctggtctgttaacactgtcactaatacaatggttgaaggaaga

SEQ ID NO: 814 - protein, 815 aa, Eucalyptus grandis
  Eucgr.E03656.1
MTSRCSCFVFFILVQASQTARGVVYNITTSEPLFPNQTLVSSGQIFELGFFTPNGSANQYVGIWYKNLAPPKIVWVANRALPLVYPDQSAKLMIGSDGNLKLVDGKQNIFWSTNASRRSNYRSAALLDSGNFVLQDANYSEIWGSFDDPTDTLLPGMKMGANARTGEKLYLISWRSDSDPSPGRFLTGITSETLPQPFTWNGSTPYWRGGQWDKSKFIGIKNMVRSYASAINVEQDIRQGTTYLSIDLQKQTYIYMSVLPGGLLKIMYWDDGAKVWLELWAGPNNTCETYGTCGPFGVCNSMSLPICRCLNGFLPKSNEEWNSGNWTGGCVRETELYCQKNTSTSASTIVKKDDFWQMSQMKLPDSEDYLSDIGDQEGCLSWCLSNCSCLAYSYVSTIGCMVWTKKNLIDLEEFSTAGENLFVRVAHVETGGSSQKAVIISLSTVAGILFFAVFVFGLCKWRAKKRGKPEKPGKLLQGNAWKEQLKEDDALKLTFFSFDSILLATNKFNTTSKLGQGGFGSVYKGKMNDGKEVAVKRLSSSSAQGVQEFENEIVLISKLQHRNLVKLIGCCTEGDEKILVYEYLPNKSLDSFLFDSKKKAELDWGKRFQIIEGIARGLLYLHRDSCLRVIHHELKISDFGLARMFKALKFCSNQCSGYMSPEYAMGGIFSERSDVYSFGVLLLEIVSGRKNSALFDQGYLNLLSYVSMPIIFFYKKKPRNHFGRNILPAWQLWSEGKALDLLDEAIAVSFPLEDHAMDRPNMTNVVLMLGGESDLPQPRQPIFTFQTEMPNHAIPPQQQSIWSVNTVTNTMVEGR

SEQ ID NO: 815 - DNA, 2121 bp, Eucalyptus grandis
  Eucgr.E02493.1
atgacaaagtctaactattctgcagcactgctttcagactttggaaactttgttcttcaagataggaacgcggttataatgtgggaaagctttgatgagccaactgacactctcctgccaaagatgaagatcggagtaaacgtgaaaacaggaaagaaacgaaacttgatttcgtggaaaggcgaagatgatccctcatttggaagctttgctgtaggattgacaccagaaacagcgcctcagcttttcacttggaatggatcaagtccttactggagaagcggacagtgggataaaaccaagttcattggaataccgggcatggaagggcgtgggtccaatctccagcaagataatatacagggaacaacatattattccctcgataattacaataactacttctttgcatatgatttcatctcatctgaaggatattttatggcggttcgttgggtcaatgagtgggggacatattgggaggcaccggcaccaactaacccttgtgatatatacggatattgcggcccctttggagtttgcaacctgcttaattcacccatgtgcaaatgcttaaaaggatttaaaccaagatcagatgaagagtggaacagaggaaactggaccagagggtgccttaggaaaatggaattgaattgtcagaaatccgcaaatgcagcagcttcgacgactgtcaaaaaagatatgttttggcaactgagtcagatcaagttgcctgattttgctgattttatattgatagatgatgcaaacggatgtcaaagttggtgcctagaaaactgctcgtgcttggccttttcttttgtgaatgctataggatgcatggcttggagtaaagacctcctagatattcagcaattctccatggatggtgaagatctatatattcggtttgcggatgcgggtgcgggtgcagatgggggtgtagatgcagatacagccggtatttttatctgtggtctttcaaagtggagagggaagtttaggaaaatgacaatcccagggctctttaggtcagtggctacggccatcagatcagataaactgctaaaggaaactgcatggaaagagcaaatgaaggaagatgatgcatctaaattggtggcctatgattttgacagcatatgcctcgcgacagacaactttgacgcagaaaacaaacttgggcagggagggtttggcccggtttataagggaaaactgaaggatggtaaggagatagcagcgaagagactttcgagcagctcaggccaaggcttaacggagttcaagaatgagatccttctaatatccaaacttcaacaccgaaatttggtgagactcctcggttgctgcactgaaagagaagaaaagattctagtgtatgagtacttgccgaacaagagcttggacgccttcctttttgattcaaaagagaaggcaaaacttagctggagcgtacgcttccacattatccagggggtcgcaagagggctgctctacctccaccatgattctggccttagggtcatacatcgagatttgaaagtgagcaacattctcttggatgaaaaaatgaatcccaaaatttctgattttgggctggcacggatgtttgaaggcagtcaagttatggtaaatactcacagagttgtggggacacacggttacatgtctcctgagtatgtcatgggtgggacaatttctgagaaatcagatgtttatagctttggagtactattattggagattatcagcagcaagaagaacacaagttcagattaccccgagcagcatctcaatctcatggcttatttgttacaggcttggcacttgtggtgtgggggtagaggactggacctgatggatgaagccattgctgacgcattttcgacgtcagaagtaatgagatgcattcagttagcgcttctctgcacgcaggaccatgccacagatagacccaacatgtccgccgtggttctaatgttgaatggggagtccaagctttcacagccgaagcaatcggcatatacatttcaaagtttgctggctcgcaaagtccaatcacaagaaggaatccggtccatgaataacatcaccattactatggttgaaggaaga

SEQ ID NO: 816 - protein, 707 aa, Eucalyptus grandis
  Eucgr.E02493.1
MTKSNYSAALLSDFGNFVLQDRNAVIMWESFDEPTDTLLPKMKIGVNVKTGKKRNLISWKGEDDPSFGSFAVGLTPETAPQLFTWNGSSPYWRSGQWDKTKFIGIPGMEGRGSNLQQDNIQGTTYYSLDNYNNYFFAYDFISSEGYFMAVRWVNEWGTYWEAPAPTNPCDIYGYCGPFGVCNLLNSPMCKCLKGFKPRSDEEWNRGNWTRGCLRKMELNCQKSANAAASTTVKKDMFWQLSQIKLPDFADFILIDDANGCQSWCLENCSCLAFSFVNAIGCMAWSKDLLDIQQFSMDGEDLYIRFADAGAGADGGVDADTAGIFICGLSKWRGKFRKMTIPGLFRSVATAIRSDKLLKETAWKEQMKEDDASKLVAYDFDSICLATDNFDAENKLGQGGFGPVYKGKLKDGKEIAAKRLSSSSGQGLTEFKNEILLISKLQHRNLVRLLGCCTEREEKILVYEYLPNKSLDAFLFDSKEKAKLSWSVRFHIIQGVARGLLYLHHDSGLRVIHRDLKVSNILLDEKMNPKISDFGLARMFEGSQVMVNTHRVVGTHGYMSPEYVMGGTISEKSDVYSFGVLLLEIISSKKNTSSDYPEQHLNLMAYLLQAWHLWCGGRGLDLMDEAIADAFSTSEVMRCIQLALLCTQDHATDRPNMSAVVLMLNGESKLSQPKQSAYTFQSLLARKVQSQEGIRSMNNITITMVEGR

SEQ ID NO: 817 - DNA, 2112 bp, Eucalyptus grandis
  Eucgr.E02493.2
atgacaaagtctaactattctgcagcactgctttcagactttggaaactttgttcttcaagataggaacgcggttataatgtgggaaagctttgatgagccaactgacactctcctgccaaagatgaagatcggagtaaacgtgaaaacaggaaagaaacgaaacttgatttcgtggaaaggcgaagatgatccctcatttggaagctttgctgtaggattgacaccagaaacagcgcctcagcttttcacttggaatggatcaagtccttactggagaagcggacagtgggataaaaccaagttcattggaataccgggcatggaagggcgtgggtccaatctccagcaagataatatacagggaacaacatattattccctcgataattacaataactacttctttgcatatgatttcatctcatctgaaggatattttatggcggttcgttgggtcaatgagtgggggacatattgggaggcaccggcaccaactaacccttgtgatatatacggatattgcggcccctttggagtttgcaacctgcttaattcacccatgtgcaaatgcttaaaaggatttaaaccaagatcagatgaagagtggaacagaggaaactggaccagagggtgccttaggaaaatggaattgaattgtcagaaatccgcaaatgcagcagcttcgacgactgtcaaaaaagatatgttttggcaactgagtcagatcaagttgcctgattttgctgattttatattgatagatgatgcaaacggatgtcaaagttggtgcctagaaaactgctcgtgcttggccttttcttttgtgaatgctataggatgcatggcttggagtaaagacctcctagatattcagcaattctccatggatggtgaagatctatatattcggtttgcggatgcgggtgcgggtgcagatgggggtgtagatgcagatacagccggtatttttatctgtggtctttcaaagtggagagggaagtttaggaaaatgacaatcccagggctctttaggtcagtggctacggccatcagatcagataaactgctaaaggaaactgcatggaaagagcaaatgaaggaagatgatgcatctaaattggtggcctatgattttgacagcatatgcctcgcgacagacaactttgacgcagaaaacaaacttgggcagggagggtttggcccggtttataagggaaaactgaaggatggtaaggagatagcagcgaagagactttcgagcagctcaggccaaggcttaacggagttcaagaatgagatccttctaatatccaaacttcaacaccgaaatttggtgagactcctcggttgctgcactgaaagagaagaaaagattctagtgtatgagtacttgccgaacaagagcttggacgccttcctttttgattcaaaagagaaggcaaaacttagctggagcgtacgcttccacattatccagggggtcgcaagagggctgctctacctccaccatgattctggccttagggtcatacatcgagatttgaaagtgagcaacattctcttggatgaaaaaatgaatcccaaaatttctgattttgggctggcacggatgtttgaaggcagtcaagttatggtaaatactcacagagttgtggggacacacggttacatgtctcctgagtatgtcatgggtgggacaatttctgagaaatcagatgtttatagctttggagtactattattggagattatcagcagcaagaagaacacaagttcagattaccccgagcagcatctcaatctcatggcttatgcttggcacttgtggtgtgggggtagaggactggacctgatggatgaagccattgctgacgcattttcgacgtcagaagtaatgagatgcattcagttagcgcttctctgcacgcaggaccatgccacagatagacccaacatgtccgccgtggttctaatgttgaatggggagtccaagctttcacagccgaagcaatcggcatatacatttcaaagtttgctggctcgcaaagtccaatcacaagaaggaatccggtccatgaataacatcaccattactatggttgaaggaaga

SEQ ID NO: 818 - protein, 704 aa, Eucalyptus grandis
  Eucgr.E02493.2
MTKSNYSAALLSDFGNFVLQDRNAVIMWESFDEPTDTLLPKMKIGVNVKTGKKRNLISWKGEDDPSFGSFAVGLTPETAPQLFTWNGSSPYWRSGQWDKTKFIGIPGMEGRGSNLQQDNIQGTTYYSLDNYNNYFFAYDFISSEGYFMAVRWVNEWGTYWEAPAPTNPCDIYGYCGPFGVCNLLNSPMCKCLKGFKPRSDEEWNRGNWTRGCLRKMELNCQKSANAAASTTVKKDMFWQLSQIKLPDFADFILIDDANGCQSWCLENCSCLAFSFVNAIGCMAWSKDLLDIQQFSMDGEDLYIRFADAGAGADGGVDADTAGIFICGLSKWRGKFRKMTIPGLFRSVATAIRSDKLLKETAWKEQMKEDDASKLVAYDFDSICLATDNFDAENKLGQGGFGPVYKGKLKDGKEIAAKRLSSSSGQGLTEFKNEILLISKLQHRNLVRLLGCCTEREEKILVYEYLPNKSLDAFLFDSKEKAKLSWSVRFHIIQGVARGLLYLHHDSGLRVIHRDLKVSNILLDEKMNPKISDFGLARMFEGSQVMVNTHRVVGTHGYMSPEYVMGGTISEKSDVYSFGVLLLEIISSKKNTSSDYPEQHLNLMAYAWHLWCGGRGLDLMDEAIADAFSTSEVMRCIQLALLCTQDHATDRPNMSAVVLMLNGESKLSQPKQSAYTFQSLLARKVQSQEGIRSMNNITITMVEGR

SEQ ID NO: 819 - DNA, 2265 bp, Eucalyptus grandis
  Eucgr.E03122.1
cttcaaagtagcacaattgacagtataactgcatcaactcttctcgttcagaaccaaaccgttgtctctagtcgtcaaatctttgagcttgggttcttcacgcctaaaggatcagcaaagcagtacgtaggaatatggtacaagaacttgactccctccaaagttgtctgggtggccaacagggacaagccacttggacacacagatcaatctgcgagtttaataattggcgaagatggaaatctgaagcttcttgatgggcaacaaaacactgtgtggtctactaatgtcatggcaaagtctaactattctgtagcactgctttcagactttggaaactttgttcttcaagacaggaacgcggatattatgtgggaaagctttgatgagccaactgacactctcctgccaaacatgaagatcggagtgaacgtgaaaacaggaaagaaacggaacttgatttcctggaaaggcgaagatgatccctcattcggaagctttgccgtaggattgacaccagaaacagcgcctcaggttttcacttggaatggatcaagtccttactggagaagcggacagtgggataaaaccaagttcattggaataccgaccatgagtgggcctgggtccgttctccagcaagataatatacaaggaacaacatattattccctcaaaagttacgacaatctctttggatataatttcatctcatctgaaggatatttaatggcagttcgttgggccaatggatggtcaacatactggggggcaccggaatcaactaacccttgtgatatatatggatattgcggctcctttggagtttgcaacctgcttaattcacccatgtgcagatgcttaaaaggttttaagccaagatcagatgaagaatggaacagaggaaattggaccagagggtgccttagggaaatggaattaaattgtcagaaacctgcaaatgtagcagcttcgacgactgtcaaaaaagatatgtttcggcgaatgagtcagatcaagttgcctgattccgctgatttcccattgatagatgatgcagagcaatgtcaaagttggtgcctagaaaactgctcgtgcttggccttttcttatgtgaatgctataggatgtatggcttggagtaaagacctcctagatattcagcaattctccatgggtggccaagatctatatattcggcttgcagatgggggtgcgggttcaggtttacccatgcggacaaaacttatcatcagcctaagtactatttctggcatcatcttatttggagccagtattttagtatgtggtctttcaaagtggagagggaagtttaggaaaatgacaatcccagggcactttaggtcagtggctgtggccatcaaatcagaaaaactgctaaaggaaactgcatggaaagagcaaatgaaggaagatgatgcatctaaattagtggcctatgattttgatagcatatgcctcgcaacagacaacttcgacacaaaaaacaaactcgggcagggagggtttggcccggtttataagggaaaactgaaggatggtaaggagatagcagcgaagagactttcgagctgctcaggccaaggcttaacggagttcaagaatgagatccttctaatatccaaacttcaacaccgaaatatggtgagactcctcggttgttgcactgaaagagaagaaaagattctagtgtatgagtacttgccgaacaagagcttggacgccttcctttttgggctgctctacctccaccacgattctggcctcagggtcatacatcgagatttgaaagtgagcaacattctattggatgaaaagatgaatcctaaaattttttattttgggctggcgcggatgtttgaaggatctcaagttgtggtaaatactcacaaagttgtggggacacacggttacatgtctcccaagtatgtcatgggtgggacaatttctgagaaatcagatgtttatagctttggagtactgttattagagattatcagcagcaagaagaacacaagtttagattaccccaagcagcatctcaatctcatggcttatgcttggcacttgtggtatgagggcagaggactggacttgatggatgcagccattgctgacgcattttcgacgtcagaagtaatgagatgcattcagttagggcttctctgcacgcaggaccatgccacagatagacccaacatgtccaccgtggttcgaatgctgaatggagagtccaagctttca

SEQ ID NO: 820 - protein, 755 aa, Eucalyptus grandis
  Eucgr.E03122.1
LQSSTIDSITASTLLVQNQTVVSSRQIFELGFFTPKGSAKQYVGIWYKNLTPSKVVWVANRDKPLGHTDQSASLIIGEDGNLKLLDGQQNTVWSTNVMAKSNYSVALLSDFGNFVLQDRNADIMWESFDEPTDTLLPNMKIGVNVKTGKKRNLISWKGEDDPSFGSFAVGLTPETAPQVFTWNGSSPYWRSGQWDKTKFIGIPTMSGPGSVLQQDNIQGTTYYSLKSYDNLFGYNFISSEGYLMAVRWANGWSTYWGAPESTNPCDIYGYCGSFGVCNLLNSPMCRCLKGFKPRSDEEWNRGNWTRGCLREMELNCQKPANVAASTTVKKDMFRRMSQIKLPDSADFPLIDDAEQCQSWCLENCSCLAFSYVNAIGCMAWSKDLLDIQQFSMGGQDLYIRLADGGAGSGLPMRTKLIISLSTISGIILFGASILVCGLSKWRGKFRKMTIPGHFRSVAVAIKSEKLLKETAWKEQMKEDDASKLVAYDFDSICLATDNFDTKNKLGQGGFGPVYKGKLKDGKEIAAKRLSSCSGQGLTEFKNEILLISKLQHRNMVRLLGCCTEREEKILVYEYLPNKSLDAFLFGLLYLHHDSGLRVIHRDLKVSNILLDEKMNPKIFYFGLARMFEGSQVVVNTHKVVGTHGYMSPKYVMGGTISEKSDVYSFGVLLLEIISSKKNTSLDYPKQHLNLMAYAWHLWYEGRGLDLMDAAIADAFSTSEVMRCIQLGLLCTQDHATDRPNMSTVVRMLNGESKLS

SEQ ID NO: 821 - DNA, 2346 bp, Eucalyptus grandis
  Eucgr.E03754.1
atgactctgcacttgtgttctttgctagtcttctccctgcctcaagcacttcaaagcagcacaattgatagcataactgcatcgagtccactgattcagaaccaaacccttgtctctagtagtcaaatctttgagctcgggttcttcacgcctaaaggatcagcaaagcagtacgtaggaatatggtacaagaagatgactccctccaaagttgtctgggtggccaacagggacaagccacttggacatacagatcagtctgcaagtttaataattggcgaagatggaaatctgaagcttcttgatgggcgacaaaacaccgtgtggtctactaatgtcatggcaaagtcaaattattccgaagcattgctttcagactttggaaactttgttcttcaagacaggaacgcgaatataatgtgggaaagctttgatgagccaaccgacactctcttgccaaacatgaagattggagcaaatgtgaaaaaaggaaagaaactaaacttgacttcctggaaaggcgaagatgatccctcactcggaagctttgtcacgggattgacatcggagacaccacctcagcttttcacttggaatggatcaagtccctactggagaagtggacagtgggataaaaccaagttcatcggaataccgaacatgaccaacacatactacaatctccaacaagataatgtccagggaacctcatattattacctcaataattacaacaactccatctttgcatattctttcatctcttctgaaggatctctaaaggcaatgttttgggacaatggctggttaacatactggaaggcaccggcaccaactaacccttgtgaaatttatggaatatgtggcccctttggagtttgcaacccgtttagttcacccatatgcagatgcttaaaaggttttaaaccaagatcaaaaaaagaatggaacagaggaaactggaccagagggtgccttaggaaaactgaattgaattgtcagaaatccacaagcgctgaagatatgttctggcaaatgagacaaataaaattgcctgattctgctgatcatttgctgatacataatgcggaaggatgccaaagttggtgcctagaaaactgctcttgcttggccttttcttatgtgaattctataggatgtatggcctggagtaaggacctcctagatactcaacaactctccgtgggtggtgaagatctatttattcgacttatggactcgagtgcagggaagtttaggaaaatgacaatcccaaggctctttaggtcagaagaactactaagggacattgcttggaaaaagcaaatgaaggaagatgatacatcgaaattggtcgtttatgactttgatagcatacgcctcgcaacagacaacttcaacgtgaaaaacaaactcgggcagggagggtttggcccagtttataagggaaaactgaacaatggtatggagatagcagcaaagagactttcaagcagctctggccaaggcatagcggagttcaagaatgagatccttctaatatccaaacttcaacaccgaaatctagtgagactccttggttgctgcattgaaggagaagaaaagattctagtgtatgagtacttgcccaacaagagcttggacaccttcctctttgattcaaaagagaaggcaaaacttagctggagtgtacgcttccacattatccaagggatcgcaagagggctgctttacctccaccacgattcttgccttagagtcatacatcgggatttgaaagtgagcaacattctcttggatgaaaagatgaatcccaagatttcagattttgggctgtcacggatatttgaaggcactcaagttttggtaaatactcacaaagttgtggggacacttggctacatgtctccagagtatgccatgggtgggatattttctgagaaatctgatgtttatagctttggagtactgctattggagattatcagcggcaagaagaacacaagttcagattacccagggcagcatctcaatctcctcgcttatgcttggcacttgtggtgtgaaggaagaggattggatctaatagatgaaggcattgccgatgcattttcggtgttagaagtgatgagatgcattcagttggggcttctctgtacgcaagaccatgccacggatagacccaacatgttggctgtggttctaatgctaaatggggagtccaatcttccacaaccaaagcaaccgacatatacattttcacgctcgctggctcacgaagtcccatcacaagaagaaagcgtccagtccatgaataccatcaccattactacggttgaaggaaga

SEQ ID NO: 822 - protein, 782 aa, Eucalyptus grandis
  Eucgr.E03754.1
MTLHLCSLLVFSLPQALQSSTIDSITASSPLIQNQTLVSSSQIFELGFFTPKGSAKQYVGIWYKKMTPSKVVWVANRDKPLGHTDQSASLIIGEDGNLKLLDGRQNTVWSTNVMAKSNYSEALLSDFGNFVLQDRNANIMWESFDEPTDTLLPNMKIGANVKKGKKLNLTSWKGEDDPSLGSFVTGLTSETPPQLFTWNGSSPYWRSGQWDKTKFIGIPNMTNTYYNLQQDNVQGTSYYYLNNYNNSIFAYSFISSEGSLKAMFWDNGWLTYWKAPAPTNPCEIYGICGPFGVCNPFSSPICRCLKGFKPRSKKEWNRGNWTRGCLRKTELNCQKSTSAEDMFWQMRQIKLPDSADHLLIHNAEGCQSWCLENCSCLAFSYVNSIGCMAWSKDLLDTQQLSVGGEDLFIRLMDSSAGKFRKMTIPRLFRSEELLRDIAWKKQMKEDDTSKLVVYDFDSIRLATDNFNVKNKLGQGGFGPVYKGKLNNGMEIAAKRLSSSSGQGIAEFKNEILLISKLQHRNLVRLLGCCIEGEEKILVYEYLPNKSLDTFLFDSKEKAKLSWSVRFHIIQGIARGLLYLHHDSCLRVIHRDLKVSNILLDEKMNPKISDFGLSRIFEGTQVLVNTHKVVGTLGYMSPEYAMGGIFSEKSDVYSFGVLLLEIISGKKNTSSDYPGQHLNLLAYAWHLWCEGRGLDLIDEGIADAFSVLEVMRCIQLGLLCTQDHATDRPNMLAVVLMLNGESNLPQPKQPTYTFSRSLAHEVPSQEESVQSMNTITITTVEGR

SEQ ID NO: 823 - DNA, 2469 bp, Eucalyptus grandis
  Eucgr.E04138.1
atgactctgcacttgtgttctttgcttgtcttctccctccctcaagcacttcaaagcagcacaattgacagcataactgcatcaagtccactggttcagaaccaaacccttgtctctagtagtcaaatctttgagctcgggttcttcacgcctaaaggatcagcaaagcagtacgtaggaatatggtacaagaagatgactccctccagagtcgtctgggtggccaacagggacaagccacttggacatacagatcaatctgctagtttaacaattggggaagatggaaatctgaagcttcttgatgggcgacaaaacactgtgtggtctactaatgtcatggcaaagtcgaattattctgaagcactgctttcagactttggaaactttgttcttcaagacaggaacgagaatataatgtgggaaagctttgatgagccaaccgacactctcttgccaaacatgaagattggagtaaatgtgaaaaaaggaaagaaactaaatttgacttcctggaaaggcgaagatgatccctcactcggaagctttgtcatgggagtgacattggagacaccacctcagcttttcacatggaatggatcaagtccttactggagaagtggacagtgggataaaaccaagttcatcggaataccgaacatgaccaacacatactacaatctccaacaagataatgtccagggaacctcatattattacctcaataattacaacaactccatctttggatatactttcatctcttctgaaggatctgtaaagtcagtttgttggaccaatggctggttaacatactggaaggcaccggcaccaactaacccttgtgaaatttatggaatatgtggcccctttggagtttgcaacccgtttagttcacccatgtgcagatgcttaaaaggttttaaacctagatcagatgaagaatggaacagaggaaactggaccagagggtgccttaggaaaatggaattgaattgtcagaaatctgcaagcgcagcagcttcaacaactgtggaaaaagatatgttctggcaaatgagacaaataaaattgcctgattccgctgatcatttgttgatagataatgtggaaggatgtcaaagttggtgccccgaaaactgctcgtgcttggcctcttcttatgtgaatgctataggatgtatggcttggagtaaagaccttctagatactcagcaattctccattggtggcgaagatctatttattcgacttgcggatgcgagtgcgggtgtacctacgcggacaaaacttatcatcagcctaagtactatttccggcatcatcttatttggagctggtatttcagtctgtggtctttcaaagtggagagggaagtttaggaaaatgacaatcccaaggctctttatgtcagaagaactactaagggacactgcttggaaagaccaaatgaaggaagatgatacatcaaatttggtcgtttatgacttcgatagcatacgcctcgcaacagacaacttcaacgtgaaaaacaaacttgggcagggagggtttggcccggtttataagggaaaactgaacgatggtaaggagatagcaacaaagagactttcaagcagctcaagccaaggcatagcggagttcaagaatgagatccttctaatatccaaacttcaacaccgaaatctggtgagactccttggttgctgcattgaagaagaggaaaagattctagtgtatgagtacttgcccaacaagagcttggacaccttcctctttgattcaaaagagaaggaaaaacttagctggagtgtacgcttccacattattcagggggtcgccagagggctactttacctccaccatgattcttgccttagagtcatacatcgggatttgaaagtgagcaacattctcttggatgaaaagatgaattccaagatttcagattttgggttgtcacggatgtttgaaggcactcaagttttggtaaatactcacaaagttgtggggacacttggctacatgtctccagagtatgccatgggtgggatattttctgagaaatctgatgtttatagctttggagtactgctattggagattatcagcggcaagaagaacacaagttcagattacccagggcagcatctcaatctcctcgcttatgcttggcacttgtggtgtgaagacagagtattggatctaatggatgaaggcattgccgatgcatttttggtgtcagaagtgatgagatgcattcaattagggcttctctgtacgcaagaccatgccacagatagacccaacatgttggctgtggttctaatgctgaatggggagtccaatctttcacagccaaagcaaccaacatatacattttcacgctcgctggctcacgaagtcccatcacaagaagaaagcatccggtccatgaataccatcaccattactacggttgaaggaaga

SEQ ID NO: 824 - protein, 823 aa, Eucalyptus grandis
  Eucgr.E04138.1
MTLHLCSLLVFSLPQALQSSTIDSITASSPLVQNQTLVSSSQIFELGFFTPKGSAKQYVGIWYKKMTPSRVVWVANRDKPLGHTDQSASLTIGEDGNLKLLDGRQNTVWSTNVMAKSNYSEALLSDFGNFVLQDRNENIMWESFDEPTDTLLPNMKIGVNVKKGKKLNLTSWKGEDDPSLGSFVMGVTLETPPQLFTWNGSSPYWRSGQWDKTKFIGIPNMTNTYYNLQQDNVQGTSYYYLNNYNNSIFGYTFISSEGSVKSVCWTNGWLTYWKAPAPTNPCEIYGICGPFGVCNPFSSPMCRCLKGFKPRSDEEWNRGNWTRGCLRKMELNCQKSASAAASTTVEKDMFWQMRQIKLPDSADHLLIDNVEGCQSWCPENCSCLASSYVNAIGCMAWSKDLLDTQQFSIGGEDLFIRLADASAGVPTRTKLIISLSTISGIILFGAGISVCGLSKWRGKFRKMTIPRLFMSEELLRDTAWKDQMKEDDTSNLVVYDFDSIRLATDNFNVKNKLGQGGFGPVYKGKLNDGKEIATKRLSSSSSQGIAEFKNEILLISKLQHRNLVRLLGCCIEEEEKILVYEYLPNKSLDTFLFDSKEKEKLSWSVRFHIIQGVARGLLYLHHDSCLRVIHRDLKVSNILLDEKMNSKISDFGLSRMFEGTQVLVNTHKVVGTLGYMSPEYAMGGIFSEKSDVYSFGVLLLEIISGKKNTSSDYPGQHLNLLAYAWHLWCEDRVLDLMDEGIADAFLVSEVMRCIQLGLLCTQDHATDRPNMLAVVLMLNGESNLSQPKQPTYTFSRSLAHEVPSQEESIRSMNTITITTVEGR

SEQ ID NO: 825 - DNA, 2322 bp, Eucalyptus grandis
  Eucgr.E03760.1
atggcattggtcatcataactgcatcaagtccactggttcagaatcaaacccttgtctctagtagtcaaatctttgagctcgggttcttcacacccaaaggatcagcaaagcagtacataggaatatggtacaagaagttgactccctccagagttgtttgggtggccaatagggacaagccacttggacatacagatcaatctgcaagtttaataattggcgaagatggaaatctgaagcttcttgatgggcgacaaaacactgtgtggtctcctaatgtcatggcaaagtcgaattattctgaagcactgctttcagactttggaaactttgttcttcaagacaggaacgcgaatataatgtgggaaagctttgatgagccaaccgacactctcttgccaaacatgaagattggagtaaatgtgaaaacaggaaagaaactaaacttgacttcctggaaaggtgaagatgatccctcatttggaagctttgtcatgggagtgacatcggagaaaccacctcagcttttcacttggaatggatcaagtccttactggagaagtggacagtgggaaaaaacgaagttcatcggaataccgacaatgaccaacacatactacgatatccggcaagataacatccagggaacctcatatttttacctcaataattataacaactccatctttggatatactttcatctcttctgaaggatctgtgaagttggctttttgggccaacgggtggttaacatcctggaaggcaccggcaccaactaacccttgtgaaatttatggagtatgtggccccttcggattttgcaacccgtttggttcacctatgtgtagatgcttaaaaggttttaaaccaagatcagatgaagaatggaacagaggaaactggaccagagggtgccttagggaaatggaattgaattgtcagaaacctgcaagcgcagcagcttcaacaactgtggaaaaagatatgttctggcaaatgagacaaataaaattgcctgattccgctgattatttgttgatagataatgtggaaggatgtcaaagtcagtgcctagaaaattgctcgtgcttggccttttcttatgtgaatgctataggatgtatggcttggagtaaagacctcctagatactcagcaattctccacagatggcgaagatctatttattcgacttgtggatgcgagtgtgggtgcagatacagggaggtttaggaaaatgacaatcccaaggctccttaggtcagaagaaccgctaagggaaacttcttggaaagagcaaatgaaggaagatgatgcatcgaaattgatcgtttatgactttgatagcatacgcctcgcaacagacaacttcaacgtggaaaacaaacttgggcagggaggctttggcccggtttataagggaaaactgaacaatggtaaggagatagcagcaaagagactttcgagcagctcaggccaaggcatagcagagttcaagaatgagatccttctaatatccaaacttcaacaccgaaatctggtgagacttctcggtttctgcattgaaggagaagaaaagattctagtgtatgagtacttgcccaacaagagcttggacaccttcctttttgattcaagagagaaggcaaaacttagctggggtgtacgcttccacattatccagggggttgcaagagggctgctctacctccaccgtgattcttgccttagagtcatacatcgggatttgaaagtgagcaacattctcttggatgaaaagatgaatcccaagatttcagattttgggctatcgcggatgtttgaaggcactcaagttttggtaaatactcacaaagttgtggggacatttggctacatgtctccagagtatgccatgggtgggatattttctgagaaatctgatgtttatagctttggagtactgctattggagattatcagcggcaagaagaacacaagtttagattacccagggcagcatctcaatctcgttgcttatgcttggcacttgtggtgtgaaggcagaggattggacctaatagatgaagccatcgctgatgcattttcggtgttagaagtaacgagatgcattcagttagggcttctctgtacgcaagaccatgccgcagatagacccaacattttggccgtggttctaatgctgaatggggagtccattctttcacaaccaaagcaaccgacatatacattttcacgcttgctggctcatgaagtccaatcacaagaaggaagcatccggtccatgaataccataaccattactacggttgaaggaaga

SEQ ID NO: 826 - protein, 774 aa, Eucalyptus grandis
  Eucgr.E03760.1
MALVIITASSPLVQNQTLVSSSQIFELGFFTPKGSAKQYIGIWYKKLTPSRVVWVANRDKPLGHTDQSASLIIGEDGNLKLLDGRQNTVWSPNVMAKSNYSEALLSDFGNFVLQDRNANIMWESFDEPTDTLLPNMKIGVNVKTGKKLNLTSWKGEDDPSFGSFVMGVTSEKPPQLFTWNGSSPYWRSGQWEKTKFIGIPTMTNTYYDIRQDNIQGTSYFYLNNYNNSIFGYTFISSEGSVKLAFWANGWLTSWKAPAPTNPCEIYGVCGPFGFCNPFGSPMCRCLKGFKPRSDEEWNRGNWTRGCLREMELNCQKPASAAASTTVEKDMFWQMRQIKLPDSADYLLIDNVEGCQSQCLENCSCLAFSYVNAIGCMAWSKDLLDTQQFSTDGEDLFIRLVDASVGADTGRFRKMTIPRLLRSEEPLRETSWKEQMKEDDASKLIVYDFDSIRLATDNFNVENKLGQGGFGPVYKGKLNNGKEIAAKRLSSSSGQGIAEFKNEILLISKLQHRNLVRLLGFCIEGEEKILVYEYLPNKSLDTFLFDSREKAKLSWGVRFHIIQGVARGLLYLHRDSCLRVIHRDLKVSNILLDEKMNPKISDFGLSRMFEGTQVLVNTHKVVGTFGYMSPEYAMGGIFSEKSDVYSFGVLLLEIISGKKNTSLDYPGQHLNLVAYAWHLWCEGRGLDLIDEAIADAFSVLEVTRCIQLGLLCTQDHAADRPNILAVVLMLNGESILSQPKQPTYTFSRLLAHEVQSQEGSIRSMNTITITTVEGR

SEQ ID NO: 827 - DNA, 2280 bp, Eucalyptus grandis
  Eucgr.E04147.1
atgactctgcacttgtgttctttgcttgtcttctccctccctcaagcacttcaaagcagcacaattgacagcataactgcatcaagtccactggttcagaaccaaacccttgtctctagtagtcaaatctttgagctcgggttcttcacgcctaaaggatcagcaaagcagtacgtaggaatatggtacaagaagatggctccctccagagtcgtctgggtggccaacagggacaagccactcggacatacagatcaatctgctacactactttcggactttggaaactttgttcttcaagacaggaacgagaatataatgtgggaaagctttgatgagccaaccaacactctcttgccaaacatgaagattggagtaaacgtgaaaacaggaaagaaactaaacttgacttcctggaaaggcgaagatgatccctcgttcggaagctttgtcatgggagtgacattggagaaaccacctcagcttttcacttggaatggatcaagtccttactggagaagtggacagtgggaaaaaacgaagttcatcggaataccgacgatgaccaacacatactacgatatccggcaagataacatccggggaacctcatatttttacctcaataattacaacaactccatctttggatatactttcatctcttctgaaggatctgtaaagtcggctttttgggccaatgggtggttaacatcctggaaggcaccggcaccaactaacccttgtgaaatttatggaatatgtggccccttcggagtttgcaactcgtttagttcacctatgtgcagatgcttaaaaggttttaaaccaagatcaaatgaaaaatggaacagaggaaactggaccagagggtgccttagggaaatggaattgaattgtcagaaatctgcaagcgcagcagcttcaacaactgtggaaaaagatatgttctggcaaatgagacaaataaaattgcctgattccgctgattatttgttgatagataatgtggaaggatgtcaaagttggtgcctagaaaattgctcgtgcttgggcttttcttatgtgaatgctataggatgtatggcttggagtaaagacctcctagatactcagcaattctccacagatggcgaagatctatttattcgactagcggatgcgagtgtgggtgcagatacagggaagtttaggaaaatgacaatcccaaggctccttaggtcagaagaaccactaagggaaacttcttggaaagagcaaatgaaggaagatgatgcatcgcaattggtcgtttatgattttgatagcatacgcctcgcgacagacaacttcaacttgaaaaacaaacttgggcagggagggcttggcccggtttataagggaaaactgaacaatggtaaggagatagcagcaaagagactttcgagcagctcaagccaaggcatagcagagttcaagaatgagatccttctaatatccaaacttcaacatcaaaatctagtgagactcctcggttgctgtattgaaggagaagaaaagattctagtgtatgagtacttgcccaacaagagcttggacaccttcctttttgattcaagagagaaggcaaaacttagctggagtgtacgcttccgcattatccagggggtcgcaagagggctgctttacctccactgcgattcttgccttagagtcatacatcgggatttgaaagtaagcaacattcttttggatgaaaagatgaatcccaagatttcagattttgggctgtcacggatgtttgaaggcactcaagttttggtaaatactcacaaagttgtggggacacttggctacatgtctccagagtatgccatgggtgggatattttctgagaaatctgatgtttatagctttggagtactgctattggagattatcagcggcaagaagaacacaagtttagattacccagggcagcatctcaatctccttgcttttgcttggcacttgtggtgtgaaggcagaggattggacctaatagatgaagccattgctaatgcattttcggtgtcagaagtaatgagatgcattcagttagggcttctctgtacgcaagaccatgccacagatagacccaacatgttggccgtggttctaatgctgaatggggagtccaatctttcacagccaaagcaaccgacatatacattttcaagctcgctggcccacgaagtcccatcacaagaagaaagcatccggtccatgaataccatcaccattactacggttgaaggaaga

SEQ ID NO: 828 - protein, 760 aa, Eucalyptus grandis
  Eucgr.E04147.1
MTLHLCSLLVFSLPQALQSSTIDSITASSPLVQNQTLVSSSQIFELGFFTPKGSAKQYVGIWYKKMAPSRVVWVANRDKPLGHTDQSATLLSDFGNFVLQDRNENIMWESFDEPTNTLLPNMKIGVNVKTGKKLNLTSWKGEDDPSFGSFVMGVTLEKPPQLFTWNGSSPYWRSGQWEKTKFIGIPTMTNTYYDIRQDNIRGTSYFYLNNYNNSIFGYTFISSEGSVKSAFWANGWLTSWKAPAPTNPCEIYGICGPFGVCNSFSSPMCRCLKGFKPRSNEKWNRGNWTRGCLREMELNCQKSASAAASTTVEKDMFWQMRQIKLPDSADYLLIDNVEGCQSWCLENCSCLGFSYVNAIGCMAWSKDLLDTQQFSTDGEDLFIRLADASVGADTGKFRKMTIPRLLRSEEPLRETSWKEQMKEDDASQLVVYDFDSIRLATDNFNLKNKLGQGGLGPVYKGKLNNGKEIAAKRLSSSSSQGIAEFKNEILLISKLQHQNLVRLLGCCIEGEEKILVYEYLPNKSLDTFLFDSREKAKLSWSVRFRIIQGVARGLLYLHCDSCLRVIHRDLKVSNILLDEKMNPKISDFGLSRMFEGTQVLVNTHKVVGTLGYMSPEYAMGGIFSEKSDVYSFGVLLLEIISGKKNTSLDYPGQHLNLLAFAWHLWCEGRGLDLIDEAIANAFSVSEVMRCIQLGLLCTQDHATDRPNMLAVVLMLNGESNLSQPKQPTYTFSSSLAHEVPSQEESIRSMNTITITTVEGR

SEQ ID NO: 829 - DNA, 2511 bp, Eucalyptus grandis
  Eucgr.E04137.1
atgactttgcacctgtgctctttgcttgtcatctcccttcttcaagcccttcaaagcagcacaatttacagcataactgcatcaagcccactggttcagaaccaaacccttgtctctcgtagtcaaatctttgagctcgggttcttcacacctaatggatcagcaaagcagtacgtaggaatatggtacaagaacatgactccctccaaagttgtctgggtggccaacagggacaagccaattggacacacagataaatctgcgagtttaataattggcaacgatggaaatctgaagcttctagatgggcaacaaaacactgtgtggtcgactaatgtcatggcaaagtcgaattattctgcagcccacctttcagactatggaaactttgttcttcaagacaggaatgcgaatatattgtgggaaagctttgatgagccaactgacactctcctgccaaacatgaagatcggagtaaacgtgaaaacaggaaagaaacgaaacttgatttcctggaaaggtgaagatgatccctcgttcggaagctttgttgtaggaatgacatcggagacaccacctcagcttttcacttggaatggattgagtccttactggagaagtggacagtgggataaaaccaggttcattggaatacccgccatggacggcacatactttgatgtccagcaagatattgtccagggaacatcatattatatcaacaataatcacaacaactccatctttggatatactttcatctcttctgaaggaactttaaatggggttttatgggccaataatggctggttaacatactggagggcaccgaaaccaaataacccctgtgaaatttatggaaaatgtgggccctttggagtttgcaaccaaattagttcacctatttgcagatgcttagaaggtttcaaaccaatatcagatgaagaatggaacagaggaaactggaccagaggatgccttagggaattggaattgaattgtcagaaatctgccagcacagctgcttcaacgactgtaaaaaaagataggttctggaaaataacacagatgaagttacctgattccgctgattattctttgatagatgatgcagaaagatgtcaaagttggtgcctagaaaactgcacatgcttggcctattcttttgtgaatgctataggatgtatgacttggagtaaagacctcctagatactctgcagctctccacaggtggcgaagaactgtttattcgacttgtggacacaagtgcgggtgtggttgcggatacaggtgtacctacacggacaaaacttatcatcagtctcagtactatatctggaatcatcttatttggagctagtatttcagtctgttgtctttcaaagtggagaggaaagcttaggaaaatgacaatcccaaggctctttaggtcagtggctgcagccatcagatcagaaaaactgctaagggaaactgcatcgaaagagcaaatgaaggaagatgatgcatcgaaagtggtggtttatgattttgatagcatacgcctagcgacagacaacttcgacgcaaaaaacaaacttgggcagggagggtttggcccagtttataagggaaaactgagcaatggtaaggagatagcagcaaagagactttcgagcagctcaggccaaggcatagcagagttcaagaatgagatccttctaatatctaaacttcaacaccgaaatctggtgagactcctcggtagctgcaccgaaagagaagaaaagattctagtgtatgagtacttgccgaacaagagcttggacgccttcctttttgattcagaaaagaaggcgaaacttagttgggtcgtacgattccgcattatcgagggggttgcgagagggctgctttacctccaccgcgattcttgccttagggtcatacatcgagatttgaaagtgagcaacattctcttggatgaaaagatgaatccaaagatttctgattttgggttggcgcggatgtttgaaagcagtcaagttttggtcaatactcacaaagttgtggggacactcggctatatgtctcctgagtatgctatgggtggggcattttctgagaaatccgatgtttatagctttggagtactgctattggagattatcagcagcaagaagaacacaagtttagattaccctgggcagcatctcaatctccttgcttatgcttggcacttgtggtgtgaagggagaggtttggacctaatggatgcagccattgctaacgcattttcagcgttagaagtaatgagatgcattcaggtagggcttctctgtacgcaagaccacgccatagatagacccaacatgtcagccgtagttctaatgctgaatggggagtccgaactttcacaaccaaagcaaccggcatatacatttcaaaggctgctggctcagcaagtccaatcacaagaaggaagcatccggtccatgaataccatctccattactacagttgaaggaaga

SEQ ID NO: 830 - protein, 837 aa, Eucalyptus grandis
  Eucgr.E04137.1
MTLHLCSLLVISLLQALQSSTIYSITASSPLVQNQTLVSRSQIFELGFFTPNGSAKQYVGIWYKNMTPSKVVWVANRDKPIGHTDKSASLIIGNDGNLKLLDGQQNTVWSTNVMAKSNYSAAHLSDYGNFVLQDRNANILWESFDEPTDTLLPNMKIGVNVKTGKKRNLISWKGEDDPSFGSFVVGMTSETPPQLFTWNGLSPYWRSGQWDKTRFIGIPAMDGTYFDVQQDIVQGTSYYINNNHNNSIFGYTFISSEGTLNGVLWANNGWLTYWRAPKPNNPCEIYGKCGPFGVCNQISSPICRCLEGFKPISDEEWNRGNWTRGCLRELELNCQKSASTAASTTVKKDRFWKITQMKLPDSADYSLIDDAERCQSWCLENCTCLAYSFVNAIGCMTWSKDLLDTLQLSTGGEELFIRLVDTSAGVVADTGVPTRTKLIISLSTISGIILFGASISVCCLSKWRGKLRKMTIPRLFRSVAAAIRSEKLLRETASKEQMKEDDASKVVVYDFDSIRLATDNFDAKNKLGQGGFGPVYKGKLSNGKEIAAKRLSSSSGQGIAEFKNEILLISKLQHRNLVRLLGSCTEREEKILVYEYLPNKSLDAFLFDSEKKAKLSWVVRFRIIEGVARGLLYLHRDSCLRVIHRDLKVSNILLDEKMNPKISDFGLARMFESSQVLVNTHKVVGTLGYMSPEYAMGGAFSEKSDVYSFGVLLLEIISSKKNTSLDYPGQHLNLLAYAWHLWCEGRGLDLMDAAIANAFSALEVMRCIQVGLLCTQDHAIDRPNMSAVVLMLNGESELSQPKQPAYTFQRLLAQQVQSQEGSIRSMNTISITTVEGR

SEQ ID NO: 831 - DNA, 2448 bp, Eucalyptus grandis
  Eucgr.E04137.2
atgactttgcacctgtgctctttgcttgtcatctcccttcttcaagcccttcaaagcagcacaatttacagcataactgcatcaagcccactggttcagaaccaaacccttgtctctcgtagtcaaatctttgagctcgggttcttcacacctaatggatcagcaaagcagtacgtaggaatatggtacaagaacatgactccctccaaagttgtctgggtggccaacagggacaagccaattggacacacagataaatctgcgagtttaataattggcaacgatggaaatctgaagcttctagatgggcaacaaaacactgtgtggtcgactaatgtcatggcaaagtcgaattattctgcagcccacctttcagactatggaaactttgttcttcaagacaggaatgcgaatatattgtgggaaagctttgatgagccaactgacactctcctgccaaacatgaagatcggagtaaacgtgaaaacaggaaagaaacgaaacttgatttcctggaaaggtgaagatgatccctcgttcggaagctttgttgtaggaatgacatcggagacaccacctcagcttttcacttggaatggattgagtccttactggagaagtggacagtgggataaaaccaggttcattggaatacccgccatggacggcacatactttgatgtccagcaagatattgtccagggaacatcatattatatcaacaataatcacaacaactccatctttggatatactttcatctcttctgaaggaactttaaatggggttttatgggccaataatggctggttaacatactggagggcaccgaaaccaaataacccctgtgaaatttatggaaaatgtgggccctttggagtttgcaaccaaattagttcacctatttgcagatgcttagaaggtttcaaaccaatatcagatgaagaatggaacagaggaaactggaccagaggatgccttagggaattggaattgaattgtcagaaatctgccagcacagctgcttcaacgactgtaaaaaaagataggttctggaaaataacacagatgaagttacctgattccgctgattattctttgatagatgatgcagaaagatgtcaaagttggtgcctagaaaactgcacatgcttggcctattcttttgtgaatgctataggatgtatgacttggagtaaagacctcctagatactctgcagctctccacaggtggcgaagaactgtttattcgacttgtggacacaagtgcgggtgtggttgcggatacaggtgtacctacacggacaaaacttatcatcagtctcagtactatatctggaatcatcttatttggagctagtatttcagtctgttgtctttcaaagtggagaggaaagcttaggaaaatgacaatcccaaggctctttaggtcagtggctgcagccatcagatcagaaaaactgctaagggaaactgcatcgaaagagcaaatgaaggaagatgatgcatcgaaagtggtggtttatgattttgatagcatacgcctagcgacagacaacttcgacgcaaaaaacaaacttgggcagggagggtttggcccagtttataagggaaaactgagcaatggtaaggagatagcagcaaagagactttcgagcagctcaggccaaggcatagcagagttcaagaatgagatccttctaatatctaaacttcaacaccgaaatctggtgagactcctcggtagctgcaccgaaagagaagaaaagattctagtgtatgagtacttgccgaacaagagcttggacgccttcctttttgattcagaaaagaaggcgaaacttagttgggtcgtacgattccgcattatcgagggggttgcgagagggctgctttacctccaccgcgattcttgccttagggtcatacatcgagatttgaaagtgagcaacattctcttggatgaaaagatgaatccaaagatttctgattttgggttggcgcggatgtttgaaagcagtcaagttttggtcaatactcacaaagttgtggggacactctttggagtactgctattggagattatcagcagcaagaagaacacaagtttagattaccctgggcagcatctcaatctccttgcttatgcttggcacttgtggtgtgaagggagaggtttggacctaatggatgcagccattgctaacgcattttcagcgttagaagtaatgagatgcattcaggtagggcttctctgtacgcaagaccacgccatagatagacccaacatgtcagccgtagttctaatgctgaatggggagtccgaactttcacaaccaaagcaaccggcatatacatttcaaaggctgctggctcagcaagtccaatcacaagaaggaagcatccggtccatgaataccatctccattactacagttgaaggaaga

SEQ ID NO: 832 - protein, 816 aa, Eucalyptus grandis
  Eucgr.E04137.2
MTLHLCSLLVISLLQALQSSTIYSITASSPLVQNQTLVSRSQIFELGFFTPNGSAKQYVGIWYKNMTPSKVVWVANRDKPIGHTDKSASLIIGNDGNLKLLDGQQNTVWSTNVMAKSNYSAAHLSDYGNFVLQDRNANILWESFDEPTDTLLPNMKIGVNVKTGKKRNLISWKGEDDPSFGSFVVGMTSETPPQLFTWNGLSPYWRSGQWDKTRFIGIPAMDGTYFDVQQDIVQGTSYYINNNHNNSIFGYTFISSEGTLNGVLWANNGWLTYWRAPKPNNPCEIYGKCGPFGVCNQISSPICRCLEGFKPISDEEWNRGNWTRGCLRELELNCQKSASTAASTTVKKDRFWKITQMKLPDSADYSLIDDAERCQSWCLENCTCLAYSFVNAIGCMTWSKDLLDTLQLSTGGEELFIRLVDTSAGVVADTGVPTRTKLIISLSTISGIILFGASISVCCLSKWRGKLRKMTIPRLFRSVAAAIRSEKLLRETASKEQMKEDDASKVVVYDFDSIRLATDNFDAKNKLGQGGFGPVYKGKLSNGKEIAAKRLSSSSGQGIAEFKNEILLISKLQHRNLVRLLGSCTEREEKILVYEYLPNKSLDAFLFDSEKKAKLSWVVRFRIIEGVARGLLYLHRDSCLRVIHRDLKVSNILLDEKMNPKISDFGLARMFESSQVLVNTHKVVGTLFGVLLLEIISSKKNTSLDYPGQHLNLLAYAWHLWCEGRGLDLMDAAIANAFSALEVMRCIQVGLLCTQDHAIDRPNMSAVVLMLNGESELSQPKQPAYTFQRLLAQQVQSQEGSIRSMNTISITTVEGR

SEQ ID NO: 833 - DNA, 2028 bp, Eucalyptus grandis
  Eucgr.E04140.1
atggcaaagtcaaattattctgcagccctcctttcagactatggaaactttgttcttcaagacaggaatgcgaatatattgtgggaaagctttgatgagccaactgacgctctcctgccaaacatgacgattggagtaaacatgaaaacaggaaagaaacgaaacttgatttcctggaaaggcgaagatgatccctccttcggaagctttgtcgttggagtgacatcggagacaccacctcagcttttcacttggaatggattgagtcgttactggagaagtggacaatgggataaaaccaggttcatcggaatacccaccatggacaacacatactatgatgtccagcaagatattgtccagggaacatcaaattataccaacaataatcacaacaactccatctttggatatactttcatctcttttgaaggaactttaaaggcggtttggtgggccaatcactggtcaacatactgggaggcaccggcaccaactaaaccttgtgaaatttatggaaaatgtgggccctttggagtttgcaaccagtctagttcacctatttgtcgatgcttagaaggtttcaaaccaatatcagatgaagaatggaacagaggaaactggaccaaaggatgccttagggaattggaattgaattgtcagaaatctgcaagcacagctgcttcaacgactgtcaaaaaagatatgttcaggaaaatgagtgagatgaagttacctgattccgctgattatttttggtgcctagaaaactgctcttgcttggcctattcttatgtgaatgctataggatgtatgacttggagtaaagacctcctagatactatgcaactccccacaggtggcgaagatctgtttattcgacttgtggacacgagtgcaggtgctgcgggaaagcttaggaaaatgacaatcccaagtctctttaggtcagtggctgcaaccatcagatcagaaaaactaccaagggaaactgcatggaaagagcaaatgaaggaagatgatgcatcggaagcggtggtttatgattttgatagcatacgcctagcgacagacaacttcgatgcaaaaaacaaactcgggcagggagggtttggcccagtttataagggaaaactgagcgatggtaaggagatagcagcaaagagactttcgagtagctcaggccaaggcatagcagagttcaagaatgagatacttctaatatccaaacttcaacaccgaaatctggtcaaactcctcggttactgcaccgaaagagaagaaaagattctagtgtatgagtacttgccgaacaagagcttggacgccttcctttttgattcagaaaagaaggcgaaacttagctgggccgtacgattccacataatccagggggttgcaagagggctactctacctccaccgtgattcttgctttagggtcatacatcgagatttgaaagtgagcaacattctcttggacgaaaagatgaatcccaagatttctgattttgggttggcgcggatgttcgaaagcagtcaagttttggtcaatactcacaaagttgtggggacactaggctacatgtctcccgagtatgctatgggtgggacattttcagagaaatccgatgtttatagctttggagtactattattggagattatcagtagcaagaagaatacaaatttagattaccccgggcagcatcttaatctccttgcttatgcttggcacttgtggtgtgaagggagaggattggacttgatggatgcagccattgctaacgcattttcggcattagaagtaatgagatgcattcaagtagggcttctctgtacgcaagaccacaccatagatagacccaacatgtcagccgtggttctaatgctgaatggggagtccaaactttcaccgccgaagcaaccggcatatatatttcaaaggctgctggcccaccaagtccaatcacaagaaggaagcatccggtccatgaataccatcaccattactacagttgaaggaaga

SEQ ID NO: 834 - protein, 676 aa, Eucalyptus grandis
  Eucgr.E04140.1
MAKSNYSAALLSDYGNFVLQDRNANILWESFDEPTDALLPNMTIGVNMKTGKKRNLISWKGEDDPSFGSFVVGVTSETPPQLFTWNGLSRYWRSGQWDKTRFIGIPTMDNTYYDVQQDIVQGTSNYTNNNHNNSIFGYTFISFEGTLKAVWWANHWSTYWEAPAPTKPCEIYGKCGPFGVCNQSSSPICRCLEGFKPISDEEWNRGNWTKGCLRELELNCQKSASTAASTTVKKDMFRKMSEMKLPDSADYFWCLENCSCLAYSYVNAIGCMTWSKDLLDTMQLPTGGEDLFIRLVDTSAGAAGKLRKMTIPSLFRSVAATIRSEKLPRETAWKEQMKEDDASEAVVYDFDSIRLATDNFDAKNKLGQGGFGPVYKGKLSDGKEIAAKRLSSSSGQGIAEFKNEILLISKLQHRNLVKLLGYCTEREEKILVYEYLPNKSLDAFLFDSEKKAKLSWAVRFHIIQGVARGLLYLHRDSCFRVIHRDLKVSNILLDEKMNPKISDFGLARMFESSQVLVNTHKVVGTLGYMSPEYAMGGTFSEKSDVYSFGVLLLEIISSKKNTNLDYPGQHLNLLAYAWHLWCEGRGLDLMDAAIANAFSALEVMRCIQVGLLCTQDHTIDRPNMSAVVLMLNGESKLSPPKQPAYIFQRLLAHQVQSQEGSIRSMNTITITTVEGR

SEQ ID NO: 835 - DNA, 2160 bp, Eucalyptus grandis
  Eucgr.E04142.1
atgacatcatttctcttctctgccacgtcagatgcacttcaaagcagcacaatttacaacataactgcatcaagtccactggttcagaaccaaaccctggtctctagtagtcaaatctttgagcttgggttcttcacgcctaatggatcagcaaagcagtacctaggaatatggtacaagaacatgactccctcccaaaaaaactatggaaactttgttcttcaagacaggaatgcgaatatattgtgggaaagctttgatgagccaactgacgctctcctgccaaacatgacgattggagtaaacatgaaaacaggaaagaaacgaaacttgatttcctggaaaggcgaagatgatccctccttcggaagctttgtcgtaggagtgacatcggagacaccacctcagcttttcacttggaatggattgagtcgttactggagaaatgggcaatgggataaaaccaggttcatcggaatacccaccatggacaacacatactatgatgtccagcaagatattgtccagggaacatcaaattataccaacaataatcacaacaactccatctttggatatactttcatctcttttgaaggaactttaaaggcggtttggtgggccaatcactggtcaacgtactgggaggcaccgacaccaactaaaccttgtgaaatttatggaaaatgtgggccctttggagtttgcaaccagtctagttcacctatttgtcgatgcttagaaggtttcaaaccaatatcagatgaagaatggaacagaggaaactggaccaaaggatgccttagggaattggaattgaattgtcagaaatctgcaagcacagctgcttcaacgactgtcaaaaaagatatgttcaggaaaatgagtgagatgaagttacctgattccgctgattatttgttgataaatgatgaggaaagatgtcgaagttggtgcctagaaaactgctcttgcttggcctattcttatgtgaatgctataggatgtatgacttggagtaaagacctcctagatactctgcaactccccacaggtggcgaagatctgtttattcgacttgtggacacgagtgcaggtgctgcggaaaaactaccaagggaaactgcatggaaagagcaaatgaaggaagatgatgcatcggaagcggtggtttatgattttgatagcatacgcctagcaacagacaacttcgatgcaaaaaacaaactcgggcagggagggtttggcccagtttataagggaaaactgagcgatggtaaggagatagcagcaaagagactttcgagtagctcaggccaaggcatagcagagttcaagaatgagatacttctaatatccaaacttcaacaccgaaatctggtcaaactcctcggttactgcaccgaaagagaagaaaagattctagtgtatgagtacttgccgaacaagagcttggacgccttcctttttgattcagaaaagaaggcgaaacttagctgggccgtacgattccacataatccagggggttgcaagagggctactctacctccaccgcaattcttgctttagggtcatacatcgatatttgaaagtgagcaacattctcttggacgaaaagatgaatcccaagatttctgattttgggttggcacgaatgttcgaaagcagtcaggttttggtcaatactcacaaagttgtggggacactaggctacatgtctcccgagtatgctatgggtgggacattttcagagaaatccgatgtttatagctttggagtactattattggagattatcagcagcaagaagaacaaaaatttagattaccccgggcagcatcttaatctccttgcttatgcttggcacttgtggtgtgaagggagaggattggacctgatggatgcaaccattgctaacgcattttcggcattagaagtaatgagatgcattcaagtagggcttctctgtacgcaagaccacaccatagatagacccaacatgtcagccgtggttctaatgctgaatggggagtccgaactttcaccgccgaagcaaccggcatatatatttcaaaggctgttggcccaccaagtccaatcacaagaaggaagcatccggtccatgaataccatcaccattactacagttgaaggaaga

SEQ ID NO: 836 - protein, 720 aa, Eucalyptus grandis
  Eucgr.E04142.1
MTSFLFSATSDALQSSTIYNITASSPLVQNQTLVSSSQIFELGFFTPNGSAKQYLGIWYKNMTPSQKNYGNFVLQDRNANILWESFDEPTDALLPNMTIGVNMKTGKKRNLISWKGEDDPSFGSFVVGVTSETPPQLFTWNGLSRYWRNGQWDKTRFIGIPTMDNTYYDVQQDIVQGTSNYTNNNHNNSIFGYTFISFEGTLKAVWWANHWSTYWEAPTPTKPCEIYGKCGPFGVCNQSSSPICRCLEGFKPISDEEWNRGNWTKGCLRELELNCQKSASTAASTTVKKDMFRKMSEMKLPDSADYLLINDEERCRSWCLENCSCLAYSYVNAIGCMTWSKDLLDTLQLPTGGEDLFIRLVDTSAGAAEKLPRETAWKEQMKEDDASEAVVYDFDSIRLATDNFDAKNKLGQGGFGPVYKGKLSDGKEIAAKRLSSSSGQGIAEFKNEILLISKLQHRNLVKLLGYCTEREEKILVYEYLPNKSLDAFLFDSEKKAKLSWAVRFHIIQGVARGLLYLHRNSCFRVIHRYLKVSNILLDEKMNPKISDFGLARMFESSQVLVNTHKVVGTLGYMSPEYAMGGTFSEKSDVYSFGVLLLEIISSKKNKNLDYPGQHLNLLAYAWHLWCEGRGLDLMDATIANAFSALEVMRCIQVGLLCTQDHTIDRPNMSAVVLMLNGESELSPPKQPAYIFQRLLAHQVQSQEGSIRSMNTITITTVEGR

SEQ ID NO: 837 - DNA, 2385 bp, Eucalyptus grandis
  Eucgr.E04143.1
atggccctgagtgctactggcctcaaagggacaatttccgatataagatccaaaattccagtccaatgcccaagcacaatttaccgcataactgcatcaagtccactggttcagaaccaaacccttgtctctagtagtcaaatctttgagctcgggttcttcacgcctaatcgatcagcaaagcagtacctaggaatatggtacaagaacatgccttcctccaaaaaagtctgggtggccaacagggacaagccaattggacacacagataaatctgcgagtttaaaaattagcaacgatggaaatctgaagcttcttgatgggcaacaaaacactctgtggtcaactcatgtcatggcaaagtcgaattattctacagccttcctttcagactatggaaactttgttcttcgagacaggaatgcgaataacttgtgggaaagctttgatgagccaactgacactctcctgccaaacatgaagatcggagtaaacacgaaaacaggaaataaacgaaacttgatttcctggaaaggcgaaaatgatccctcgtttggaagctttgtcgtagaattgacatcggagagaccacctcagcttttcactcggaatggatcgagtccttactggagaagtggacagtgggatacaactaggttcatcggaatacccgccatggacaacacatactttgatgtcaagcaagatattgtccagggaacatcatattataccaacaataatcacaacaactccatctttggatatcttttcatctcttttgaaggaactttaaaggtggattcatggaccaataatcgctggtcaacaaagtggaacgcaccggcaccaactaacccttgtgaaatttatggaaaatgtgggccctttggagtttgcaaccagtttagttcacctatttgcagatgcttagaaggtttcaaaccaatatcagatgaagagtggaacagaggaaactggaccagaggatgccttagggaattggaattgaattgtcagaaatctgccagcacagctgcatcaacgactgtcaaaaaagataggttctggaaaataacacagatgaagttacctgattccgctgattattcttcgatagatgatgcagaaagatgtcaaagttggtgcctaggaaactgcacatgcttggcctattcttatgtgaacgctataggatgtatggcttggagtaaagacctcctagatactctgcaactctccacaggtggcgaagatctgtttattcgacttgtggacgcaagtgcggggaagtttgggaaaatgacaatcccaaggctctttacgtcagaagaactgctaagggacactgcttggaaagagcaaatgaaggaagatgatacatcaaaattggtcttttatgactttgatagcatacgcctcgcaacagacaactttaacgtgaaaaacaaacttgggcaaggagggtttggcccggtttataagggaaaactgaacgatggtaaggagatagcagcaaagagactttcaagcagctcaggccaaggcatagcggagttcaagaatgagatccttctaatatccaaacttcaacaccgaaatctggtgagactccttggttgctgcattgaaggagaggaaaagattctagtgtatgagtacttgcccaacaagagcttggacaccttcctctttgattcaaaagagaaggcaaaacttagctggagtgtacgcttccacattatccagggggtcgccagaggactgctttacctccaccgcgattcttgccttagagtcatacatcgagatttgaaagtgagcaacattctcttggatgaaaagatgaatcccaagatttcagattttgggctgtcacggatgtttgaaggcactcaagttttggtaaatactcacaaagttgtggggacacttggctacatgtctccagagtatgccatgggtgggatattttctgagaaatctgatgtttatagctttggagtactgctattggagattatcagcggcaagaagaacacaagtttagattacccagggcagaatctcaatctcctcgcttatgcttggcacttgtggtgtgaaggtagaggatcagatctaatagatgaaggcattgccgatgcattttcggtgttagaagtgatgagatgcattcaattggggcttctctgtacgcaagaccatgccacagatagacccaacatgttggccgtggttctaatgctgaatggggagtccaatctttcacagccaaagcaaccgacctatacattttcacgctcgctggctcacgaagtcccatcacaagaagaaagcatccggtccatgaataccatcaccattactacggttgaaggaaga

SEQ ID NO: 838 - protein, 795 aa, Eucalyptus grandis
  Eucgr.E04143.1
MALSATGLKGTISDIRSKIPVQCPSTIYRITASSPLVQNQTLVSSSQIFELGFFTPNRSAKQYLGIWYKNMPSSKKVWVANRDKPIGHTDKSASLKISNDGNLKLLDGQQNTLWSTHVMAKSNYSTAFLSDYGNFVLRDRNANNLWESFDEPTDTLLPNMKIGVNTKTGNKRNLISWKGENDPSFGSFVVELTSERPPQLFTRNGSSPYWRSGQWDTTRFIGIPAMDNTYFDVKQDIVQGTSYYTNNNHNNSIFGYLFISFEGTLKVDSWTNNRWSTKWNAPAPTNPCEIYGKCGPFGVCNQFSSPICRCLEGFKPISDEEWNRGNWTRGCLRELELNCQKSASTAASTTVKKDRFWKITQMKLPDSADYSSIDDAERCQSWCLGNCTCLAYSYVNAIGCMAWSKDLLDTLQLSTGGEDLFIRLVDASAGKFGKMTIPRLFTSEELLRDTAWKEQMKEDDTSKLVFYDFDSIRLATDNFNVKNKLGQGGFGPVYKGKLNDGKEIAAKRLSSSSGQGIAEFKNEILLISKLQHRNLVRLLGCCIEGEEKILVYEYLPNKSLDTFLFDSKEKAKLSWSVRFHIIQGVARGLLYLHRDSCLRVIHRDLKVSNILLDEKMNPKISDFGLSRMFEGTQVLVNTHKVVGTLGYMSPEYAMGGIFSEKSDVYSFGVLLLEIISGKKNTSLDYPGQNLNLLAYAWHLWCEGRGSDLIDEGIADAFSVLEVMRCIQLGLLCTQDHATDRPNMLAVVLMLNGESNLSQPKQPTYTFSRSLAHEVPSQEESIRSMNTITITTVEGR

SEQ ID NO: 839 - DNA, 2529 bp, Eucalyptus grandis
  Eucgr.E03963.1
atgcttcttgaatttgttcatcattgttcttacgattgcgtacttgtgtattctttgctcgtctgctccctgtttcaagcacttcaaagcagcacaatttacaatataactgcatcaaggccacttattcagaaccaaacccttgtctcgcctagtgaaatctttgagctcgggttcttcacgcctaatggatcagaaaagcagtacgtaggaatatggtacaagaacacaactttctccaaagttgtctgggtggccaacagggacaagccacttggacacaaagatcaatctgcgagtttgataattagcggagatggaaatctgaagcttcttgatgggcaacaaagtactgtctggtctacaaatgtcatggcgaagtctaattattctgcagcagtgcttttagactttggaaaccttgttcttcaagacgggaaagcaaataaaatgtgggaaagcttcgatgagccaaccgacactctcctgccaaacatgaagatcggagtaaatgtgaaaacaggaaagaaaaaatacttgatttcctggaaaggtgaagatgatccatcgcccggaagctttgtccttggagtgacatcggagacaccgcctcagctttttgcttggaatggatcaagtccatactggagaagtggacagtgggataaatccaagtttaatggaataccgaccatgagcaacaaatacctgagcggcaatcagctcctgcaaaatatcaaccagggaacgacatattatttccgcaattattacaacaactcctttggatatgttttcatctcatcggaaggatctatagggtctgttcgttggggggatggatggtcaacaaactgggaaggatcacgaactaaccgctgtgaaatttatggaacatgtggtcctttcggagtttgcgacacgtttagttcacctatatgcagctgcttaaaagggtttaaacccaggtcagatgaagagtggaaccgaggaaactggaccggagggtgcgttaggaaaatggaattgaattgtcagaaatacgcacatgcagcagctatgacgactgtggaaaaagatgtgttctggccaatgaaacatatgaaattgcctgattctgctgattatttgtcaaacatagctgatgcagaaggatgtcgaagttggtgcctaggaaactgctcgtgcttggccttttcttacgtggatactgtaggatgtatggcttggtgtaaaaacctcatagatactcagcaattctccagagaaggcagagatctatttattcgacttgtggatgtggataaaggtgtacctacgaagacaaaactcatcatcagcttaagtactatttctggcatcatgttattcggagctggcatttcagtgtgtggtcttttcaagtggagagggaaatttaggaaaatgacaatcccaagggtccttaattcaaaggccacaaccaacagatcagaggaattgctgagggaaactgcatggaaagagcaaatgaagcaaggtgatgcatcggaattaatggtttatgatttggacagcatactccttgcaacgaacaacttcaacgtgaagaacaaactcgggcagggagggtttggccctgtttataagggaaagctgaacgatggtaaggacatagctgtgaaaagactttcgagcagctcaggccaaggcattgcagagttcaagaatgagatcctcctgatatccaaacttcaacaccgaaatctggtgagacttgttgcttactgcactgaaggagaagaaaagatactagtgtatgagtacttgccgaacaggagcttggacgcctttcttttcgattcaaaagagaaggcaaaactcagctggggcatccgcttccacattatccagggcattgcaagagggctgctctacctccaccgcgattcatgcctcagggtcatacatcgagatttgaaagtgagcaacattctcttggacgaaaaaatgaatcccaagatttcagattttgggctagcgcggatgtttgaaggcactcaagttttcgtaaatactcacaaagttgtggggacactgggttacatgtctcccgaatatgccatgggtgggatattttctgaaaaatctgatgtttatagctttggcgtactgatattggagcttatcagcagcaagaagaacacaagtttagattaccatggacagcatctcaatctcctgacctatgtatggcatttgtggtgtgaaggcagaggattggccctaatggatgaagccattgctgacgcattttcgctgtcagaagtgatgagatgcattcaattagggcttctctgcgtacaggaacatgccacagatagacccgacatgtcagctgtggttctaatgctaagtgggcagtctgatcttccacagccaaagcaaccagcatttacatttcaactctcaacgactcatgaagtccaatcaaaagaagaatacattcagtccaggaataccatcaccattactatggctgaaggaaga

SEQ ID NO: 840 - protein, 843 aa, Eucalyptus grandis
  Eucgr.E03963.1
MLLEFVHHCSYDCVLVYSLLVCSLFQALQSSTIYNITASRPLIQNQTLVSPSEIFELGFFTPNGSEKQYVGIWYKNTTFSKVVWVANRDKPLGHKDQSASLIISGDGNLKLLDGQQSTVWSTNVMAKSNYSAAVLLDFGNLVLQDGKANKMWESFDEPTDTLLPNMKIGVNVKTGKKKYLISWKGEDDPSPGSFVLGVTSETPPQLFAWNGSSPYWRSGQWDKSKFNGIPTMSNKYLSGNQLLQNINQGTTYYFRNYYNNSFGYVFISSEGSIGSVRWGDGWSTNWEGSRTNRCEIYGTCGPFGVCDTFSSPICSCLKGFKPRSDEEWNRGNWTGGCVRKMELNCQKYAHAAAMTTVEKDVFWPMKHMKLPDSADYLSNIADAEGCRSWCLGNCSCLAFSYVDTVGCMAWCKNLIDTQQFSREGRDLFIRLVDVDKGVPTKTKLIISLSTISGIMLFGAGISVCGLFKWRGKFRKMTIPRVLNSKATTNRSEELLRETAWKEQMKQGDASELMVYDLDSILLATNNFNVKNKLGQGGFGPVYKGKLNDGKDIAVKRLSSSSGQGIAEFKNEILLISKLQHRNLVRLVAYCTEGEEKILVYEYLPNRSLDAFLFDSKEKAKLSWGIRFHIIQGIARGLLYLHRDSCLRVIHRDLKVSNILLDEKMNPKISDFGLARMFEGTQVFVNTHKVVGTLGYMSPEYAMGGIFSEKSDVYSFGVLILELISSKKNTSLDYHGQHLNLLTYVWHLWCEGRGLALMDEAIADAFSLSEVMRCIQLGLLCVQEHATDRPDMSAVVLMLSGQSDLPQPKQPAFTFQLSTTHEVQSKEEYIQSRNTITITMAEGR

SEQ ID NO: 841 - DNA, 2529 bp, Eucalyptus grandis
  Eucgr.E03972.1
atggttcttgaatttgttcatcattgttcttatgattgtgtatttgtgtattctttgctcgtctgctcgctgtttcaagcacttcaaagcagcacaatttacaatataactgcatcaaggccactcattcagaaccaaacccttgtctctccttgtaaaatcttcgagctcgggttcttcgggcctaatggatcagaaaagcagtacgtaggaatatggtacaagaacacgactttctccaaagttgtctgggtggccaacagggacaagccacttggacacaaagatcaatctgcaagtttgataattggcggagatggaaatctgaagcttctagatgggcgaaaaaatgctgtctggtctacaaatgtcatggcgaagtctaattattctgcagcagtgcttttagactttggaaaccttgttcttcaagacgggaatgcaaatgaaatgtgggaaagcttcgatgagccaaccgacactctcctgccaaacatgaagatcggagtaaacgtgaaaacaggaaagaaaaaatacttgatttcctggaaaggtgaagatgatccttcgcccggaagctttgtccttggagtaacgtcggagacaccacctcagcttttcgcttggaatggatcaagtccatactggagaagcggacagtgggataaatccaagtttaatggaataccgaacatgagcaacaaatacctgagcggccatcagcttgtgcaaaatatcaaccagggaacgacatattatttccgcaattattacaacaactcctttggatatgttttcatctcatcggaaggatctatagagtctgttcgttggggggatggatggtcaacaaactgggaagcatcacgaactaaccgctgtgaaatttatggaacatgtggtcctttcggagtttgcaacacgtttagttcacctatatgcagctgcttaaaagggtttaaacccaggtcagatgaagagtggaacagaggaaactggactggagggtgcgttaggaaaatggaattgaattgtcagaaatacgcacatgcagcagctatgacgactgtggaaaaagatgtgttctggccaatgaaacatatgaaattgcctgattctgctgattatttgtcaaacatagctgatgcagaaggatgtcgaagttggtgcctaggaaactgctcgtgcttggccttttcttatgtggagactgtaggatgtatggcttggtgtaaaaacctcatagatactcagcaattctccagagaaggcaaagatctatttcttcgacttgtggatgtggataaaggtgtacctccgaagacaaaactcatcatcagcctaagtactatttctggcatcgtgttattcggagctggcatttcagtgtgtggtcttttcaagtggagagggaaatttaggaaaatgacaatcccaagggtccttaattcaaaggccacagccaacagatcagaggaattgctgagggaaactgcatggaaagggaaaatgaagcaaggtgatgcgtcggaattaatggtttatgatttggacagcatactccttgcaacgaacaacttcgacgtgaagaacaaacttgggcagggagggtttggccttgtttataagggaaagctgaacgatggtaaggacatagctgtgaaaagacttttgagcagctcaggccaaggcgttgcagagttcaagaatgagatccttctgatatccaaacttcaacaccgaaatctggtgagacttgttggttactgcactgaaggacaagaaaagatactagtgtatgagtacttgccgaacaagagcttggacgcctttcttttcgattcaaaagagaaggcaaaactcagctggggcatccgcttccacattatccaaggcattgcaagagggctgctctacctccaccgtgattcttgccttagggtcatacatagagatttgaaagtgagcaacattctcttggacgaaaaaatgaatcccaagatttcagattttgggctagcgcggatgtttgaaggcactcaagttttcctaaatactcacaaagttgtggggacactgggttacatgtctcccgaatatgccatgggtgggatattttctgaaaaatctgatgtttatagctttggagtactgatattggagcttatcagcagcaagaagaacacaagtttagaataccatggacagcatctcaatctcctgacctatgtatggcacttgtggcatgaaggcagaggattggacctaatggatgaagccattggtgacgcatttttgccttcagaagtgatgagatgcattcaattagggcttctctgtgtgcaggaacatgccgcagatagacctgacatgtcagccgtggttctaatgctaagtgggcaatctgatcttccacagccaaagcaaccagcatttacatttcaacgctcaacgactcatgaagtccaatcagaagaagaatacattcggtccaggaataccatcaccattactttggctgaaggaaga

SEQ ID NO: 842 - protein, 843 aa, Eucalyptus grandis
  Eucgr.E03972.1
MVLEFVHHCSYDCVFVYSLLVCSLFQALQSSTIYNITASRPLIQNQTLVSPCKIFELGFFGPNGSEKQYVGIWYKNTTFSKVVWVANRDKPLGHKDQSASLIIGGDGNLKLLDGRKNAVWSTNVMAKSNYSAAVLLDFGNLVLQDGNANEMWESFDEPTDTLLPNMKIGVNVKTGKKKYLISWKGEDDPSPGSFVLGVTSETPPQLFAWNGSSPYWRSGQWDKSKFNGIPNMSNKYLSGHQLVQNINQGTTYYFRNYYNNSFGYVFISSEGSIESVRWGDGWSTNWEASRTNRCEIYGTCGPFGVCNTFSSPICSCLKGFKPRSDEEWNRGNWTGGCVRKMELNCQKYAHAAAMTTVEKDVFWPMKHMKLPDSADYLSNIADAEGCRSWCLGNCSCLAFSYVETVGCMAWCKNLIDTQQFSREGKDLFLRLVDVDKGVPPKTKLIISLSTISGIVLFGAGISVCGLFKWRGKFRKMTIPRVLNSKATANRSEELLRETAWKGKMKQGDASELMVYDLDSILLATNNFDVKNKLGQGGFGLVYKGKLNDGKDIAVKRLLSSSGQGVAEFKNEILLISKLQHRNLVRLVGYCTEGQEKILVYEYLPNKSLDAFLFDSKEKAKLSWGIRFHIIQGIARGLLYLHRDSCLRVIHRDLKVSNILLDEKMNPKISDFGLARMFEGTQVFLNTHKVVGTLGYMSPEYAMGGIFSEKSDVYSFGVLILELISSKKNTSLEYHGQHLNLLTYVWHLWHEGRGLDLMDEAIGDAFLPSEVMRCIQLGLLCVQEHAADRPDMSAVVLMLSGQSDLPQPKQPAFTFQRSTTHEVQSEEEYIRSRNTITITLAEGR

SEQ ID NO: 843 - DNA, 2532 bp, Eucalyptus grandis
  Eucgr.L02453.1
atgtttcttgaatttgttcatcattgttcttatgattgtgtatttgtgtattctttgctcgtctgctcgctgtttcaagcacttcaaagcagcacaatttacaatataactgcatcaaggccactcattcagaatcaaacccttgtctctcctagtaaaatcttcgagctagggttcttcgcgcctaatggatcagaaaagcagtacgtaggaatatggtacaagaacacgactttctccaaagttgtctgggtggccaacagggacaagccacttggacacaaagatcaatctgcgagtttgataattagtggagacggaaatctgaagcttcttgatgggcaacaaaatactgtctggtctacaaatgtcatgacgaagtcaaattattctgcagcagtgctttcagactttggaaaccttgttcttcaagacgggaatgcaaatgaaatgtgggaaagcttcgatgagccaaccgacactctcctgccaaacatgaagatcggagtaaacgtgaaaactggaaagaaaaaatacttgatttcctggaaaggtgaagatgatccttcgcccggaagctttgtccttggagtgacgtcggagacaccgcctcagcttttcgcttggaatggatcaagtccatactggagaagcggacagtgggataaatccaagtttaatggaatgccgaccatgagcaacacatatctgagtggccatgagatccagcaaaatatcgaccagggaacaacgtattatttccgcaataattacaacaactccttccttggatacagtttcatctcttcagaaggatctatagagtctcttcgttggagcgatggatggtcaataatctgggaagtatcacgaactaaccggtgtgaaatttatggaacatgcggtccttttggagtttgcaacacgtttagttcacctttatgcagttgcttaaaagggtttaaaccaaggtcagatgaagagtggaacagaggaaactggaccggagggtgcgttcggaaaatggaattgaattgtcagaaatccacacgtgcagcagctatgacgactgtggaaaaagacgcgttctggcaaatgaaacatatgaaattgcctgattctgctgattatttgtcaaacatagctgatgcagaaggatgtcgaagttggtgcctgggaaactgctcgtgcttggccttttcttatgtccatgctgtaggatgtctggcttggtgtaaaaacctcatagatactcagcaattctctagagaaggcaaagatctatttatccgacttgtggatgtggacaaaggtgtacctacgaagacaaaactcatcatcagcctaagtactatttctggcatcatgctatttggagctggcatttcagtgtgtggtcttttcaagtggagagggaaatttaggaaaatgacaatcccaagggtccttaattcaaaggccacagccaacagatcagaggaattgctgagggaaactgcatggaaagggcaaatgaagcaaggtgatgcgtcggaattaatggtttatgatttggacagcatactccttgcaacaaacaacttcaacatgaagaacaaactcgggcagggagggtttggccctgtttataagggaaagctgaacgatggtaaggacatagctgtgaaaagacttttgagcagctcaggccaaggcattgcagagttcaagaatgagatcctcctgatatccaaacttcaacaccgaaatctggtgagacttgttggttactgcactgaaggagaagaaaagatactagtgtatgagtacttgccaaacaagagcttggacgtctttcttttcgattcaaaagagaaggcaaaactcagctggggcatccgctttgacattatccagggcattgcaagagggctgctctacctccaccgcgattcatgcctcagggtcatacatcgagatttgaaagtgagcaacattctcttggacgaaaaaatgaatcctaagatttcagattttgggctagcgcggatgtttgaaggcactcaagttttcataaatactcacaaagttgtggggacactgggttacatgtctcccgaatatgccatgggtgggatattttctgaaaaatctgatgtttatagctttggcgtactgatattggagcttatcagcagcaagaagaacacaagtttagattaccatggacagcatctcaatctcctgacctatgtatggcatttatggtgtgaaggcagaggattggccctaatggatgaagccattgctgacgcattttcgctgtcagaagttatgagatgcattcaattagggcttctctgtgtgcaggaacatgccacagatagacccgacatgtcagctgtggttctaatgctaagtgggcagtctgatcttccacagccaaagcaaccagcatttacatttcaatgctcaacgactcatgaagtccaatcagaagaagaatacattcagtccaggaataccatcaccattactatggctgaaggaaga

SEQ ID NO: 844 - protein, 844 aa, Eucalyptus grandis
  Eucgr.L02453.1
MFLEFVHHCSYDCVFVYSLLVCSLFQALQSSTIYNITASRPLIQNQTLVSPSKIFELGFFAPNGSEKQYVGIWYKNTTFSKVVWVANRDKPLGHKDQSASLIISGDGNLKLLDGQQNTVWSTNVMTKSNYSAAVLSDFGNLVLQDGNANEMWESFDEPTDTLLPNMKIGVNVKTGKKKYLISWKGEDDPSPGSFVLGVTSETPPQLFAWNGSSPYWRSGQWDKSKFNGMPTMSNTYLSGHEIQQNIDQGTTYYFRNNYNNSFLGYSFISSEGSIESLRWSDGWSIIWEVSRTNRCEIYGTCGPFGVCNTFSSPLCSCLKGFKPRSDEEWNRGNWTGGCVRKMELNCQKSTRAAAMTTVEKDAFWQMKHMKLPDSADYLSNIADAEGCRSWCLGNCSCLAFSYVHAVGCLAWCKNLIDTQQFSREGKDLFIRLVDVDKGVPTKTKLIISLSTISGIMLFGAGISVCGLFKWRGKFRKMTIPRVLNSKATANRSEELLRETAWKGQMKQGDASELMVYDLDSILLATNNFNMKNKLGQGGFGPVYKGKLNDGKDIAVKRLLSSSGQGIAEFKNEILLISKLQHRNLVRLVGYCTEGEEKILVYEYLPNKSLDVFLFDSKEKAKLSWGIRFDIIQGIARGLLYLHRDSCLRVIHRDLKVSNILLDEKMNPKISDFGLARMFEGTQVFINTHKVVGTLGYMSPEYAMGGIFSEKSDVYSFGVLILELISSKKNTSLDYHGQHLNLLTYVWHLWCEGRGLALMDEAIADAFSLSEVMRCIQLGLLCVQEHATDRPDMSAVVLMLSGQSDLPQPKQPAFTFQCSTTHEVQSEEEYIQSRNTITITMAEGR

SEQ ID NO: 845 - DNA, 2259 bp, Eucalyptus grandis
  Eucgr.L02453.2
atgtttcttgaatttgttcatcattgttcttatgattgtgtatttgtgtattctttgctcgtctgctcgctgtttcaagcacttcaaagcagcacaatttacaatataactgcatcaaggccactcattcagaatcaaacccttgtctctcctagtaaaatcttcgagctagggttcttcgcgcctaatggatcagaaaagcagtacgtaggaatatggtacaagaacacgactttctccaaagttgtctgggtggccaacagggacaagccacttggacacaaagatcaatctgcgagtttgataattagtggagacggaaatctgaagcttcttgatgggcaacaaaatactgtctggtctacaaatgtcatgacgaagtcaaattattctgcagcagtgctttcagactttggaaaccttgttcttcaagacgggaatgcaaatgaaatgtgggaaagcttcgatgagccaaccgacactctcctgccaaacatgaagatcggagtaaacgtgaaaactggaaagaaaaaatacttgatttcctggaaaggtgaagatgatccttcgcccggaagctttgtccttggagtgacgtcggagacaccgcctcagcttttcgcttggaatggatcaagtccatactggagaagcggacagtgggataaatccaagtttaatggaatgccgaccatgagcaacacatatctgagtggccatgagatccagcaaaatatcgaccagggaacaacgtattatttccgcaataattacaacaactccttccttggatacagtttcatctcttcagaaggatctatagagtctcttcgttggagcgatggatggtcaataatctgggaagtatcacgaactaaccggtgtgaaatttatggaacatgcggtccttttggagtttgcaacacgtttagttcacctttatgcagttgcttaaaagggtttaaaccaaggtcagatgaagagtggaacagaggaaactggaccggagggtgcgttcggaaaatggaattgaattgtcagaaatccacacgtgcagcagctatgacgactgtggaaaaagacgcgttctggcaaatgaaacatatgaaattgcctgattctgctgattatttgtcaaacatagctgatgcagaaggatgtcgaagttggtgcctgggaaactgctcgtgcttggccttttcttatgtccatgctgtaggatgtctggcttggtgtaaaaacctcatagatactcagcaattctctagagaaggcaaagatctatttatccgacttgtggatgtggacaaaggtgtacctacgaagacaaaactcatcatcagcctaagtactatttctggcatcatgctatttggagctggcatttcagtgtgtggtcttttcaagtggagagggaaatttaggaaaatgacaatcccaagggtccttaattcaaaggccacagccaacagatcagaggaattgctgagggaaactgcatggaaagggcaaatgaagcaaggtgatgcgtcggaattaatggtttatgatttggacagcatactccttgcaacaaacaacttcaacatgaagaacaaactcgggcagggagggtttggccctgtttataagggaaagctgaacgatggtaaggacatagctgtgaaaagacttttgagcagctcaggccaaggcattgcagagttcaagaatgagatcctcctgatatccaaacttcaacaccgaaatctggtgagacttgttggttactgcactgaaggagaagaaaagatactagtgtatgagtacttgccaaacaagagcttggacgtctttcttttcgattcaaaagagaaggcaaaactcagctggggcatccgctttgacattatccagggcattgcaagagggctgctctacctccaccgcgattcatgcctcagggtcatacatcgagatttgaaagtgagcaacattctcttggacgaaaaaatgaatcctaagatttcagattttgggctagcgcggatgtttgaaggcactcaagttttcataaatactcacaaagttgtggggacactgggttacatgtctcccgaatatgccatgggtgggatattttctgaaaaatctgatgtttatagctttggcgtactgatattggagcttatcagcagcaagaagaacacaagtttagattaccatggacagcatctcaatctcctgacctatgttgttacaggtatggcatttatggtg

SEQ ID NO: 846 - protein, 753 aa, Eucalyptus grandis
  Eucgr.L02453.2
MFLEFVHHCSYDCVFVYSLLVCSLFQALQSSTIYNITASRPLIQNQTLVSPSKIFELGFFAPNGSEKQYVGIWYKNTTFSKVVWVANRDKPLGHKDQSASLIISGDGNLKLLDGQQNTVWSTNVMTKSNYSAAVLSDFGNLVLQDGNANEMWESFDEPTDTLLPNMKIGVNVKTGKKKYLISWKGEDDPSPGSFVLGVTSETPPQLFAWNGSSPYWRSGQWDKSKFNGMPTMSNTYLSGHEIQQNIDQGTTYYFRNNYNNSFLGYSFISSEGSIESLRWSDGWSIIWEVSRTNRCEIYGTCGPFGVCNTFSSPLCSCLKGFKPRSDEEWNRGNWTGGCVRKMELNCQKSTRAAAMTTVEKDAFWQMKHMKLPDSADYLSNIADAEGCRSWCLGNCSCLAFSYVHAVGCLAWCKNLIDTQQFSREGKDLFIRLVDVDKGVPTKTKLIISLSTISGIMLFGAGISVCGLFKWRGKFRKMTIPRVLNSKATANRSEELLRETAWKGQMKQGDASELMVYDLDSILLATNNFNMKNKLGQGGFGPVYKGKLNDGKDIAVKRLLSSSGQGIAEFKNEILLISKLQHRNLVRLVGYCTEGEEKILVYEYLPNKSLDVFLFDSKEKAKLSWGIRFDIIQGIARGLLYLHRDSCLRVIHRDLKVSNILLDEKMNPKISDFGLARMFEGTQVFINTHKVVGTLGYMSPEYAMGGIFSEKSDVYSFGVLILELISSKKNTSLDYHGQHLNLLTYVVTGMAFMV

SEQ ID NO: 847 - DNA, 2256 bp, Eucalyptus grandis
  Eucgr.H02483.1
aaccagacactgttgtccaatagtcaaatcttcgagcttgggttcttcacacctaatggatcacaaaaccaatatgttggaatatggtttaagaacatgaatccttccaaagttgtctgggtggccaatagggatcagccactcgcaaatacggatcgatctgcgagcttgacgataggcagcgatagaaatctgaagcttcttaatggacagcaaagcctgatctggtctaccaatgtcacagtccattcaaataattctgtagcaacactttcagactatggaaattttgttctgcaagacagaaatttgaatgaaatatggggaagctttgatgaacccactgatacacttctcccaaacatgaaggtgggaataaatgtcaaaacaggaaagaaagcatacttggtttcctggaaaagcgaaaatgatccctcatctggaagttttgtcctaggactcacgccagagacaccacctcaggcattctcatggaacgaatcaactccttattggagaagcggacaatgggataagtcaacctttgtcgggatacctactatggataacacattaatgagccgctttagtcttttgcaggatagtcagcagggaacatcacaaatcttcatgagcaatgacaacaactcttatttttcatatctatccatctcatcaaacgggtccataaagcttatggattgggatgacggaaattacacttggtcaacaaattgggagacaccgaccaattcctgtgaaatttatggaacttgtggtcctttcggtgtttgcagttcattaaaatttcctatatgtagatgctcaaaagggtttaaaccaagatttgatgaagaatgggacagacaaaactggacaggagggtgcatcagggaaacagaattgaattgtcagagaaacactagcacctccggtccagtaacagtaaaagaagacatcttcatgaagatgagccacatgaaattgcccaattccgccacttatttgccagacccagcagacgcagaagaatgtcaaagttggtgtctaagtaattgttcgtgctcggcttactcttatgtgaatggtataggatgtatggtttggagtgaagagctcatagatattcaacaattcaccacagcaggggaggatctctttattcgccttgtgtatgaaagtccatcaaaacaaacgaaagtgatcatcagcctaagtacaatttttggcatcatcttgtgtggagctgccatatatggtctatgcaagtggagagctaaaaaaagagggtatacgactgataggccagaagaagtgcagaatgcatgcaaagagcaatggaggcaagatgacgcatcagagttgacacttttcagttttgacagcatattacttgcgacaaacaacttcaactcaatcaataaacttgggcagggaggttttggccctgtttacaagggaaagctgaaagatgggaaggagatagctgtgaaaagactctcgagcagctcatcgcaaggcgtggaagagtttaagaatgagatccttctaatatctaaacttcgacacagaaatctcgtcagactcctagattcaagtaagaaggcggaactgagctgggacatacgtttgcaaatcatccacggggttgccagaggactcttgtacctgcatcgtgattcttgtcttaggattattcatcgagacttaaaagtgagcaacatcctcttgaatgaaaagatggatccaaaaatttctgattttgggttggcacggatgtttgaatgcactcaagtcttggtaaaaacacacagagttgccggaacattagactttgaaatgtttaaattatgcagcggctacatgtctcctgagtatgccatgggtggaatattttctgaaaaatctgatatttatagctttggagttctgctcctagagattgtcagcagcaaaaagaacactatcttagataaccacggacatctcaatctcctcgtttatgcttggcaattgtggagtggaggtagagcattggacctattggatgcggcggttgcggattccttttcaccgtcagaggcgattcgaagcattcaagtagggcttctctgcgtgcaggaccatgctgtggataggcccaacatgtcacaagtggttctgatgctaagcggtgaatcggatcttcctcagccaaaacaacctacatttacctttcaaagcttaacaactcacgaaatcaagtcaccgcaacaa

SEQ ID NO: 848 - protein, 753 aa, Eucalyptus grandis
  Eucgr.H02483.1
NQTLLSNSQIFELGFFTPNGSQNQYVGIWFKNMNPSKVVWVANRDQPLANTDRSASLTIGSDRNLKLLNGQQSLIWSTNVTVHSNNSVATLSDYGNFVLQDRNLNEIWGSFDEPTDTLLPNMKVGINVKTGKKAYLVSWKSENDPSSGSFVLGLTPETPPQAFSWNESTPYWRSGQWDKSTFVGIPTMDNTLMSRFSLLQDSQQGTSQIFMSNDNNSYFSYLSISSNGSIKLMDWDDGNYTWSTNWETPTNSCEIYGTCGPFGVCSSLKFPICRCSKGFKPRFDEEWDRQNWTGGCIRETELNCQRNTSTSGPVTVKEDIFMKMSHMKLPNSATYLPDPADAEECQSWCLSNCSCSAYSYVNGIGCMVWSEELIDIQQFTTAGEDLFIRLVYESPSKQTKVIISLSTIFGIILCGAAIYGLCKWRAKKRGYTTDRPEEVQNACKEQWRQDDASELTLFSFDSILLATNNFNSINKLGQGGFGPVYKGKLKDGKEIAVKRLSSSSSQGVEEFKNEILLISKLRHRNLVRLLDSSKKAELSWDIRLQIIHGVARGLLYLHRDSCLRIIHRDLKVSNILLNEKMDPKISDFGLARMFECTQVLVKTHRVAGTLDFEMFKLCSGYMSPEYAMGGIFSEKSDIYSFGVLLLEIVSSKKNTILDNHGHLNLLVYAWQLWSGGRALDLLDAAVADSFSPSEAIRSIQVGLLCVQDHAVDRPNMSQVVLMLSGESDLPQPKQPTFTFQSLTTHEIKSPQQE

SEQ ID NO: 849 - DNA, 2490 bp, Solanum lycopersicum
  Solyc03g006720.1.1
atggcattgccaagttgggatttttttttgtttctgatgcttagaattatgcatttaccactagtgtatgctgaaaatgataccttaactcaatcgcaacaattgtcgctgaatcagacgcttgtctctgctggaaatatatttgagcttggcttttttagtccaagtaacccgagcagactatatctcggaatatggttcaagggtatacctggtcagaggattgtatgggtagcaaacagagaaaatccactcactgctgcaatcttgaagattggaggtgatgggaacctcagaattatggatagcaatattcaaaatatcgtttggtccaccaatgttgctgtcgagtctagttgcacagttgccgtgcttacagatgaagggcgatttattctgaaagataatgtctcagggtcatctttatgggatagttttaactatccttgtgataccttgttatcgggaatggttattggatacaataccaggactggggtgaaacttgccttatcatcctggcaggctgaagatgatccgtcgcctgggaagtttattgctggactttcagtagatatgccacctcaaggcttcatttggactagttactcaaggccttattggagaggtggaccatgggatggtgggagtttcataggcatacgtgatcccgacaaggggtatgctagtggtataaacatagtatcagataagcatcagggaactgcgattctcagtttcaatacattcatcaattcccatgttacgattgtggtactaaaaccatcagggctgttgcagattatgtattgggaagaggaatcgaatgtgtggaaagtcacttgggagggaccggataatccatgcgatgtttatggagcttgtggtccatacagtgtttgcgacaagaataagtctccagtttgtgattgcttgagaggatttgtaccaaagtcaactgatgagtggatcagaggaaattggactggtggctgcgttaggcgaactaagcttctatgtgaaatcagtacaagtgatatagccccaaaggaatcgaaaaatgacaagttcttgaaactgagggagatgaaacttccagattattacacatatttgtatgatcaaaatgggattcagaactgcgaaaagtggtgtctgaataactgttcctgtgcagcctatgcgtatccagatggaattaactgcatggtctggacatcagaacttatagatgttcagcagtttccatataatggagctaatctgtttcttcgtcttgcatattctgaactagatttagatgaagataacgggaaggctaaacttatcatcggcttagcaacggtttcaagcattctcttgttgagcatccttggatgcattttctgcaagtggaaagcaaataaaagaggaagtgaagctacagactatttgtgggaagagcaagcattgctaaaagattcatcagaactacaccttcttgacttttctaaattggcagttgcaactgataatttcaatgaaataaataaaattggagcaggaggatttggcccagtttacaagggaaaactagaagatggacaagtgatagctgtcaaacgattatctagtttctctggccaaggaattgaagagttcaagaatgaagtcttgctgatctccaaactgcagcacaggaatctcgtcagaatattggcctattgcgttcacgggaaagagaagttactggtttatgagtacatggctaacagaagcttagacactttgttatttgatccaaaaagaagtcatcatcttccttggccaaaacgtttagacatgatttatggcattgctagagggcttctataccttcaccgtgattcttgtttacgggtcattcaccgggatttgaaggcaagcaatattctcttggatggtgatatgaatccaaaaatctcagattttggcttggctagaacctttcaagtgactcaagagctagcaaacactcatcggatagtgggaacattcggctacatgtcgcctgagtatgcaatgggtggactgttctctgagaaatctgatgtctacagcttcggcgtgttgctactggagattgtcagtggtcagaaaaacaacagcttttatgacaatgataggcatttcaatcttctgagctatgtaagttcaaaatcattatgcaaggcatggaagctttggactgaaagcaaaggactagacttaatggataaatcaatatcgaattcacgttccgctgcaacagtgttgaaatgcatacatattggccttctgtgtgtccaggaccatgcagttgataggccattaatgtcatctgtagttcttatgctaagaagtaagatggatctgcctcaaccaaagcaacctaaatttatatttaaaaggtggttgaattctgatgcccaatcacaaagcagtaaagcaaggtccattaatggtattactatatcttcagcagaagggcga

SEQ ID NO: 850 - protein, 830 aa, Solanum lycopersicum
  Solyc03g006720.1.1
MALPSWDFFLFLMLRIMHLPLVYAENDTLTQSQQLSLNQTLVSAGNIFELGFFSPSNPSRLYLGIWFKGIPGQRIVWVANRENPLTAAILKIGGDGNLRIMDSNIQNIVWSTNVAVESSCTVAVLTDEGRFILKDNVSGSSLWDSFNYPCDTLLSGMVIGYNTRTGVKLALSSWQAEDDPSPGKFIAGLSVDMPPQGFIWTSYSRPYWRGGPWDGGSFIGIRDPDKGYASGINIVSDKHQGTAILSFNTFINSHVTIVVLKPSGLLQIMYWEEESNVWKVTWEGPDNPCDVYGACGPYSVCDKNKSPVCDCLRGFVPKSTDEWIRGNWTGGCVRRTKLLCEISTSDIAPKESKNDKFLKLREMKLPDYYTYLYDQNGIQNCEKWCLNNCSCAAYAYPDGINCMVWTSELIDVQQFPYNGANLFLRLAYSELDLDEDNGKAKLIIGLATVSSILLLSILGCIFCKWKANKRGSEATDYLWEEQALLKDSSELHLLDFSKLAVATDNFNEINKIGAGGFGPVYKGKLEDGQVIAVKRLSSFSGQGIEEFKNEVLLISKLQHRNLVRILAYCVHGKEKLLVYEYMANRSLDTLLFDPKRSHHLPWPKRLDMIYGIARGLLYLHRDSCLRVIHRDLKASNILLDGDMNPKISDFGLARTFQVTQELANTHRIVGTFGYMSPEYAMGGLFSEKSDVYSFGVLLLEIVSGQKNNSFYDNDRHFNLLSYVSSKSLCKAWKLWTESKGLDLMDKSISNSRSAATVLKCIHIGLLCVQDHAVDRPLMSSVVLMLRSKMDLPQPKQPKFIFKRWLNSDAQSQSSKARSINGITISSAEGR

SEQ ID NO: 851 - DNA, 5124 bp, Solanum lycopersicum
  Solyc03g006730.1.1
atggtatggccaagatgggatttttttttgtttctgatgctcggaaggatgcttttagcgcaactctctgctgcaagtgataccttaactcaatcccaacaactgtctctaaatcagacacttgtctctgctggaaatatatttgagctgggcttcttcagtccacgtagctcgaggagtctatatataggaatttggttcaagaatatttctcgtcggagggttgtttgggtagcaaatagagaagatccactccaagcatctgattctgatacaatcttgaagattggaggtgatgggaacctcataattatggatggcaatcaaaatatcatttggtcaacaaatatctctattcagtctaataagacatctgctgtacttacagacaaaggagaattcattcttaaagacgatgtcacgggatcatctttatgggatagttttaactatccttgcgataccttgttatcaggaatgaatattggatacaacaccagtgctggggtaagacttgttttatcgtcctggcaggctgaaaatgatccatcgcctggaaagtttacttctggactatcggtagagatgccacttcaaggcttcacttggactaattactcaaggccttactggagaggtggaccatgggacggagcgaacttcataggcatacctgatgtcgacaaggggtatgcaagtagtataaacgtcatagtaaacaagcaacaggaatctggctttctcagtttgaataatttcaatgattctgatgttataatcatggtccttaaaccatcagggttattgcagactatattatgggttgaagaactgaatgcatggcaagtcacttgggaggcaccaggtaatccatgtgatgtttatggaacttgtggtcctaacagtgtttgtgacaagaataaatctccagtctgtgattgcttgaaaggatttgtaccaaagtcaactgatgaatggatcagaggaaattggactggtggttgtgtgaggcgaactaaacttctatgtgaaattagtacaagtgaaaatactacaaacgggtacggaagtgacaacttcttgcagctgagagagatgaaacttccagatcactacacgtatttttatgcctatgattatcagagttgcaaagagtggtgcctgaataactgttcatgtgcagcatatgcatatccagatagaattgactgcatggtttggacttcagaacttatggatgttcagcagttcccatctgatggtgtggatttgtttcttcgtcttgcttattctgaactagatcatagtttagatgaagataaaaggaagaaaaagcttatcatcggcttgacaaccctttcaagcattctcatattgggcatcttgggatacatcttctgcaggtggaaagtaaatcaaagaggaaatagaagaaatagggttgaacaccacattccggctgataagtgtcagatttcaagcgaaatgtctacagacaatttgtgggaagagcaagaactgccaaaagattcatcagaattaccacttcttgactttgctaaactggctactgcaactgataatttcagtgaaataaataagattggagcaggaggatttggccccgtttacaagggaaaactggaagatcgacaaatgatagctgtcaaaagactatctagtcagtctggacaaggaattgaagagttcaagaatgaagtcttgctaatctccaaactgcagcacaggaatctcgttagaatattagcctattgcgttcacgggaaagagaagttactagtttatgagtacatggctaacaagagcttagatactttgttgtttgtttgtgattctttacgtcaaaattatggaaatggaaattatgacatgtttcagaactataaattgttgtattcaaaaaagagtcatcagcttccctggccaaaacgtttcgacatgattcaaggcattgctcgtggccttctttaccttcaccgagattcttgtttaagggtcattcaccgagatctgaaggcaagcaatattctcttggacgatgatatgaatccgaaaatttcagattttggattggccagaatttttcaagtgactcaagagctagcaaacactaacaggatagcaggaacattcggttatatgtcaccagagtatgcaatgggaggactattttctgagaaatctgatgtctacagctttggcgtattgctactagagattgtcagtggaaagagaaacagtggatattatgaccacgaaaggcatcacaaccttctcagttatgcgtggcagctgtggactgaaagcaacggactagacttaatggataaatcaattttggactcagattcctctgcaacagtgctgagatgcatacatattggcctactttgtgtccaggatcatgctactgataggccatcaatgccgtctatcgttcttatgctaagtagtgagatggatcttcctcaaccaaagcaacctacatttatatttcaaagatggttgaattctgatacccaatcgcaaatcagcaaaactcaatctgttaatgatatcactgtatctgtgatgaaccaaaaaggaaagaaaacggcatggccaagatgggatttttttctgtttctgatgctcggaaggatgcttttagcacaagtctctgctgaaagtgataccttaacacaatcccaacaactgtcactaaatcagacacttgtctctgctgggaaaatatttgagctgggcttcttcagtccaagtaactcgaggagtctatatctcggaatttggttcaagaatattcctcgtcagaggattgtatgggtagcaaatagagaaaacccactcccagcttctgactcagctgcattcttgaagattggaggtgatgggaacctcagaattatggatggcaatcaaaatatcatttggtctacaaatatctctgttcagtctaataagactactgttgtactaacagacgaaggggaattcattcttaaagacagtgtctcaggcacatctttatgggatagttttaattatccttgtgatactttgttattaggaatgaatattggatacaacaccaggtcaggagtaaaacttgttttatcgtcctggcaggctgaaaatgatccatcacctggaaagtttactattggactttcggtagaaatgccacctcaaatcttcacttggaataattactcgaggccttactggagaggtgtcccatgggatggagggaacttcttaggtgtacctgatgacgaaaaggggtatgcaagtgatataaaagtaatagtaaacaagcaacaggaatctgccttcttcagtttcaataatttcaatgtttctgatgttataatcctggtcctaaaaccatcagggttattgaatatgatggaatggctagaagacctgaatgcatggcacgtcttttgggaggcaccagcgaatccatgtgatgtttatggaacttgtggtccttacagtgtttgtgacatgggtaagtctccagtctgtgattgcttgagaggatttgcaccaaagtcaactgatgaatggataagaggaaattggactggtggctgtgtgaggcgaactaaacttctatgtgaaatcagtgcaagtggcaatactataaaggggtccgaaagtgacaacttcttgcagctgagagagatgaaactgccagatcactacacatatttttatgactatgaggctcagatttgcaaggagtggtgcctgaataactgttcctgtgcagcctatgcatatccagatggagtaaagtgcatggtttggacttcagaacttatagatgttcagcagtttccatataatggtgtggatttgtttcttcgtgttgcttcttctgaactagctttagatgaagttacaacgaaggctaaacttatcatcatcttcacaaccgtttcaagcgttctcatattggccattttcggatgcattttctacaggtggaaagcaaagcaaagagcaaatagaagaaatagggttaatgacctcactccagctgttagttctcagaattcagagaatgcatctacagataatttgttggaagaacaaccattgctaactcttctcgactttgctaagttgggaattgcaactgacaactttagtgaaactaataagattggagctggaggattcggtcctgtttacaagggaaaactagaagatggacaattggtagctgtcaaaagattatctagtcactctggacaaggaattgaagagttcaaaaatgaaatcttgctaatctccaaactgcagcacagaaatctcgttcgagtattggcctattgcgttcacgggcaagagaagttactagtttatgagtacatggctaacagaagcttagatactttgttgtttgattcaaaaaaaagttatcagcttccctggacgaaacgtttcaacatgattcaaggcattgctcgagggcttctttaccttcaccgtgattcatgtttaagggtcattcaccgagatttgaaggcaagcaatgttctcttggatgatgaaatgaatccaaaaatttcagattttggattggctagaacttttcaagtaactcaagagctagcaaacactaaccggatagcaggaacattcggttatatgtcaccagagtatgcaatgggaggactattttctgaaaaatctgatgtctacagcttcggcgtattgctactagagattgtcagtggaaagaaaaacagcggattttatgaccatgaaaatcatctcaaccttctcagttatgcatggaagctacagaccgaaagcaaagagttagacttaatggataaatcaattttggactcaagttcctctgcaacagttctgagatgcatacatattggcctgctttgtgtccaggatcatgctgttgataggccatcaatgccgtctgttgttcttatgctaaacagtgagacggatctgcctctacctaaggaacctacatttatatttcaaagatggttgaattctgatactcaatcgcaaatcagcaaagctcagtctgttaatgatattactgtctctgtggccgaaggccga

SEQ ID NO: 852 - protein, 1708 aa, Solanum lycopersicum
  Solyc03g006730.1.1
MVWPRWDFFLFLMLGRMLLAQLSAASDTLTQSQQLSLNQTLVSAGNIFELGFFSPRSSRSLYIGIWFKNISRRRVVWVANREDPLQASDSDTILKIGGDGNLIIMDGNQNIIWSTNISIQSNKTSAVLTDKGEFILKDDVTGSSLWDSFNYPCDTLLSGMNIGYNTSAGVRLVLSSWQAENDPSPGKFTSGLSVEMPLQGFTWTNYSRPYWRGGPWDGANFIGIPDVDKGYASSINVIVNKQQESGFLSLNNFNDSDVIIMVLKPSGLLQTILWVEELNAWQVTWEAPGNPCDVYGTCGPNSVCDKNKSPVCDCLKGFVPKSTDEWIRGNWTGGCVRRTKLLCEISTSENTTNGYGSDNFLQLREMKLPDHYTYFYAYDYQSCKEWCLNNCSCAAYAYPDRIDCMVWTSELMDVQQFPSDGVDLFLRLAYSELDHSLDEDKRKKKLIIGLTTLSSILILGILGYIFCRWKVNQRGNRRNRVEHHIPADKCQISSEMSTDNLWEEQELPKDSSELPLLDFAKLATATDNFSEINKIGAGGFGPVYKGKLEDRQMIAVKRLSSQSGQGIEEFKNEVLLISKLQHRNLVRILAYCVHGKEKLLVYEYMANKSLDTLLFVCDSLRQNYGNGNYDMFQNYKLLYSKKSHQLPWPKRFDMIQGIARGLLYLHRDSCLRVIHRDLKASNILLDDDMNPKISDFGLARIFQVTQELANTNRIAGTFGYMSPEYAMGGLFSEKSDVYSFGVLLLEIVSGKRNSGYYDHERHHNLLSYAWQLWTESNGLDLMDKSILDSDSSATVLRCIHIGLLCVQDHATDRPSMPSIVLMLSSEMDLPQPKQPTFIFQRWLNSDTQSQISKTQSVNDITVSVMNQKGKKTAWPRWDFFLFLMLGRMLLAQVSAESDTLTQSQQLSLNQTLVSAGKIFELGFFSPSNSRSLYLGIWFKNIPRQRIVWVANRENPLPASDSAAFLKIGGDGNLRIMDGNQNIIWSTNISVQSNKTTVVLTDEGEFILKDSVSGTSLWDSFNYPCDTLLLGMNIGYNTRSGVKLVLSSWQAENDPSPGKFTIGLSVEMPPQIFTWNNYSRPYWRGVPWDGGNFLGVPDDEKGYASDIKVIVNKQQESAFFSFNNFNVSDVIILVLKPSGLLNMMEWLEDLNAWHVFWEAPANPCDVYGTCGPYSVCDMGKSPVCDCLRGFAPKSTDEWIRGNWTGGCVRRTKLLCEISASGNTIKGSESDNFLQLREMKLPDHYTYFYDYEAQICKEWCLNNCSCAAYAYPDGVKCMVWTSELIDVQQFPYNGVDLFLRVASSELALDEVTTKAKLIIIFTTVSSVLILAIFGCIFYRWKAKQRANRRNRVNDLTPAVSSQNSENASTDNLLEEQPLLTLLDFAKLGIATDNFSETNKIGAGGFGPVYKGKLEDGQLVAVKRLSSHSGQGIEEFKNEILLISKLQHRNLVRVLAYCVHGQEKLLVYEYMANRSLDTLLFDSKKSYQLPWTKRFNMIQGIARGLLYLHRDSCLRVIHRDLKASNVLLDDEMNPKISDFGLARTFQVTQELANTNRIAGTFGYMSPEYAMGGLFSEKSDVYSFGVLLLEIVSGKKNSGFYDHENHLNLLSYAWKLQTESKELDLMDKSILDSSSSATVLRCIHIGLLCVQDHAVDRPSMPSVVLMLNSETDLPLPKEPTFIFQRWLNSDTQSQISKAQSVNDITVSVAEGR

SEQ ID NO: 853 - DNA, 2376 bp, Citrus clementina
  clementine0.9_002780m
atgttgggtgcttactcttgtttgttgtttatcttaggagcttctgctgcaaatgataatattacaccgagtcaatccatcagagatggtgagactctagtttcagttaatggaacctttgaattgggatttttcagcccaggtacttcagcaaaacgttacttaggaatttggtacaagagagtttctcctaggacagtcgcatgggtagccaaccgagaaactccgctcaccgatcagtcaggattgttaaatgtaaccagtaaagggattgtactactggatggccgagatagaattttctggtcgtccaacacatcgataacaatgaaaaacccagttgtgcagctcatggattcgggaaaccttgtcctcacagatggaaactataacagccttttgtggcagagttttgatcatccttgtgacaccttgctacctggaatgaagcttggaaggaactttaaaacaggaatggataggcacctatcatcttggaaaagcataaatgatcctgctcctggcgaattttcattgtggattgatactcatggatttccccaactagttcttaggaagggatctgtgttgcagtatagagctgggtcgtggaatggccttggttttacggggactcctccactgaaagaaaatgttccactgtgtgattacaaatttgtaataaatgagaatgaagtctactatgagtgtgatgccaagggtcctgcagtttcaaggttatgggtgaaccaatctggtcttgttctgcgttccatttggagttctcaacaagatgtatggttccttgcttattatgcacctttagatcggtgtgatctttattcagtctgtggtgcaaatgctcgttgtacgaccaacagcagtcgtcgatgtgattgcctggagggtttcgtgccaaaatcaccaaataattggtctgaaggttgtgtcagagagagagaattgaagtgtagaaatggagatgaatttccaaagtatgtaaagctgaagttgccagacacttctagttcttggtttaacgcaagtatgaatctcaaggaatgttcagaattgtgttcgaaaaattgctcttgcacagcctatgcaaactcagatgtcgagagaggaggaagtggctgcttgctctggtttggtgacctaatggatatgaaagaatacaatgacggtgggcaagatctttatatcaggatcgcatcagaacgaggtcgttctgtgacgaagaagcaagtaggaatcataattgcttctgtattattgatggcaatgttcatagtggcatcgctcttttgtatctggcgaaagaaactcaagaagcaaggattaacaaagatgagtcatatgaaagaagatatggaattatgggaatttgattttgccagtatagcaaaggccacagataacttcgcaagttacaataaactgggagaaggtggatttgggccagtatacaagggtacattggtagaggggcaagaaattgcagttaaaaggctgtcaaaaggttctggacaaggaatggaagagttcaaaaatgaagttacattgattgctaggcttcaacaccgcaatcttgtgaagcttcttggttgctgcatacaagcagatgaaagcatgttaatctatgagtacatgccaaacaaaagcttggacttcttcatttttgatcaagcaagagccacatttcttgattggcagaagcgcattcatattgttggtggaatcgccagaggaattctgtatcttcatcaagactctagaatgaggattatacatagggatctcaaagccagcaacgtcttactggacaacgatatgaacccaaaaatttcagattttggtatggccagaatatttggaggagatgagattcagaccaatacacacaaagtggttggaacatatggctatatgtcccctgaatatgcggctgaaggacttttctcagtgaaatctgatgtattcagcttcggggttttagtattagagatagtcagtgggaagaaaaactggaggttttcccacccagatcatgaccataatcttcttggacatgcatggatactctggaaagaaaagagagcaatggaactagctggcgacacattagccgattcccatccaccgactgaggtgttaagatgtattcatgtgggactgttgtgcgtgcagcatcgaccagaagataggccaaatatgtcatctgtggttctaatgttgagcagcgacagtttgttgcctgaaccaaatcggcctggtttttttacggaaaggagtcttcctgaagctgaattttcaccaagctaccctcaatcatctacaacaaatgaaatcaccatcacagagttacagggaagg

SEQ ID NO: 854 - protein, 792 aa, Citrus clementina
  clementine0.9_002780m
MLGAYSCLLFILGASAANDNITPSQSIRDGETLVSVNGTFELGFFSPGTSAKRYLGIWYKRVSPRTVAWVANRETPLTDQSGLLNVTSKGIVLLDGRDRIFWSSNTSITMKNPVVQLMDSGNLVLTDGNYNSLLWQSFDHPCDTLLPGMKLGRNFKTGMDRHLSSWKSINDPAPGEFSLWIDTHGFPQLVLRKGSVLQYRAGSWNGLGFTGTPPLKENVPLCDYKFVINENEVYYECDAKGPAVSRLWVNQSGLVLRSIWSSQQDVWFLAYYAPLDRCDLYSVCGANARCTTNSSRRCDCLEGFVPKSPNNWSEGCVRERELKCRNGDEFPKYVKLKLPDTSSSWFNASMNLKECSELCSKNCSCTAYANSDVERGGSGCLLWFGDLMDMKEYNDGGQDLYIRIASERGRSVTKKQVGIIIASVLLMAMFIVASLFCIWRKKLKKQGLTKMSHMKEDMELWEFDFASIAKATDNFASYNKLGEGGFGPVYKGTLVEGQEIAVKRLSKGSGQGMEEFKNEVTLIARLQHRNLVKLLGCCIQADESMLIYEYMPNKSLDFFIFDQARATFLDWQKRIHIVGGIARGILYLHQDSRMRIIHRDLKASNVLLDNDMNPKISDFGMARIFGGDEIQTNTHKVVGTYGYMSPEYAAEGLFSVKSDVFSFGVLVLEIVSGKKNWRFSHPDHDHNLLGHAWILWKEKRAMELAGDTLADSHPPTEVLRCIHVGLLCVQHRPEDRPNMSSVVLMLSSDSLLPEPNRPGFFTERSLPEAEFSPSYPQSSTTNEITITELQGR

SEQ ID NO: 855 - DNA, 2442 bp, Eucalyptus grandis
  Eucgr.F03113.1
atgaaagcttttgtggcactttccatgtgtcttgttctcttctcttgcaatgctcttctttccaatgcactagataccatagcaacagatcagtcaattcgagacggcgagaacctactctctgctggtgggacatttgagctggggttcttcagtgcgggcaatcccccaaagcgatatctgggaatatggtacaagaaaataaccacaaggacaatagtgtgggttgcaaatagagtagcaccccttgcggacgcatcaggcgcttttagggttactacccacggaagtcttgtccttctcgacgggaatggaagtgatatctggttgtcgaacgctccgataccagtgcgtaatccagttgcgcagctcttggattcaggaaatctggttgtgagagacgcagaaggcagtgatcccaataatttcctgtggcagagttttgactatcctacagatacacttgtagccggtatgaagctaggatggaatagaacatcaggcttcaatcgtcatttaacatcatggaagagcattgatgatccttctccaggtaactttacgtttcaacttgatccgaatggctacccacaagaactattgaagcagggttctgacatcaagttcaggacaggaccatggaatggtcttcgatggagtggcatacctaatttaaatccaaacccatactacaggtatgaatttgtgttaaatgagggagagatgtactaccgcgagctcctcaacagctgggtcatttccaggatgatattgatgcccaatggcatgctacagcgattcacttggattgaccgaacgcagggttggacgctttacatcagttgcccaatagaccaatgtgacaactatgcatcatgtggtgcctatggtagctgtagggtcgatacttccccagtgtgtaggtgcttgaaaggctttgtgccccgattttctcaagaatgggatattttggattggtccaatgggtgtgtgaggagaaatgctttggattgtgaaaaggacatatttgtgaagtattctaggttaaaattgccggatactcagtcttcctggtttaacgagagcatgaatcttcaagaatgcgaagtagtttgcatgaaaaattgttcctgtatggcttattcgaacttagatatccgagatggaggaagtggttgcttgctgtggttcgacaagctgattgacattagagagtacagcgactatgggcaggacctctacatccggatggctgcatcagaatcagctttactaccgtcacaccaaaagaagcataagctggtcatgggcttggcagtttctttcgggtctgttttcctcattctggttctcaccattcgtgttctacaatgcaagaagaagaaaatgaagcttcctgaagctaaaagggacagttttgaatcaggagacaactgtgaaaaccagaaggaagatcttgatttgccactatttgacttgtctacagtagctattgctaccaattacttttcatcggacaataagcttggagaaggtggttttggacctgtctacaagggtgtgttgaggggtggtcaaataattgccgtgaagatgctgtcaaagaactcaagacaagggctgcatgagtttaaaaatgaagttctatatgtttccaagctgcagcaccgaaacctagtgaagcttctaggatgttgcattgaggaagaaaaacttttgatctatgaattcgtgcccaacaggagcttggactcatttctctttgatccaacgcaaagggagcaactggactggtcagctcgtttcaacatcatcaatggaattgctagggggcttctttaccttcatcaagattccagactcaggattattcacagagatataaaagctagcaatgtattgttagattgtgaaatgaaccccaagatctctgattttggcttggctaaaagcttcgcagggaatgagacacaggcaaatactaacagagtggttggaacatatggttacatgtctccagagtatgctcttgatggagttttctcaacaaaatctgatgtctttagctatggtgtattggtgctcgagatcgtaagcgggaagagaaacagagggtttcatcatccagaccacgatcataatctcctcggacatgcctggagactgttcacagaaggcagctccatgcagttgctcgataagttggtcccgaattcgtgcagtacttctgaagcattacgctctattcatattgccctactgtgcgtgcagcgatgccccaatgataggccgagtatgtctgcggtggttatgatgctgggaagtgacatcgaattgcctcttccgaaagagccggggtttttcaatgaaaggaatctactccaagaaaacacttcaccaagtcaaccaaacgaaatcaccatgacactgttatttgctcga

SEQ ID NO: 856 - protein, 814 aa, Eucalyptus grandis
  Eucgr.F03113.1
MKAFVALSMCLVLFSCNALLSNALDTIATDQSIRDGENLLSAGGTFELGFFSAGNPPKRYLGIWYKKITTRTIVWVANRVAPLADASGAFRVTTHGSLVLLDGNGSDIWLSNAPIPVRNPVAQLLDSGNLVVRDAEGSDPNNFLWQSFDYPTDTLVAGMKLGWNRTSGFNRHLTSWKSIDDPSPGNFTFQLDPNGYPQELLKQGSDIKFRTGPWNGLRWSGIPNLNPNPYYRYEFVLNEGEMYYRELLNSWVISRMILMPNGMLQRFTWIDRTQGWTLYISCPIDQCDNYASCGAYGSCRVDTSPVCRCLKGFVPRFSQEWDILDWSNGCVRRNALDCEKDIFVKYSRLKLPDTQSSWFNESMNLQECEVVCMKNCSCMAYSNLDIRDGGSGCLLWFDKLIDIREYSDYGQDLYIRMAASESALLPSHQKKHKLVMGLAVSFGSVFLILVLTIRVLQCKKKKMKLPEAKRDSFESGDNCENQKEDLDLPLFDLSTVAIATNYFSSDNKLGEGGFGPVYKGVLRGGQIIAVKMLSKNSRQGLHEFKNEVLYVSKLQHRNLVKLLGCCIEEEKLLIYEFVPNRSLDSFLFDPTQREQLDWSARFNIINGIARGLLYLHQDSRLRIIHRDIKASNVLLDCEMNPKISDFGLAKSFAGNETQANTNRVVGTYGYMSPEYALDGVFSTKSDVFSYGVLVLEIVSGKRNRGFHHPDHDHNLLGHAWRLFTEGSSMQLLDKLVPNSCSTSEALRSIHIALLCVQRCPNDRPSMSAVVMMLGSDIELPLPKEPGFFNERNLLQENTSPSQPNEITMTLLFAR

SEQ ID NO: 857 - DNA, 2445 bp, Eucalyptus grandis
  Eucgr.F03379.1
atgaaagcttttgtggcactttccatgtgtcttgttctcttcacttgtaatgcccttgtttccaatgcactagataccataacaacaaatcagtcaattcaagacggcgagagcctaatctctgctggtgagacatttgagctggggttcttcagtaggggggatccaccaaagcgatatctgggaatatggtacaaaaaaataaccacaatgacaatagtgtgggttgcaaatagagtcgcaccccttgcggacgcatcaggcactttgagggttactacccacggaagtctcgtccttcttgacggaaatggaagtgatacctggttgtcgaacgctccaataccagttcgtaatccagttgcgcagctcttggattcaggaaatctggtcgtgagagatgcagaaggcagtgatcccaataatttcctgtggcagagttttgactatcctactgatacacttcaggctggtatgaagatcggatggaatagaacatcaggcttcaatcgttatttaaaatcatggaagagcattgatgatccttctccaggcaacttcacgtttcaacttgatccgaatggctacccacaactcctattgaagcagggttctgacatcaagttcaggacaggaccatggaatggtcttcgatttagtggcaccccttatttaaatacgaacccatactacagatatgaatttgtgttaaatgaggaagagatgtactaccgctacgtgctcctcaacagatcggtcacttccaggctgacattgacgaccaatggcatcatacagcgatttgcttggattgaccgaacgcagggttggatgctttatatcacctcgccaatagaccaatgtgacaactatgcatcctgtggtgcctatgctagctgtagggtcgatacttccccagtgtgtaggtgcttgaaaggcttcgtgccccgcttttctcaagaattggatatgttggattggtcaaatgggtgtgtgaggagaaatcctttggattgtgaaaaggacatatttgtgaagtattcttggttaaaattgccagatactcggtcttcatggtttaacgagagcatgaatcttcaggaatgcgaagtagtttgcatgaaaaaatgttcctgtatggcttattcgaacttagacatccgaaatggaggaagtggttgtttgctgtggttcagcgagctggttgacattagagggtacagcaactacgggcaggacctctacatccggatggctgtgtcagaatcagctttactaccgtcacaccacaagaagcataagctggtcatgggcttggcagtttttttcgggtctgttttcctcattctggttctcaccatccgccttctacaatgcaagaagaagaaaatgaagcttcctgaagctaaatgggatagttttgaatcaggagacaactgtgaaaagccaaaggaggatcttgagttgccactatttgacttgtttacagtagcaagagctaccgataacttttcgaccgataataagcttggagaaggtggttttggacctgtctacaagggtgtgctgagggatggtcaagaaattgcggtgaagatgctgtcaaggaactcaagacaagggctgcatgagtttaaaaatgaagttctatatgtttccaagctgcaacaccggaacctagtgaagcttttaggatgttgcattgaggaagaaaatcttctgatctatgaattcatgcccaacgggagcttggactcatttctctttgatccaatgcagaggaagcgattggactggtcaactcgtttcaacatcatcaaagggattgctaggggacttctttaccttcatcaagattccagactcaggatcattcacagagatgtgaaagctagcaatgtattgttagattatgagatgaaccctaagatctctgattttggcctggctaaaagcttcacagggaatgagacacaggcaaatactaacagagtggttggaacatatggttacatgtctccagagtatgctctcgatggagttttctcaacaaaatctgatgtctttagctatggtgtattggtgctcgagatcgtaagcgggaagagaaacagagggtttcatcatccagaccaccgtcataatcttctaggacatgcttggagactattcacagaaggcaggtccatgaagttgcttgacaagttggttgagaactcatgcagtacttctgaagcattgcgctctattcatattggcctattgtgcgtgcagcgatgccccaatgataggccaagtatgtccactgtggttatgatgctgggaagcgacatcgaattgcctcttccaaaagagccagggtttttcattgaaaggaatctactccaagaaagcacttcacaaagtcaaccaaatgaaatgaccatgacagtgttatctgctcga

SEQ ID NO: 858 - protein, 815 aa, Eucalyptus grandis
  Eucgr.F03379.1
MKAFVALSMCLVLFTCNALVSNALDTITTNQSIQDGESLISAGETFELGFFSRGDPPKRYLGIWYKKITTMTIVWVANRVAPLADASGTLRVTTHGSLVLLDGNGSDTWLSNAPIPVRNPVAQLLDSGNLVVRDAEGSDPNNFLWQSFDYPTDTLQAGMKIGWNRTSGFNRYLKSWKSIDDPSPGNFTFQLDPNGYPQLLLKQGSDIKFRTGPWNGLRFSGTPYLNTNPYYRYEFVLNEEEMYYRYVLLNRSVTSRLTLTTNGIIQRFAWIDRTQGWMLYITSPIDQCDNYASCGAYASCRVDTSPVCRCLKGFVPRFSQELDMLDWSNGCVRRNPLDCEKDIFVKYSWLKLPDTRSSWFNESMNLQECEVVCMKKCSCMAYSNLDIRNGGSGCLLWFSELVDIRGYSNYGQDLYIRMAVSESALLPSHHKKHKLVMGLAVFFGSVFLILVLTIRLLQCKKKKMKLPEAKWDSFESGDNCEKPKEDLELPLFDLFTVARATDNFSTDNKLGEGGFGPVYKGVLRDGQEIAVKMLSRNSRQGLHEFKNEVLYVSKLQHRNLVKLLGCCIEEENLLIYEFMPNGSLDSFLFDPMQRKRLDWSTRFNIIKGIARGLLYLHQDSRLRIIHRDVKASNVLLDYEMNPKISDFGLAKSFTGNETQANTNRVVGTYGYMSPEYALDGVFSTKSDVFSYGVLVLEIVSGKRNRGFHHPDHRHNLLGHAWRLFTEGRSMKLLDKLVENSCSTSEALRSIHIGLLCVQRCPNDRPSMSTVVMMLGSDIELPLPKEPGFFIERNLLQESTSQSQPNEMTMTVLSAR

SEQ ID NO: 859 - DNA, 2403 bp, Eucalyptus grandis
  Eucgr.G00947.1
atgtccctggtgttgcagataagctatgcatcggactccatttcagctggccagaacatcacagatggccaaacgatagtctctcctggcgggaacttcgagctaggattcttcagccctggcagctccaagaaccggtacgtgggcgtatggtacaagaagctatcggccgggagggtgatttgggtcgcaaaccgagagaatcccctgaatgattcttcaggagtcctaaagctcactcctcagggtgtactcactctcctgaaccgcaacaatggggtcgtttggtcctccaacgtgtcaagatctgcccagaatccgattgcgcagcttttggattccgccaatttcgtcataaaagaaggaaacgacaatgacttgggtgatgcaatttggcagagttttgatcacccttgtgattcgtttctggctggcatgaagtttggtatagatcgagcaaaaggtctggaccggtacctgacctcgtggaaaagcgtggacgacccttcacttggtgatttcacatataggctcgattcttcgggatatccgcagctgatcgtgagaaacagatcggtagtgcagttcaggtcgggaccttggaacggccttcggtttagcgggttccctcagttgagcctaaatcctgtttatagctttggcttcgtcttcaaccaaaacgaaatttactatcacttcaatattctgaacagttccgtcccatcgatgctcgttttaaacgagaatgggattgctcagcacttcagttgggtagatcggacacacgattggatactgtattcgtctgctcaaacggacgactgtgacacttatgcattatgcggagggaatgggaactgtgacattgctagctctccaaaatgcgtgtgcttaacaggcttcatgcccaaatacccgagcgcctgggaattcggggattggtcaaacggttgtgtccggaggacggaactggattgcctgggaggagacaagtttctgaagtacaccggagtgaagttgcccgacaccaggcaatcgtggttcaacgtgagtatgaaccttcaagaatgcgagcagacatgcttgaggaactgctcgtgcacggcttattcaaacttggatattagagggcaaggaagcggatgcttgctttggttcggtgacctgatggatattagacagttcaatgagaatggccaggatatttacgtaaggatggccgcatcagaagtcggtgggagttcgagcggaaatactggcacaaggaaaagcacaggcatcattgtcagcaccgtgctgtccgcggtgcttcttctcggcatcatggctgttttcataaagtataggagagatggacaaatctttagatgctgccatcaaaaccatggtgaagatctagacttacctatgttcgacctgacaaccatagtgaacgctacgaataacttctctgaagacaacaaactcggagagggaggttttggagctgtctataagggtgttctgaggaatggccaagaaattgctgtgaagaggctgtcggaaaactctaggcagggacaggatgagttcaaaaacgaagtcgtctacatcgccaaacttcaacaccgaaacctcgtcaagattctgggatgctgcgttcaagtagatgaaatgatgttgatctatgagttcttgcccaaccggagcttggattgtttcatttttgatcaagagaagggtgttttactggattggcctaggcgcttctctatcatcaacggcatagcctcagggctcctataccttcaccgagactcaagattaagaataattcatcgagatctgaaagctgaaaacatcctgctcgacaacgaaatgaatccaaagatatcagactttggtttggcgaggagtttcggaggtaatgatagcgaagcgaatacaaagagagtggtgggaacgtacggttacatatcaccagagtatgctatccatgggttatattcgataaaatcggatgtattcagttttggtgtcgtagtgctggaaatcgtgagtgggcaaagaaatcgaggctttaatcatcctgacaaccatttaagccttctcggatttgcctggacactgttcagagatcgaaagcctatgaagctggttgatccatcgatcacatccacattcaatcctgcggaagttttacgatcgatccatatggctctgttgtgcgtccaacaaaatccgagagatagaccggagatgtcgtccgtggttatgatgctgggcagtgagagcgcattgccttatcctaaacagcccggttttttcagcgaggagtccgtatcggaagccagttcttcaagcggtggcaagcaccaacaatattcagccaacgaaatgactatttcagatgtacagcctcag

SEQ ID NO: 860 - protein, 801 aa, Eucalyptus grandis
  Eucgr.G00947.1
MSLVLQISYASDSISAGQNITDGQTIVSPGGNFELGFFSPGSSKNRYVGVWYKKLSAGRVIWVANRENPLNDSSGVLKLTPQGVLTLLNRNNGVVWSSNVSRSAQNPIAQLLDSANFVIKEGNDNDLGDAIWQSFDHPCDSFLAGMKFGIDRAKGLDRYLTSWKSVDDPSLGDFTYRLDSSGYPQLIVRNRSVVQFRSGPWNGLRFSGFPQLSLNPVYSFGFVFNQNEIYYHFNILNSSVPSMLVLNENGIAQHFSWVDRTHDWILYSSAQTDDCDTYALCGGNGNCDIASSPKCVCLTGFMPKYPSAWEFGDWSNGCVRRTELDCLGGDKFLKYTGVKLPDTRQSWFNVSMNLQECEQTCLRNCSCTAYSNLDIRGQGSGCLLWFGDLMDIRQFNENGQDIYVRMAASEVGGSSSGNTGTRKSTGIIVSTVLSAVLLLGIMAVFIKYRRDGQIFRCCHQNHGEDLDLPMFDLTTIVNATNNFSEDNKLGEGGFGAVYKGVLRNGQEIAVKRLSENSRQGQDEFKNEVVYIAKLQHRNLVKILGCCVQVDEMMLIYEFLPNRSLDCFIFDQEKGVLLDWPRRFSIINGIASGLLYLHRDSRLRIIHRDLKAENILLDNEMNPKISDFGLARSFGGNDSEANTKRVVGTYGYISPEYAIHGLYSIKSDVFSFGVVVLEIVSGQRNRGFNHPDNHLSLLGFAWTLFRDRKPMKLVDPSITSTFNPAEVLRSIHMALLCVQQNPRDRPEMSSVVMMLGSESALPYPKQPGFFSEESVSEASSSSGGKHQQYSANEMTISDVQPQ

SEQ ID NO: 861 - DNA, 2493 bp, Populus trichocarpa
  POPTR_0001s42060.1
atgaaaaggcatgaattcttcatgggaggccaaactattttgttccttttgtctattgttttcttcttatcaatcccctctacagcaatagagagcatcaatgccactcaatcactagaagatggggacaccctggtctcatcagaaggccattttgagctgggtttttttagtcctggaaattccagaaatcggtacatgggaatatggtacaagaagatatctagctttacagtagtatgggttgccaacagaaatactcctctaaatgattcatcaggaatgtttaagtttgttgaccatggaaatcttgcctttatcaatagtacaaatggcactatttggtcctcaaatatatcaagggcagcaatcaatccagttgcacaacttctggacacaggaaatctagttgtgagagctgaaaatgacaatgatcctgaaaatttcttatggcagagtttcgattatccaggcgactcgtttttaccaggcatgaaatatggtataagcttcgtgaccggcctcaatcgatacctgacatcctggaagagccccagtgatccttctacaggtaaatatacaaataagcttgatccaaatggattgccacagtactttttatctcagggttcagttgaccagttcaggtcaggaccctggaatggactgaggtttagtggtatgataaatttgaagccaaacccaatttacacatttgagtttgttttcaatcaagaggaaatatattacaagtatcaaatcgctaacagttcagtcctttcgaggatggtgttaagtcctgatggtgtcctgcagcgtttcacttggattgatcgaactcaagattggaccctatacttgacagcaaatatggataactgtgacaggtttgcattatgtggtgcacatggtgtttgtaacatcaacaactccccagcctgtgattgtttgaaagagtttgagccaaaatccctggaagaatggacagctgcagattggtcacaaggatgtgttcgaaaggccccattggattgcagcaatggagaaggttttataaaatatactgggattaaagtgccagacacacggaagtcttggtataacaaaaccataaaccttgaagaatgtgaggaggtctgtttgaagaattgttcttgcacagcttacgcgaatttggatgttagagatggaggaagtgggtgtgttctgtggttcggtgacttgattgatatcaggcaatacaacgaaaatgggcaagatatctatataaggatagctgcttctgtaatagataaacctgtcaaatccagagggaagaaacgagtaaggatcattgttattcccgtatcactagtggcattttccctcctagccctttgtctgttcttgcgtttcctgaggaaaaacaagcaacagcagctaacaagagaaggaaatgtggtaaccaatccagagcaagaccgcaccaaggaaagcagaaatgaagatttagagcttccactgtttgatttggctacattaacagatgcaaccaattgcttttcgataaacaacaagcttggccagggtggttttggaccagtctacaagggtatactgcaagatggacaagaaatagcagtgaagaggctatctaaaaggtcaagacaaggaattaatgagttcagaaatgaagttgtatgcattgccaaacttcagcatcgcaaccttgtgaagcttttaggatgctgcattgaattagaagaaaggatgctgatatatgaatacatgccaaacaaaagcttggactctttcatttttgataaaaggcgaaacatgttgctggactggactaagcgcttccccattatcaatgggattgcaaggggacttctttaccttcatcaagattcaagactcagaatcatacatagagatttaaaagcaagcaatattttgctggattatgagatgaatccaaaaatttcagactttggcatggctaggagtttcggaggggatgaaactagcgcaaacacaagcagaattgttgggacatatggttacatgtcgccagagtacgcaatcgatggcctcttctcagtgaaatcggatgtatttagctttggtgttttggtactagagatagtgagtggaaggaagaatagaggattccgtcacgcagaacacaagctcaatcttcttggacatgcatggatgctacacaaggaaggaagacccctggacttgattgatgaatctattgtagacacatgcattatatcagaagtcttgcgatcaatcgaagtagcactattgtgtgttcaaaaaagtcctgaagataggcctaaaatgtcaattgtggttctaatgttgagcagtgacattgttttgcctcagcccaaggagcctggttttttcactgaaagggatctgtcgaacgattcttcgtcaacaatcaagcatgaaatctcttcagtaaatgaattaacctccaccttgttagaggctcgg

SEQ ID NO: 862 - protein, 831 aa, Populus trichocarpa
  POPTR_0001s42060.1
MKRHEFFMGGQTILFLLSIVFFLSIPSTAIESINATQSLEDGDTLVSSEGHFELGFFSPGNSRNRYMGIWYKKISSFTVVWVANRNTPLNDSSGMFKFVDHGNLAFINSTNGTIWSSNISRAAINPVAQLLDTGNLVVRAENDNDPENFLWQSFDYPGDSFLPGMKYGISFVTGLNRYLTSWKSPSDPSTGKYTNKLDPNGLPQYFLSQGSVDQFRSGPWNGLRFSGMINLKPNPIYTFEFVFNQEEIYYKYQIANSSVLSRMVLSPDGVLQRFTWIDRTQDWTLYLTANMDNCDRFALCGAHGVCNINNSPACDCLKEFEPKSLEEWTAADWSQGCVRKAPLDCSNGEGFIKYTGIKVPDTRKSWYNKTINLEECEEVCLKNCSCTAYANLDVRDGGSGCVLWFGDLIDIRQYNENGQDIYIRIAASVIDKPVKSRGKKRVRIIVIPVSLVAFSLLALCLFLRFLRKNKQQQLTREGNVVTNPEQDRTKESRNEDLELPLFDLATLTDATNCFSINNKLGQGGFGPVYKGILQDGQEIAVKRLSKRSRQGINEFRNEVVCIAKLQHRNLVKLLGCCIELEERMLIYEYMPNKSLDSFIFDKRRNMLLDWTKRFPIINGIARGLLYLHQDSRLRIIHRDLKASNILLDYEMNPKISDFGMARSFGGDETSANTSRIVGTYGYMSPEYAIDGLFSVKSDVFSFGVLVLEIVSGRKNRGFRHAEHKLNLLGHAWMLHKEGRPLDLIDESIVDTCIISEVLRSIEVALLCVQKSPEDRPKMSIVVLMLSSDIVLPQPKEPGFFTERDLSNDSSSTIKHEISSVNELTSTLLEAR

SEQ ID NO: 863 - DNA, 2451 bp, Populus trichocarpa
  POPTR_0011s12930.1
atgaaaggtcttacactagtttctttatgttccatcttcttcatcttcacaaccgccgatggtgcagataccatagctgtaaaccagtcaatcatagatggagagaccatagtttcagctgggagcaactttgagctaggattttttagccctcgaagtacaagtttgcgttatgtaggaatatggtacaagttctctagtgagactctggtttgggttgccaacagagaagcaccactcaatgacacatcaggtgttttgcaagtgaccagcaagggaatccttgtccttcataattcaacaaatgttgttttatggtctactaatacatcaagagtgccgcagaatccagtagctcagcttttggattcaggaaatcttgttataagagaagcaaatgatacaaacgaggatgattacttgtgggatagttttgactatcctggtaacacgtttttgccaggcctcaagtttggcagaaatttgattactggccttgatcggtacttggtgtcatggaaaagcactaatgatccttcattgggtgattctacaactatgcttgatcctggtggatatccgcagatatttatcagggttggtgagaacataattttccgatcaggaccatggaatggtcttaaattcagtgggatgcctaatttgaaaccgaacccaatttacacatacgagtttgtttacaatgagaaggagatttattacaggtacgatctgacagacagttcagttgtgacgcgtatgttgctgaccaatgatgggattttgcagcgtttcacctggactagtagtacaagaacatggaatctgtacttgacagcccagatggataattgtgataggtatgcagtatgtggtgcatatggaatttgtaacatcgacaattcccctgcttgtgcatgcttggacggatttcagccaaagtctcgtcaagattgggattctggggattggtctggaggatgcgttaggaagaatgaatcaatttgcagggcaggagagggttttcagaaggtaacaagtgtgaaattgccagatacaaggacatcctcgtttaatatgacaatggaccttgaagaatgtcgaagggtttgcttgatgaattgttcttgcacagcttattcgactttgaatataacagatggaactggatgcttgctttggtttgaggatcttcttgatatcagagagtacactgaaactggacaagatttttacattagattatctgcctctgatttagagccaactagaagtcctaagaggacgacgcgagtgtggattatagccatctgtttgttggttgctggaattaccatcctaggcttttgcctgctgtttctgatgaggaggaggaagatgaagacagcagcaaggatggtttcgatgcaagaaagagactactcaattaatagcaccggtaaagatttagagcttccagtatttgacttcgcaaccatagctattgccacgagcaatttctcaggggccaataagcttggagagggtggattcggacctgtctacaagggcaagctagaagatggacaagagatagctgtgaaaaggctttcaaagacttcgacacaaggacttgatgaattcaagaacgaagttatatgcattgcgaaacttcaacaccgaaatcttgtcaagcttcttggttgctgcattgaatccgaagaaacaatgttggtctatgaatatatgcctaacaaaagtttggatgccttcatctttgatcaaaagcagagcaagttattggactggtctatgaggtacaacattatcaatggggtagctcgaggacttctttacctccatcaagattcccggctaagaatcattcatagagatctaaaagccagcaatatacttgtggactatgatatgaacccaaaaatctcagattttggcatggccaggagttttggtggaaatgaaattcagggaaacacaaaacgagtagttggaacatatggttacatgtctccagaatatgcaactgacgggatcttttctataaaatccgatgtatttagtttcggtgttttggtgctagagatagtaaatgggaagagaaatagaggattcattcatcaagaccataagcacaaccttcttggtcatgcatggaaactttacaaggaagaaaggtcattcgagctaatcaacgattctttaaaagacacctgcaacttatccgaagttttacgggtgatccatgtgggtctactgtgtgtgcaacaagctcctgaggataggcctactatgtcaactgtggtgctaatgttaagtagtaacattgcattgcctgaccctaaagagcctggatttttcacagaaaggaaactattcgatcatgagtcttcatctagcaaggttgatacatgttccgcgaacgaaattactatcacattgttaactgctcga

SEQ ID NO: 864 - protein, 817 aa, Populus trichocarpa
  POPTR_0011s12930.1
MKGLTLVSLCSIFFIFTTADGADTIAVNQSIIDGETIVSAGSNFELGFFSPRSTSLRYVGIWYKFSSETLVWVANREAPLNDTSGVLQVTSKGILVLHNSTNVVLWSTNTSRVPQNPVAQLLDSGNLVIREANDTNEDDYLWDSFDYPGNTFLPGLKFGRNLITGLDRYLVSWKSTNDPSLGDSTTMLDPGGYPQIFIRVGENIIFRSGPWNGLKFSGMPNLKPNPIYTYEFVYNEKEIYYRYDLTDSSVVTRMLLTNDGILQRFTWTSSTRTWNLYLTAQMDNCDRYAVCGAYGICNIDNSPACACLDGFQPKSRQDWDSGDWSGGCVRKNESICRAGEGFQKVTSVKLPDTRTSSFNMTMDLEECRRVCLMNCSCTAYSTLNITDGTGCLLWFEDLLDIREYTETGQDFYIRLSASDLEPTRSPKRTTRVWIIAICLLVAGITILGFCLLFLMRRRKMKTAARMVSMQERDYSINSTGKDLELPVFDFATIAIATSNFSGANKLGEGGFGPVYKGKLEDGQEIAVKRLSKTSTQGLDEFKNEVICIAKLQHRNLVKLLGCCIESEETMLVYEYMPNKSLDAFIFDQKQSKLLDWSMRYNIINGVARGLLYLHQDSRLRIIHRDLKASNILVDYDMNPKISDFGMARSFGGNEIQGNTKRVVGTYGYMSPEYATDGIFSIKSDVFSFGVLVLEIVNGKRNRGFIHQDHKHNLLGHAWKLYKEERSFELINDSLKDTCNLSEVLRVIHVGLLCVQQAPEDRPTMSTVVLMLSSNIALPDPKEPGFFTERKLFDHESSSSKVDTCSANEITITLLTAR

SEQ ID NO: 865 - DNA, 2481 bp, Solanum lycopersicum
  Solyc10g006710.2.1
atgaacaaaattttgttgtttctctttacaattttacccttgttccaaaaagttgagtctcaaagtgataccttaacaacttcacaaattctcaaagatggtgaaacaataatttcatcagatggaacctttgaattgggttttttctctgcaggcaaaaatagttcatcaagaaatcgttatattggcatttggtacaaaaagatttcagctttaacaccaatttgggttgcaaatagacaaattccagtgaagggtatttctggaatcttgaaaattgttgaaccaggttatcttgttttgattaataatgttactaatgacactatttggagtactaatttttcatcaattagtgtgaaaaatccagttgctaagttgttggatacagggaattttgtgattaaagatgcaaatgatgatttgttgttgtggcagagttttgattatcctagtgatactttgttagcaagtatgaaacttggaagagatttagtgactgggttggaaaggtatcttcggtcatggaaaagtgacgatgatcctgctcccggggattatacatatcattgtgatcctacaggttatccacaggaccttatgagaagaggtcctaatgtagtttatagagccgggccatggaatggtcttagatggagtggagcaccaaacatggtgaacaactcggtcacctcttttgggctagtcatgaacgatcaagaaatttactacaaatacgaactagtaaataaatccttgcttactactttagtgctaacgcctaatggtaatgcgatgcgtatgatttggatagaaaagagagagggttgggttaattaccattccgcggatgcagatcactgtgacacttacaaattatgtggtgcatatggcacttgcacaatgtttagcgatcctgtgtgtcgttgtttggataaattcgttcctaaacatccggatgattggaacagggctgactggtcaagtggttgtgttcgaaatcatccattgaattgttcagaagatggatttataaagtatactggtgtcaaattgccagatactcggtactcttggtttaacgagactatgacactcgacgaatgcaagttagtttgcttgagaaattgttcgtgtatgggatatactagtctggacatcagaaacggaggaagtggatgcttgctatggattggggagctcgttgacctcaggcagctatcggaatcaggacaggatatctatattaggatggctgcttccgagataagtcctatcgatggatcaagtcgaaagaaaagtattatacttgcaattgctttgccattatcgattgcagcgattctgttaatggttggagtctgcctgattcttcgtagacagaaaaagagggcggaaacaatgctcatagaaaaaaggaaattggacgacagcaataacaaagataaaaacaatcaaattcgccgtgaagctttggagctaccactcgttgatttgtccacaataatgaaggctaccaataacttttcacttgagaacaagattggagcaggcggctttgggaaagttttcaagggagtgctagaagaaggacaggaagtagctgtcaagcggctctctgaaacgtccagacaaggaaacgatgagttcaagaatgaagtcagctgcatcgcggaacttcagcatcgaaatcttgtgaagcttcttggatgctgcatcgaagaagaagagaagatactggtgtacgaatacatgcccaacaaaagcctggatttattcatcttcgatcaaagaaggagcacattacttgattggcctaagcgtttcaacatcatcaacgggattgctcgaggacttatgtaccttcatcaagattctaggctaagaatcatccacagagaccttaaagctagtaatgtcctgcttgattttgaaatgaacccgaagatatcagatttcgggatggccagaagttttggagggaacgagacgggagacaatacaaatcgagtggttggaacatacggttacatgtccccggagtatgcagtcgatgggattttctcagtaaaatcagacgtctttagctttggcgtattgatactagaaattgtaagcggaaagaagaacagaagattcattcatccagaccacaatctcaacctcattggacatgcatggatgctacatagggaaggaagatcatcggagataatcgatcctaacctggttgaatcatgtcatacatcagaattgcaacgatcgatacacgtgggattgttatgtgttcaacaaagtccagaggacaggccaaacatgtcttctgtagttttgatgttgacaaatgaaggcattttaccacaaccaaaaccaccaggttttttcacagaaaggaacatagatgatgccactggatattcttggagtgaccaaacaccttgttctgtcaacgatgtaaccgtcactttgttggacgctcga

SEQ ID NO: 866 - protein, 827 aa, Solanum lycopersicum
  Solyc10g006710.2.1
MNKILLFLFTILPLFQKVESQSDTLTTSQILKDGETIISSDGTFELGFFSAGKNSSSRNRYIGIWYKKISALTPIWVANRQIPVKGISGILKIVEPGYLVLINNVTNDTIWSTNFSSISVKNPVAKLLDTGNFVIKDANDDLLLWQSFDYPSDTLLASMKLGRDLVTGLERYLRSWKSDDDPAPGDYTYHCDPTGYPQDLMRRGPNVVYRAGPWNGLRWSGAPNMVNNSVTSFGLVMNDQEIYYKYELVNKSLLTTLVLTPNGNAMRMIWIEKREGWVNYHSADADHCDTYKLCGAYGTCTMFSDPVCRCLDKFVPKHPDDWNRADWSSGCVRNHPLNCSEDGFIKYTGVKLPDTRYSWFNETMTLDECKLVCLRNCSCMGYTSLDIRNGGSGCLLWIGELVDLRQLSESGQDIYIRMAASEISPIDGSSRKKSIILAIALPLSIAAILLMVGVCLILRRQKKRAETMLIEKRKLDDSNNKDKNNQIRREALELPLVDLSTIMKATNNFSLENKIGAGGFGKVFKGVLEEGQEVAVKRLSETSRQGNDEFKNEVSCIAELQHRNLVKLLGCCIEEEEKILVYEYMPNKSLDLFIFDQRRSTLLDWPKRFNIINGIARGLMYLHQDSRLRIIHRDLKASNVLLDFEMNPKISDFGMARSFGGNETGDNTNRVVGTYGYMSPEYAVDGIFSVKSDVFSFGVLILEIVSGKKNRRFIHPDHNLNLIGHAWMLHREGRSSEIIDPNLVESCHTSELQRSIHVGLLCVQQSPEDRPNMSSVVLMLTNEGILPQPKPPGFFTERNIDDATGYSWSDQTPCSVNDVTVTLLDAR

SEQ ID NO: 867 - DNA, 2433 bp, Eucalyptus grandis
  Eucgr.F01048.1
atggaaactcctactttgttcatctgcctttactttatctgcctgtcagtctttggcttatcgacggcagctgacacgtgcagttcaggccagtctatgaaagatggagagtcattggtctcttctgaccaaagctttgagctcggcttcttctctcctggcaactccaagaacaggtacatcggcatatggtacaagattagtccgggaagagttgtttgggttgccaacagggaaaatcccctcactgattcacacggagttctcgcgtttggtcatgatggagatctagttcttttcaaccaatcgaacagcgtcatctggtcttcaaatttctccagggttctgaaaaatccggttgcacagctcttagacactggaaatcttgttctcagagagaattatagtctgaattctgatgaatattcgtggcagagctttgatcatccgtcggacacacaactacccggtatgaaattaggatgggacttgaaaattggtttagaaagacatctgacttcttggaaaagcatggatgatccttcccccggagactatatttacaggttaaatatacaagggttgcctcaatttgaactcatcagcttaggatccggcaagaaatatcgaacaggaacgtgggatggaatacaattcagtgctgttccaatggttttgcatgcactgaccaagctggtgttctttaatggtgatgatgagaaatttttttcatatgaagccataaaaagcgaatatagcgcaagtatatttacattaaaccattccgggattatccagttctatactgcaagtaaaagaagcaatgcctggaacctcgcgtactcaccaaacgatccatgtgatagttacagtacttgtggggccaacggtatctgtagaagtagcagagcttcgatatgcaattgcttaaagggcttcgtaccgaagtctcctgaagaatggaatcccctcaattggtccggtggatgcacgagaagaataccaataaattgtccaaaggaagatgggttcctcaaactcgcaaaagtgaaaattccagacctgttagagttctggctgaacgagagcatgagccttgaagaatgccaggccgagtgcttaaagaactgttcatgcaccgcttatgctaattcagatgttagcgggggaggtagtggctgtatcctgtggttcggaaacctaattgacattaaggagtacgaagaagataactatgggcaaactctacacatccgcctaccaatatctgaactagatgtccatcataactcttttaagaagaaggggatggtcattggcataatgatgtcggctattgctgctttttctgtatcggccatggtgtactgccatcgaattaggaattgcagaataaagagcaaaggtaggaaaatcaaggaggaagatgctgacttgccactttttgatctggctaccatggttaatgctacagacggtttttctgagaataatctgattggagctggtggctttggcccagtttacaagggcaatctttccacaggacaagaagtagcagtgaagagactgtcaagaaactcaggacaaggtcttgaagagttcaagaatgaaacaattctgatagccaaacttcaacaccggaatcttgtggggcttctgggttgttgcatggagagggaggaaaagattttggtttatgagtacatgcaaaacaagagcttggattattttatctttgatcatgaaagatgcttattgttagactgggaaaaacgttttgatattatcatcgggattgctagaggtcttctgtatctccaccatgattctaaactccaagtaattcaccgtgatctcaaagctagcaacattttattggatgacagcctaaagcctaggatctctgactttgggttggcaagaattttctctggtgatgagaaagaagtaaagacaaggagaatcatcggaacctatggctatatgtcccctgagtatgcattcgagggaaaattctctgtgaaatccgatatctttagctttggcgtgcttttgttagagattgtaagcggcaaacgaaacagaggattctgccacccaagtcatcaacataaccttcttggacatgcatggttgctttggagtgcaaacagagccacggaactcactgatggatgcttgtatgatctggtggaacctcaagtacaaagatgtatccatatcggcttgttatgtgtgcagaagttcgccaacgatagaccagcgatgtgctctattgttcccatgttaggaaatgaaagtgcaagcttgcctcgacctaaacagcctggtttctttatggaaagaagttcaatggactcaagcgcaatcttgacacatgaagaactccattctattaatgcagtctcaatgacatcgttggatggtcga

SEQ ID NO: 868 - protein, 811 aa, Eucalyptus grandis
  Eucgr.F01048.1
METPTLFICLYFICLSVFGLSTAADTCSSGQSMKDGESLVSSDQSFELGFFSPGNSKNRYIGIWYKISPGRVVWVANRENPLTDSHGVLAFGHDGDLVLFNQSNSVIWSSNFSRVLKNPVAQLLDTGNLVLRENYSLNSDEYSWQSFDHPSDTQLPGMKLGWDLKIGLERHLTSWKSMDDPSPGDYIYRLNIQGLPQFELISLGSGKKYRTGTWDGIQFSAVPMVLHALTKLVFFNGDDEKFFSYEAIKSEYSASIFTLNHSGIIQFYTASKRSNAWNLAYSPNDPCDSYSTCGANGICRSSRASICNCLKGFVPKSPEEWNPLNWSGGCTRRIPINCPKEDGFLKLAKVKIPDLLEFWLNESMSLEECQAECLKNCSCTAYANSDVSGGGSGCILWFGNLIDIKEYEEDNYGQTLHIRLPISELDVHHNSFKKKGMVIGIMMSAIAAFSVSAMVYCHRIRNCRIKSKGRKIKEEDADLPLFDLATMVNATDGFSENNLIGAGGFGPVYKGNLSTGQEVAVKRLSRNSGQGLEEFKNETILIAKLQHRNLVGLLGCCMEREEKILVYEYMQNKSLDYFIFDHERCLLLDWEKRFDIIIGIARGLLYLHHDSKLQVIHRDLKASNILLDDSLKPRISDFGLARIFSGDEKEVKTRRIIGTYGYMSPEYAFEGKFSVKSDIFSFGVLLLEIVSGKRNRGFCHPSHQHNLLGHAWLLWSANRATELTDGCLYDLVEPQVQRCIHIGLLCVQKFANDRPAMCSIVPMLGNESASLPRPKQPGFFMERSSMDSSAILTHEELHSINAVSMTSLDGR

SEQ ID NO: 869 - DNA, 2457 bp, Populus trichocarpa
  POPTR_0001s43850.1
atgcttattactgcgaatatcctcctcctattctctagattctgtaatacagctgatacccttgccttttctcaatctattagtgatggagggacaggaaccttagtctcgaaggatggaagttttgagcttggtttcttcagtcctggaagttccaggaaccgttatatgggaatatggtacaagaacatcccagttcgaactgttgtttgggttgcaaacagaaacaacccaatcaatgattcctctggtttcttgttgatagacaacacaggaaattttgtacttgtcagcaacaacaatagtactgttgtttggtcatcaagcttaacgaaagcaggccggagagcaatgggagaactcctggattctgggaatctggtcttaagagatgagaaagataccaattctggaagctacttgtggcagagttttgactacccatctgatactatgattccaggaatgaagcttggatggggcttaaggactggacttgatcgacggctatcagcatggaagggccctgatgatccatctccaggagattttacttggggaacacaactacagggtaatcccgagttagttatgtggaaggggtccaagaagtactgtagaagtggtccatggaatggtatcgggttcagtggtgcgccggagttgaggaaaaatccagtgtttaattttgattttgtcgacgacggggaggaagtatattacacatacaacctcaaaaataaatatgtatttacgagggtagttatgaaccaaactacctatattcggcagcgttacacctggaatgaaatcaatcagacatgggtactctatgcaactgtgcctaaagattactgtgacacctacaatctttgtggtgcctacggaaattgcatcaccagccagtcgccagtttgtgaatgtttagaaaaattcacgcctaaatcacctgagagttggaattcaatggactggtctcaaggttgtgtacgaaataagccactggattgccagaaggaagatggattcgttatatatgttggtttgaaattgccagatgctacaaattcttgggttaacaaaactatgaatctcaaggaatgcaggtcagaatgcttacaaaattgttcttgtatggcatatacagctgcagatattaaggaaggtagtggctgtgctatttggtttggcgatctgatagatattagacagttttcagctgcagggcaggaaatatacattcgcttgaatgcttcagaatcgagtgagtgcttaaccttagtcttaatggcagtgggaattgcactatctattttcgtggcctgcgggatacttttggtcgcctattacatcttcaaaagaaaggcaaaactcataggtaaagttactttgactgctttcagcaacagagaagaaaatgatcagatagatagtggaccaaaggaagacttggagctacccctattccagttcactacaatagccaaagccaccaacggcttttcattcaacaacaagctaggagaaggtggttttggacctgtgtacaagggtactctagaagatggtcaagaaatagcagcaaagacgcattcaaggagttctggacaaggaataaatgagttcaaaaatgaagttatactgatcacaaagcttcagcaccgaaatcttgtaaaacttcttggctgttgcattcaaggagaagagaaaattctggtttatgaatacatgcccaacaaaagcctcgattccttcattttcgatcaaacaagaggcgaactgttagactggtccaagcgtttcagcattatatgtggtattgctagagggcttctatatcttcatcaggattccagattgaggattgtacacagggatcttaaagcaagtaacgttttacttgataaggatatgaacccaaaaatctctgattttggtttggccagaatgtttggtggagaccagacggaaggaaacacaaccagagttgttggaacttatggttatatggctcctgaatatgctactgatgggctcttctcagtgaagtctgatgtttttagctttggaatcttaatgcttgagataataagcggaaagaagagtagaggattttatcatccggaccatagcctaagccttattggacatgcatggagactgtggaaagatggaaaacctttggacttaattgaggcgtttccaggagagtcatgcaatttatcagaagtgatcatgagatgcataaacattagtctcttgtgtgtgcagcagcatcctgatgataggccaagcatggccactgtggtttggatgctaggaggtgagaatacactgcctcagccaaaggaaccaggcttttttaagggtagcggtccgttcggaccatcttcttcatcaagcaatattgaattatcttcgaacaatgaaattaccacctcactcttttatcctcgg

SEQ ID NO: 870 - protein, 819 aa, Populus trichocarpa
  POPTR_0001s43850.1
MLITANILLLFSRFCNTADTLAFSQSISDGGTGTLVSKDGSFELGFFSPGSSRNRYMGIWYKNIPVRTVVWVANRNNPINDSSGFLLIDNTGNFVLVSNNNSTVVWSSSLTKAGRRAMGELLDSGNLVLRDEKDTNSGSYLWQSFDYPSDTMIPGMKLGWGLRTGLDRRLSAWKGPDDPSPGDFTWGTQLQGNPELVMWKGSKKYCRSGPWNGIGFSGAPELRKNPVFNFDFVDDGEEVYYTYNLKNKYVFTRVVMNQTTYIRQRYTWNEINQTWVLYATVPKDYCDTYNLCGAYGNCITSQSPVCECLEKFTPKSPESWNSMDWSQGCVRNKPLDCQKEDGFVIYVGLKLPDATNSWVNKTMNLKECRSECLQNCSCMAYTAADIKEGSGCAIWFGDLIDIRQFSAAGQEIYIRLNASESSECLTLVLMAVGIALSIFVACGILLVAYYIFKRKAKLIGKVTLTAFSNREENDQIDSGPKEDLELPLFQFTTIAKATNGFSFNNKLGEGGFGPVYKGTLEDGQEIAAKTHSRSSGQGINEFKNEVILITKLQHRNLVKLLGCCIQGEEKILVYEYMPNKSLDSFIFDQTRGELLDWSKRFSIICGIARGLLYLHQDSRLRIVHRDLKASNVLLDKDMNPKISDFGLARMFGGDQTEGNTTRVVGTYGYMAPEYATDGLFSVKSDVFSFGILMLEIISGKKSRGFYHPDHSLSLIGHAWRLWKDGKPLDLIEAFPGESCNLSEVIMRCINISLLCVQQHPDDRPSMATVVWMLGGENTLPQPKEPGFFKGSGPFGPSSSSSNIELSSNNEITTSLFYPR

SEQ ID NO: 871 - DNA, 2511 bp, Populus trichocarpa
  POPTR_0004s02820.1
atgaatcctatagaaacgtttttgagtgcattgtttctcttccttgtttttccttcttgcttatctattgacatcatagctccaaaccaatcaatcaaagatggagatgttctggtctctagtggacaaagctatgaactcgggttcttcagcacaggcatcgattctactcgtcgttatgtgggaatttggtgccgtaaggtttcagaacgaactgttgtatgggtggcaaatagagataatcctatcaatggtacctccggattcctagctatcaacaaacaaggtaaccttgtaatttatgaaaataaccgaagtagtgttcctgtttggtctacaaatgttccagcctcaatatcaatgacaaattgcacggctcagctcctggattcaggaaacttggtcttggttcaacaggatagcaatggggtcttgtggcagagttttgatcatggtacagatactctgcttcctggtatgaagcttgggctggacctgaaaatcggtttgaaccggtctctgtcatcttggaagtccaaagatgacccgggaaccggaaccattctctatggtattgatccaagcgggtttccccagttgttcctatacaagggtcaaacccgatggtggcgtggcggaccatggactggactaagatggagcggagtatccgaaatgacccctacctacatcttcaatgttactttcgttaacagcgttgatgaggtatctatattctatactatgaataatccctccatcatttcaagaatggtggtgaacgaatcaggagtagtgcagcggctgtcgtggaacgatcgtgatcaacaatggatcggaatttggtccgccccaaaagaaccatgtgacacctatggccaatgtggcccaaatagtaactgtgacccatatcaaacaaatactttcatgtgcaaatgtctacccggattcgaacccaagtcaccccaagaatggtacctgagagattggtcaggaggttgtgtcaggaaacctaaagtgtccacgtgtcacggcggagaagggttcgtcgaggtggctcgagtgaagttgccggatacatcaatagcgagtgcgaacatgagtttgagattgaaagaatgtgagcaagagtgcttgaggaattgttcttgtacagcttatgctagtgctgacgaaagaggacttggatgcttgagatggtatggtgatctggttgatacaagaacgttttcagatgtggggcaagagatttacatccgtgtggatagagctgaattagctaaatatgaaaagtcaggacctcttgccaataaaggaatacaagcaatcctgatagtgtctgttggtgtgacattgtttctgatcatcttccttgtgtgttggtttgtaaagaaaaggagaaaagccagggacaggaaaagaagaaacgaatttccgctatcattaacttcaaggtcaaatagctggagagacttaccaattaaggaatttgaggaaggtacaacaagttcagatttaccactttttgatcttagtgtcatggctgcggcaacaaataatttctcagatgccaacaagcttggagagggtggttttggctcggtgtataagggtctgctgcatgatggaaaggaaattgcggtcaaaagactagcaaagtattctggacaagggattaatgagttcagaaatgaagtcgagctcattgcaaaacttcagcacaggaatcttgtaaggatattaggttgttgcatccaaggaagagagaagatgttgatctatgaatacttgccaaataaaagtttggactcttttattttcaatgaaccaagaaggtcacagttagattggtctactcgccacaacattatttgtgggattgctcgaggaattttgtatcttcatgaggactccagattacgaatcatccacagagatcttaaggcaagcaatgttctactagatgcctcaatgaacccaaaaatttcagatttcggcatggctagaatatttggagtagaccaaattgaagccaacacaaaccgtgttgtaggaacgtatggttatatgtcaccagaatatgcaatgcaaggcctattttcagtaaaatccgatgtatatagtttcgggattttgctattagaggtcatcactggaagaaaaaacagcaatttttatgatgaaagtaacttttcgagcttggttggatatgtttgggatctatggagagaaggcagggccctggaactagtggatacattgatgggcgactcgtatcctgaagatcaagtcttaaggtgcatccaaattggtcttttatgtgtgcaagaatctgcgatggaccgaccatcaatgtctaatgttgttttcatgttgagtaatgacacaactcttccatctcctaagcaacctgcgtttattctgaagaagagttacaatagtggagatccatcaactagtgaaggatcgcattctataaatgaagtgactatcaccatgcttggacctcgg

SEQ ID NO: 872 - protein, 837 aa, Populus trichocarpa
  POPTR_0004s02820.1
MNPIETFLSALFLFLVFPSCLSIDIIAPNQSIKDGDVLVSSGQSYELGFFSTGIDSTRRYVGIWCRKVSERTVVWVANRDNPINGTSGFLAINKQGNLVIYENNRSSVPVWSTNVPASISMTNCTAQLLDSGNLVLVQQDSNGVLWQSFDHGTDTLLPGMKLGLDLKIGLNRSLSSWKSKDDPGTGTILYGIDPSGFPQLFLYKGQTRWWRGGPWTGLRWSGVSEMTPTYIFNVTFVNSVDEVSIFYTMNNPSIISRMVVNESGVVQRLSWNDRDQQWIGIWSAPKEPCDTYGQCGPNSNCDPYQTNTFMCKCLPGFEPKSPQEWYLRDWSGGCVRKPKVSTCHGGEGFVEVARVKLPDTSIASANMSLRLKECEQECLRNCSCTAYASADERGLGCLRWYGDLVDTRTFSDVGQEIYIRVDRAELAKYEKSGPLANKGIQAILIVSVGVTLFLIIFLVCWFVKKRRKARDRKRRNEFPLSLTSRSNSWRDLPIKEFEEGTTSSDLPLFDLSVMAAATNNFSDANKLGEGGFGSVYKGLLHDGKEIAVKRLAKYSGQGINEFRNEVELIAKLQHRNLVRILGCCIQGREKMLIYEYLPNKSLDSFIFNEPRRSQLDWSTRHNIICGIARGILYLHEDSRLRIIHRDLKASNVLLDASMNPKISDFGMARIFGVDQIEANTNRVVGTYGYMSPEYAMQGLFSVKSDVYSFGILLLEVITGRKNSNFYDESNFSSLVGYVWDLWREGRALELVDTLMGDSYPEDQVLRCIQIGLLCVQESAMDRPSMSNVVFMLSNDTTLPSPKQPAFILKKSYNSGDPSTSEGSHSINEVTITMLGPR

SEQ ID NO: 873 - DNA, 2280 bp, Citrus clementina
  clementine0.9_030538m
ttcggcactgctactgctacagatacaatcacatcttctcagttcatcggagatcctgaagccattatctctattggcagtaaattcaagcttgggttttttagccctgatggtaattctaccaatcgctacattggaatttggtacaataaaggaggatctgcaaataaaactgtcgtatgggttgcaaacagaagcaagcctctcaatgattcatccgggattttcacaatttgggaggatggcaatcttgttgttctgaatgggcagaaagagattcattggtcatcaaatgtttcaagtttagtaaaaaatagtaacacaagagctcagcttcttgattcgggaaatcttgtcttgcatgataacattagccaagttagcatatgggatagtttccaagaagctacggatacattctattcagaaatgaaagttagcacagatctaagaacaggtaagaaagtgcagttgacatcatggagaagcctttctaatccatccattggaagcttctcagctggccttgactcctttacaattcctgaagtgttcatctggattaatggtacccgcccgtattggaggagtggtccatggaatggtcgctacttcattgggattccggatatgaattctgtttatcttgatggatttaatcttggagaggatcaccagaaaggaactcgttatctcactttcgcctttgcagacaatgatgtgtttttcaccttgactcctcaggggaatctggaagaaagagcttgggtcgacggcaaggctcatttgaagatttattttttctacccgacaaacgactgcgatgtttacggcaaatgtggggctttcggaagctgtaattcacagaaaataccaatttgtagctgtctgctagggtttgagccaaagaatgcagaggactggaacagaggaaactggtctggtgggtgtgtcagaaggaagccactgctttgtcaaaggacggtcaaacctagtgaagttgaggggaaacaagatgggttctttaagctagagactatgaaggtgccttactttgctgagcggtcctctgccaaggaagataaatgcaaggaccagtgcctgaacaattgttcctgcaaagcatatgcttatgagattggcgttgaccgaaaagatatgaaactggttatcatactatcagtgatcgtaggaataattgccattgcaatttgtacatttttcgcgtggagatggtttgctaaacgaaaggtgaacccagctagactacaggatttactagtgttcaactttgaggagctggctaatgcaactaacaacttccagttagcgaataaacttgggcaaggtggcttcggtccagtttacaagggaaaattgcaagatggacaagaaatagcagtgaaaagactatccaaagcatccggacaagggcaggaagaatttatgaatgaggttatggtaatttctaatctacagcatcgaaaccttgttagactcctcggatgttgtgttgaaagagaagaaaacatgctgatttatgaatacatgcccaataaaagtttggattcatttctattcgatccacaaagacaaagtcttttagactggccaaaacgcttcaacatcattaaaggaattagtcgaggtctcctttaccttcaccgggattctaggttgcggatcatacatagagatctaaaggcaagtaacatcttactcgatgatgatctgaatcctaaaatttcagattttggcctggcaagaattttcggaggcaatcaagatcaagccgccactaagaggctagtggggacatatgggtacatgtcacctgaatatgcaatggaaggaagattttctgaaaaatcagatgtctttagttttggagtattgttattagagattgttagcgggagaaagaacacaagtttttaccatgaggagtttgagttgactcttctaggctatgcctggaaattgtggaatgacaacaatgtaattgatttggtggatccacttatatccgaatctggcttcaaaatggagatcataaggtgcgtaaatgtgggattgctttgtgtgcaagaattcgtaaaggacaggccaaacatgccaaccgttgtatcaatgcttaatagtgaaattaaggacctccctgctgcaaaacaaccagcatttacagttaggcggggtgcctatgattcggcgtcatcttctaaccagaaccaacaaatatgttctattaacgatgttactgttacactcatggaaggccgt

SEQ ID NO: 874 - protein, 760 aa, Citrus clementina
  clementine0.9_030538m
FGTATATDTITSSQFIGDPEAIISIGSKFKLGFFSPDGNSTNRYIGIWYNKGGSANKTVVWVANRSKPLNDSSGIFTIWEDGNLVVLNGQKEIHWSSNVSSLVKNSNTRAQLLDSGNLVLHDNISQVSIWDSFQEATDTFYSEMKVSTDLRTGKKVQLTSWRSLSNPSIGSFSAGLDSFTIPEVFIWINGTRPYWRSGPWNGRYFIGIPDMNSVYLDGFNLGEDHQKGTRYLTFAFADNDVFFTLTPQGNLEERAWVDGKAHLKIYFFYPTNDCDVYGKCGAFGSCNSQKIPICSCLLGFEPKNAEDWNRGNWSGGCVRRKPLLCQRTVKPSEVEGKQDGFFKLETMKVPYFAERSSAKEDKCKDQCLNNCSCKAYAYEIGVDRKDMKLVIILSVIVGIIAIAICTFFAWRWFAKRKVNPARLQDLLVFNFEELANATNNFQLANKLGQGGFGPVYKGKLQDGQEIAVKRLSKASGQGQEEFMNEVMVISNLQHRNLVRLLGCCVEREENMLIYEYMPNKSLDSFLFDPQRQSLLDWPKRFNIIKGISRGLLYLHRDSRLRIIHRDLKASNILLDDDLNPKISDFGLARIFGGNQDQAATKRLVGTYGYMSPEYAMEGRFSEKSDVFSFGVLLLEIVSGRKNTSFYHEEFELTLLGYAWKLWNDNNVIDLVDPLISESGFKMEIIRCVNVGLLCVQEFVKDRPNMPTVVSMLNSEIKDLPAAKQPAFTVRRGAYDSASSSNQNQQICSINDVTVTLMEGR

SEQ ID NO: 875 - DNA, 2364 bp, Eucalyptus grandis
  Eucgr.D00776.1
atgtctcattatgttgtaaaattttgcattggaggagatgtcatcacagcaaatgagcatatccaagaccctgatagtataacatcaagtggaggtctctatagaatgggattctttagtcctaatggttctgcaaatcgctatgtggggatttggtacgataatgttcctacatataatgttctctgggtagcgaacagggagaatccgattttagattcttctggtgttgtgaagatatccaatgatggtaatctagtggtcatgaatggaaagggggaattagtttggtcatcaaatgtttccaactctgtaaccgatgcaaaagctcagttgttagattctgggaacctcgtcttgctcaaacatagctctaattctaatggagaccctctctggcaaagtttccagcacatgaccaattcattcttagcgaaaatgaaactcagcactatctcaaatccaaatgagaagcaggcactaacatcttggaaaagcccttctgatccatcaattggaagcttctcggcaagtcttgttccatggtacattcctgaacttttcatttggaattgcagttctctgtattggcgaagcggtccaattggaatacctaagaagcaatcagtctatattaatgggtttgacctggtgaacgatcaggaaggaacagtctatctagatcacagtttttctgaggcgtcttacttgtcatatttgttattgaaatcaaacggagatttagtgcaaccatatttggatcacaatagcagttcctggaagattgtttggtcatctcgggtgagcgattgtgatgtctatggccagtgtggaccgtttggaatctgcaatgccaggaattcaccaatttgtagctgcttgagaggctttgagcctaaaaactctgaggaatggagaagaggaaattggtccagtggatgcattcggaagtcatcgctgcagtgcaatggaactacaaatggtagcagtacagccagcaaaaaggatggatttttaaagctggaaatgatgaaagtgccaaattcagcaattttttattctacactcgaaaatgattgcccaggaaattgctcaattaattgttcatgtgtagcatatgcatatgactctggagttggctgcatgttctggacaggagacctaattgacctacagaagttgtccgttggaggaacagctctctatgttcggctggcccactcagaacttgatgaaaagggacatctgagagaaatcgtagcaactacagtcattatgggaacactcattgtcatcatcacaatatggtttgccaggtggaaggcgaaaaagcgagagaacttgagcaatgttgaattccaggagtttgtgaaatataagattgaagaattagttgcagcaacaggaaactttggtgaggccaataagcttggacggggtggtttcggtccggtatacaaggggagactaccaaacggtcaggaaatagcaatcaagaggctatcgagagcctcaggacaagggcagcaagaatttatgaacgaaatggtggttatctgtaacgtccaacatcgaaatctcgttagactcctgggatgctgttttgaaggagatgagaaaataataatctacgaattcatgccaaacaagagtcttgacacatttctttttgatccactgaaacaagtacatttggattggagaacacggttcaacattgtcgatggaatttgtcgtggtctgctttatcttcatagggactccagactgaggattatacatagagatctgaagccaagcaatatcctgctggatgaagagctcaatccaaaaatttcagactttggaatggctcggatatttgggggaaacgaaaatcaagctaatacacgaagagttgtgggaacctatggttacatggctcctgaatacgcaatggaagggcgattttcggaaaaatcagatgtctttagtttcggcatattattactggagatcataagtggaagacggaacactagttttcattatgaagatcaattcttgagccttctaggactggcatggaagttatggaatgaagacaatgttctagcactagtggacccaaacatacctgctaaatgctttgaggttcagctttcaagatgcataaatgtggggcttctttgtacgcaagaaagggcgaaagataggccttccatatcaactgttatttcaatgatcaacagtgaagtggatcttcctcgtccaaagaaacctgcattcaccccgaggaaaataacccaagacacagattcctctagaaaaagccaaaagacatgttctgccaacgatgttactcttactgttcttcaaggcaga

SEQ ID NO: 876 - protein, 788 aa, Eucalyptus grandis
  Eucgr.D00776.1
MSHYVVKFCIGGDVITANEHIQDPDSITSSGGLYRMGFFSPNGSANRYVGIWYDNVPTYNVLWVANRENPILDSSGVVKISNDGNLVVMNGKGELVWSSNVSNSVTDAKAQLLDSGNLVLLKHSSNSNGDPLWQSFQHMTNSFLAKMKLSTISNPNEKQALTSWKSPSDPSIGSFSASLVPWYIPELFIWNCSSLYWRSGPIGIPKKQSVYINGFDLVNDQEGTVYLDHSFSEASYLSYLLLKSNGDLVQPYLDHNSSSWKIVWSSRVSDCDVYGQCGPFGICNARNSPICSCLRGFEPKNSEEWRRGNWSSGCIRKSSLQCNGTTNGSSTASKKDGFLKLEMMKVPNSAIFYSTLENDCPGNCSINCSCVAYAYDSGVGCMFWTGDLIDLQKLSVGGTALYVRLAHSELDEKGHLREIVATTVIMGTLIVIITIWFARWKAKKRENLSNVEFQEFVKYKIEELVAATGNFGEANKLGRGGFGPVYKGRLPNGQEIAIKRLSRASGQGQQEFMNEMVVICNVQHRNLVRLLGCCFEGDEKIIIYEFMPNKSLDTFLFDPLKQVHLDWRTRFNIVDGICRGLLYLHRDSRLRIIHRDLKPSNILLDEELNPKISDFGMARIFGGNENQANTRRVVGTYGYMAPEYAMEGRFSEKSDVFSFGILLLEIISGRRNTSFHYEDQFLSLLGLAWKLWNEDNVLALVDPNIPAKCFEVQLSRCINVGLLCTQERAKDRPSISTVISMINSEVDLPRPKKPAFTPRKITQDTDSSRKSQKTCSANDVTLTVLQGR

SEQ ID NO: 877 - DNA, 2280 bp, Eucalyptus grandis
  Eucgr.D00778.1
atgtctcattatgttgtaaaattttgcattggaggagatgtcatcacagcaactgagcatatccaagaccctgctagtctaacatcaagtggaggtctctatagaatgggattctttagtcctaatggttctgcaaatcgctatgtggggatttggtacgataatgttcctacatataatgttctctgggtagcgaacagggagaatccgattttagattcttctggtgttgtgaagatatccaatgatggtaatctagtggtcatgaatggaaagggggaattagtttggtcatcaaatgtttccaactctctaactgatgcaaaagctcagttgtcagattatgggaacctcgtcttgctcaaacaaggctctaattctagtgcaaatagtgcagaccctctctggcaaagtttccagcacatgaccaattcattcttagcgacaatgaaactcagcactatctcaaatccaaatgagaagcaggcactaacatcttggaaaagcacttctgatccatcaattggaagcttctcggcaagtcttgttccacggcacattcctgaacttttcatttggaattgcagttctctgtattggcgaagcggtccaattggagtacttaagaagcaatcagtccatattaatgggtttgacctggtggacgatccggaaggatcagtctatctagctcacagtttttctgaggcgtcttacttgtcatatttgttattaaaatcaaatggagatttagtgcaaccatatttggatcacaatagcagttcctggaagattgtttggtcatctcgggtgagcgattgtgatgtctatggccagtgtggaccgtttggaatctgcaatgccaggaattcaccaatttgtagctgcttgagaggctttgagcctaaaaactctgaggaatggagaagaggaaattggtccagtggatgcattcggaagtcatcgctgcagtgcaatggaactacaaatggtagcagtacagccagcaaaaaggatggatttttaaagctggaaatgatgaaagtgccaaattcagcaattttttattctatactcgaaaatgtttgcccagaaaattgctcaattagttgttcatgtgtagcatatgcatatgactctggagtaggctgcatgttctggacaggagacctaattgacctacagaagttctccgttggaggaacagctctctatgttcggctggcccactcagaacttgatgaaaagggacatctgagagaaatcgtagcaactacagtcatcatgggaacactcattgtcatcatcacaacatggtttgccaggaggaaggcgaaaaagcgaggtaataggcactcatttagtccctgtgtacaggggagactaccaaacggtcaggaaatagcaatcaagaggctatcgagagcctcaggacaagggcagcaagaatttatgaacgaaatggtggttatctgtaacgtccaacatcgaaatctcgttagactcctgggatgctgttttgaaggagatgagaaaataataatctacgaattcatgccaaacaagagtcttgacacatttctttttgatccactgaaacaagtacatttggattggagaacacggttcaacattgtcgatggaatttgtcgcggtctgctttatcttcatagggactccagactgaggattatacatagagatctgaagccaagcaatatcctgctggatgaagagctcaatccaaaaatttcagactttggaatggctcggatatttgggggaaacgaaaatcaagctaatacacgaagagttgtgggaacctatggttacatggctcctgaatacgcaatgaaagggcgattttcggaaaaatcagatgtctttagtttcggcatattattactggagatcataagtggaagacggaacactagttttcattatgaagatcaattcttaagccttctaggactggcatggaagttatggaatgaagagaatgttctagcactagtggacccaaacatacctgctaaatgctttgaggttcagctttcaagatgcataaatgtggggcttctttgtacgcaagaaagggcgaaagataggccttccatatcaactgttatttcaatgatcaacagtgaagtggatcttcctcgtccaaagaaacctgcattcaccccgaggaaaataacccaagacacagattcctctagaaaaagccaaaagacatgttctgccaacgatgttactcttactgttcttcaaggcaga

SEQ ID NO: 878 - protein, 760 aa, Eucalyptus grandis
  Eucgr.D00778.1
MSHYVVKFCIGGDVITATEHIQDPASLTSSGGLYRMGFFSPNGSANRYVGIWYDNVPTYNVLWVANRENPILDSSGVVKISNDGNLVVMNGKGELVWSSNVSNSLTDAKAQLSDYGNLVLLKQGSNSSANSADPLWQSFQHMTNSFLATMKLSTISNPNEKQALTSWKSTSDPSIGSFSASLVPRHIPELFIWNCSSLYWRSGPIGVLKKQSVHINGFDLVDDPEGSVYLAHSFSEASYLSYLLLKSNGDLVQPYLDHNSSSWKIVWSSRVSDCDVYGQCGPFGICNARNSPICSCLRGFEPKNSEEWRRGNWSSGCIRKSSLQCNGTTNGSSTASKKDGFLKLEMMKVPNSAIFYSILENVCPENCSISCSCVAYAYDSGVGCMFWTGDLIDLQKFSVGGTALYVRLAHSELDEKGHLREIVATTVIMGTLIVIITTWFARRKAKKRGNRHSFSPCVQGRLPNGQEIAIKRLSRASGQGQQEFMNEMVVICNVQHRNLVRLLGCCFEGDEKIIIYEFMPNKSLDTFLFDPLKQVHLDWRTRFNIVDGICRGLLYLHRDSRLRIIHRDLKPSNILLDEELNPKISDFGMARIFGGNENQANTRRVVGTYGYMAPEYAMKGRFSEKSDVFSFGILLLEIISGRRNTSFHYEDQFLSLLGLAWKLWNEENVLALVDPNIPAKCFEVQLSRCINVGLLCTQERAKDRPSISTVISMINSEVDLPRPKKPAFTPRKITQDTDSSRKSQKTCSANDVTLTVLQGR

SEQ ID NO: 879 - DNA, 2277 bp, Eucalyptus grandis
  Eucgr.D00785.1
atggcgcgtggtggcgcgtgtagaggcatccagcgagatgtcatcactgcaacagagtatatccaagaccctgcaagtataacatcaagtggaggtctctacagattgggattctttagccctaatggttctgcaaatcgctatgtagggatttggtacaacaatgttcctacatataatgttctctgggtagcgaacagggagaatccaatttttgactcttctggtgttgtgacaatatccgatgatggtaatcttgtggttatgaatggaaagggggaaatagtttggtcatcaaatgtttccaactctgtaaccgatgcaaaagctcagttgtcagattctgggaacctggtcttgctcaaacggatctcttactcgagggcaaatgattcagagattctctgggacagtttccagcacatgactgattcattcttacagaaaatgaagctgatcactaactcgagaacaaataagatgcaggcattaacatcttggaaaagcccttctgatccatcaattggaagcttctcagtgagtcttgatctgcataacattcctgaacttttcattcagaatggcagttctctgtattggcgaagtggtccatggaatggtaatatattcattggagtacctaagatgcaatcagtctatattaatgggtttaacctggtggacaatcacgaaggaacagtctatctgacttacagttttgctgaggcgtcttacttgttattgaaatcaaatggggatttggtgcaaccgtacttggatcagtatagcagttcctgggggattgtttggtcatctcgggtgagcgattgtgatgtctacggccagtgtggaccgttcggaatctgcaatgccaagaattcaccaatttgtagctgcttgagaggctttgagcctaaaaacattgaggaatggagcagaggaaattggtccagtggatgcattcggaagtcattgctgcagtgcaatggaactacaaatggtagcagtacagccagcaaaaaggatggatttttaaagctggaaatgatgaaagtgccaaattcgggaattttttattctacactggaaagtgattgcccaggaaattgctcaattaattgttcatgtgtagcatacgcatttgaccctggtgttggctgcatgttctggatacaagacctaattgacctacagaagttctccgttggaggaacaactctttacgttcggctggcccacttagaactcgagaacttgagcagagtcgagttccaggagtttgtaaaatataaaattgaagaattggctgccgcaacaggaaactttggtgaggccaataagcttgggcggggtggtttcgggccagtatataaggggagactaccaaacggtcaggaaatagcaatcaagaggctatcgagagcctcaggacaaggacagcaggaatttatgaacgaaatggtggtcaattgtaaggtccaacatcgaaatctcgttagactgcttggatgctgtgttgaaggagatgagaaaatgttaatctatgaattcatgccaaacaagagcctagacacatttctctttgatccactgaaacgagtacatttggattggagaacccggttcaacattgttaatggaatttgtcgaggtttgctttatcttcatagggattctagactaaggattatacatagagatttgaaggcaggcaatatcttgctggatgaagagctcaatccaaagatttcagactttggaatggctcgaatatttggaggaaatgaaaaccaagctaatacacaaagagttgtgggaacctatggctacatggctcctgaatatgcaatgcaagggagattttcggaaaaatcagatgtctttagcttcggcatattattactagagatcataagtgggagacagaacacgagttttcatgatgaagatcaatgcctgagccttctaggattggcatggaagttatggaatggagagaatggtctagcactagtggacccaaacatacctgctaaatgctttgaggttcagcttttaaggtgcataaatgtggggcttctttgtgcgcaagaaagggcaaaagataggccttccatatcaactgttatttcaatgatcaatagtaaagtggatcttcttcgtccaaagaaacctgcattcaccccgtggaaaataacccaagacacagattcctcaggaaaaaaccaaaagacatgttctgccaacgatgttactcttactgttcttcaaggcaga

SEQ ID NO: 880 - protein, 759 aa, Eucalyptus grandis
  Eucgr.D00785.1
MARGGACRGIQRDVITATEYIQDPASITSSGGLYRLGFFSPNGSANRYVGIWYNNVPTYNVLWVANRENPIFDSSGVVTISDDGNLVVMNGKGEIVWSSNVSNSVTDAKAQLSDSGNLVLLKRISYSRANDSEILWDSFQHMTDSFLQKMKLITNSRTNKMQALTSWKSPSDPSIGSFSVSLDLHNIPELFIQNGSSLYWRSGPWNGNIFIGVPKMQSVYINGFNLVDNHEGTVYLTYSFAEASYLLLKSNGDLVQPYLDQYSSSWGIVWSSRVSDCDVYGQCGPFGICNAKNSPICSCLRGFEPKNIEEWSRGNWSSGCIRKSLLQCNGTTNGSSTASKKDGFLKLEMMKVPNSGIFYSTLESDCPGNCSINCSCVAYAFDPGVGCMFWIQDLIDLQKFSVGGTTLYVRLAHLELENLSRVEFQEFVKYKIEELAAATGNFGEANKLGRGGFGPVYKGRLPNGQEIAIKRLSRASGQGQQEFMNEMVVNCKVQHRNLVRLLGCCVEGDEKMLIYEFMPNKSLDTFLFDPLKRVHLDWRTRFNIVNGICRGLLYLHRDSRLRIIHRDLKAGNILLDEELNPKISDFGMARIFGGNENQANTQRVVGTYGYMAPEYAMQGRFSEKSDVFSFGILLLEIISGRQNTSFHDEDQCLSLLGLAWKLWNGENGLALVDPNIPAKCFEVQLLRCINVGLLCAQERAKDRPSISTVISMINSKVDLLRPKKPAFTPWKITQDTDSSGKNQKTCSANDVTLTVLQGR

SEQ ID NO: 881 - DNA, 2376 bp, Eucalyptus grandis
  Eucgr.D00792.1
atgactttcgtgactcgcgtcgtccgcagccttccgagaccacgaatcggtggagaaattagaggatcttcgtgtctcttgaagacagtaatttggtctgatgcagttcggccatcagatggcaagactggagatgtcatcactgcaacagagtatatccaagaccctgcaagtataacatcaagtggaggtctctacagtatgggattctttagccctaatggttctgcaaatcgctatgtagggatttggtacaataaggttcctacatctaatgttctctgggtagcgaacagggagaatccaatttttgactcttctggtgttgtgaagatatccggtgatggtaatcttgtggtcatgaatggaaagagggaatcagtttggtcatcaaatgtttccaactctgtaactgatgcaaaagctcagttgtcagattctgggaatctggtcttgctcaaacagacctctaactctagtgcaaatgattcagagactctctgggacagtttccagcacatgaccgattcattcttacagaaaatgaagctgactaccaactcaagaacaaatgagacgcaggcattaacgtcttggaaaagcccttctgatccatcaattggaagcttctcagcgagtcttgatctgcataacattcctgaacttttcattcggaatggcagttctctgtattggcgaagtggtccatggaatggtaatatattcattggagtaccgaagatgcaatcagtctatattaatgggtttaccctggtggacgatcacgaaggaacagtctatctgacttacagttttgctgaggcgtcttacttgtcatatttgttattgaaatcaaatggggatttggtgcaaccatacttggataagaatagcagttcctgggggattgtttggtcatctcgggtgagtgattgtgatgtctacggccagtgtggaccgttcggaatctgcaatgccaagaattcaccaatttgtagctgtttgagaggctttgagccaaaaaacttcgaggaatggggcagaggaaattggtccggtggatgcattcggaagtcattgctgcagtgcaatggaactgcaaatggtagcagtacagccagcaaaaaggatggatttttaaagctggaaatgatgaaagtgccaaattcgggaattttttattctacactggaaagtgattgcccaggaaattgctcaattaattgttcatgtgtagcatatgcatttgaccctggtgttggctgcatgttctggatacaagacctaattgacctacagaagttctccgttggaggaacaactctttacgttcggctggcccactcagaactcgagaacttgagcagagtcgagttccaggagtttgtaaaatataaaattgaagaattggcttccgcaacaggaaactttggtgaggccaataagcttgggcggggtggtttcgggccagtatataaggggactctgccaaacggtcaggaaatagcagtcaagaggctatcgagagcctcaggacaaggacagcaggaatttattaacgaaatggtggtcatttgtaaggtccaacatcgaaatctcgtgagactgcttggatgctgtgttgaaggagatgagaaaatgttaatctatgaattcatgccaaacaagagcctagacacatttctttttgatccactaaaacgagtacatttggattggagaacacggttcaacattgttgatggaatttgtcgaggtttgctttatcttcatagggattctagactaaggattatacatagagatttgaaggcaggcaatatcttgctggatgaagagctcaatccaaaaatttccgactttggaatggctcggatatttggaggaaatgaaaatcaagctaatacacgaagagttgtgggaacctatggctacatggctcctgaatacgcaatggatgggcgattttcagaaaaatcagatgtctttagcttcggcatattattactggagatcataagtgggagacggaacacgagttttcatgatgaagatcaatgcttgagccttctaggattggcatggaagttatggaatgaagacaatgttctagcactagtggacccaaacatacctgctaaatgctttgaggttcagcttttaaggtgcataaatgtggggcttctctgtacgcaagaaagggcaaaagataggccttccatatcaactgttatttcaatgatcaacatggatcttcctcgtccaaagaaacctgcattcactgcgaagaaaataacccaagacactgattcctctggaaaaaacccaaagacatgttctgccaacgatgttgctcttactgttcttcaaggcaga

SEQ ID NO: 882 - protein, 792 aa, Eucalyptus grandis
  Eucgr.D00792.1
MTFVTRVVRSLPRPRIGGEIRGSSCLLKTVIWSDAVRPSDGKTGDVITATEYIQDPASITSSGGLYSMGFFSPNGSANRYVGIWYNKVPTSNVLWVANRENPIFDSSGVVKISGDGNLVVMNGKRESVWSSNVSNSVTDAKAQLSDSGNLVLLKQTSNSSANDSETLWDSFQHMTDSFLQKMKLTTNSRTNETQALTSWKSPSDPSIGSFSASLDLHNIPELFIRNGSSLYWRSGPWNGNIFIGVPKMQSVYINGFTLVDDHEGTVYLTYSFAEASYLSYLLLKSNGDLVQPYLDKNSSSWGIVWSSRVSDCDVYGQCGPFGICNAKNSPICSCLRGFEPKNFEEWGRGNWSGGCIRKSLLQCNGTANGSSTASKKDGFLKLEMMKVPNSGIFYSTLESDCPGNCSINCSCVAYAFDPGVGCMFWIQDLIDLQKFSVGGTTLYVRLAHSELENLSRVEFQEFVKYKIEELASATGNFGEANKLGRGGFGPVYKGTLPNGQEIAVKRLSRASGQGQQEFINEMVVICKVQHRNLVRLLGCCVEGDEKMLIYEFMPNKSLDTFLFDPLKRVHLDWRTRFNIVDGICRGLLYLHRDSRLRIIHRDLKAGNILLDEELNPKISDFGMARIFGGNENQANTRRVVGTYGYMAPEYAMDGRFSEKSDVFSFGILLLEIISGRRNTSFHDEDQCLSLLGLAWKLWNEDNVLALVDPNIPAKCFEVQLLRCINVGLLCTQERAKDRPSISTVISMINMDLPRPKKPAFTAKKITQDTDSSGKNPKTCSANDVALTVLQGR

SEQ ID NO: 883 - DNA, 2454 bp, Eucalyptus grandis
  Eucgr.E00547.1
atgatatttctggcaaaagcaagatttttgtctctctttcttgtgtttcattatgttgtagaattttgcattggaggagatgtcatcacagcatctgagtatatccaagaccctggaagtataacatcaagtggaggtctctacagaatgggattctttagccctaatggttctgcaaatcgctatgtggggatttggtacaataatgttcctagatatagtgttctctgggtagcgaacaggaagaatccgattttagactcttctggtgtcatgaccatatccggtgatggtaatcttgtggtcatgaatggaaagagggaattagtttggtcatcaaacgtttccaactctgtaaccaatgcaaaagctcagttgttagattctgggaaccttgtcttgctcaagcagagctctaattctagtgcaaatgatgcagagaatctatgggaaagtttccagcacatgacggattcattcttggagaaaatgaagctcagcactaactcaagaacaaatgagaagcaggcactaacatcttggaaaagcccttctgatccatcaattggaagcttctcggcaagtcttgatccacgaaacattcctgaacttttcatttggaatggcagttctctgtactggcggagcggtccatggaatggtaatatattcactggagtacctgagatgcaatcagtctatagtaatggatttgctgaggcgtcttatatgtcatatttgttattgaaatcaaatggggatttggtgcaaccatactgggatcagagtagcagttcctgggggatcgtttggtcatctcggttgagtgattgtgatgtctatggccagtgcggaccatttggaatctgcaatgccaagaaatcaccaatttgtagctgcttgaaaggttttgagcctaaaaactttgaggaatggagcagaggaaattggtccagtggatgcattcggaagtcattgctgcagtgcaatggaactacaaatggtagcagtacagccggcaaaaaggatggctttttaaagctggaaataatgaaagtgccaagttctggaatttttttttctaccctcgaagaggattgcccaggaaattgctcaatgaattgttcatgtgtagcatatgcatatgactctggtgtcggctgcgtgttctggataggagaactaattgacctgcagaagttctccattggaggaacaactctttatgttcggctggcccactcagaacttgagaaaaagggacatctgagagaaatcatagcaactacagtcatcataggaacactcgttgtcatcatcataatatggtttgccaggaggaaggcaaaaaaacaagcagtaaagcaaagcatggaaaaacatttgtccagtggagaagccccttcagtggtgatgcttggagagaacttgagcagagttgagttccaggagtttgtgaaatataaaattgaagaattggctgcagcaactggaaacttttgtgaggccaataagcttggacggggtggtttcgggccagtatataaggggagactaccaaacggtcaggaaatagcaatcaagaggctatcgagagcctcaggacaagggcagcaggaatttatgaacgaaatggaggtcatttgtaaggtccaacatcgaaatcttgttagactgctcggatgctgtgctgaaggagatgagaaaatgttaatctacgaattcatgccaaacaagagtctggacacatttatttttgatccactgaaacaagtacacttggattggagaacacggttcaacattgttgatggaatttgtcgaggtctgctttatctccatagggactctagactaagaattattcatagagatttgaaggcaagcaatatcctgctggataaagagctcaatccaaaaatttcagactttggaatggctcggatatttgggggaaatgaaaatcaagctaatacacgaagagttgtgggaacctatggttatatggctcctgaatatgcaatggaagggcgattttcggaaaaatcagatgtctttagctttggcatattattactagagattgtaagtggaagacggaacacgagttttcattatgaagatcaatgcttgagccttctaggattggcatggaagttatggaatgaagaggatgttctagcactagtggacccaaccatgcctgctacaccctttgaggttcagctttcaaggtgcataaatgtggggcttctctgtacacaagaaagggcaaaagatcggccttccatatcaacagttatttctatgatcaacagtgaaattgtggatcttcctcgtccaaagcaacctgcattcaccgcgaggaaaataacccaagacacggattcctctggacaaagccaaaagacatgttctgccaacgatgtcactcttactgttcttcaaggaaga

SEQ ID NO: 884 - protein, 818 aa, Eucalyptus grandis
  Eucgr.E00547.1
MIFLAKARFLSLFLVFHYVVEFCIGGDVITASEYIQDPGSITSSGGLYRMGFFSPNGSANRYVGIWYNNVPRYSVLWVANRKNPILDSSGVMTISGDGNLVVMNGKRELVWSSNVSNSVTNAKAQLLDSGNLVLLKQSSNSSANDAENLWESFQHMTDSFLEKMKLSTNSRTNEKQALTSWKSPSDPSIGSFSASLDPRNIPELFIWNGSSLYWRSGPWNGNIFTGVPEMQSVYSNGFAEASYMSYLLLKSNGDLVQPYWDQSSSSWGIVWSSRLSDCDVYGQCGPFGICNAKKSPICSCLKGFEPKNFEEWSRGNWSSGCIRKSLLQCNGTTNGSSTAGKKDGFLKLEIMKVPSSGIFFSTLEEDCPGNCSMNCSCVAYAYDSGVGCVFWIGELIDLQKFSIGGTTLYVRLAHSELEKKGHLREIIATTVIIGTLVVIIIIWFARRKAKKQAVKQSMEKHLSSGEAPSVVMLGENLSRVEFQEFVKYKIEELAAATGNFCEANKLGRGGFGPVYKGRLPNGQEIAIKRLSRASGQGQQEFMNEMEVICKVQHRNLVRLLGCCAEGDEKMLIYEFMPNKSLDTFIFDPLKQVHLDWRTRFNIVDGICRGLLYLHRDSRLRIIHRDLKASNILLDKELNPKISDFGMARIFGGNENQANTRRVVGTYGYMAPEYAMEGRFSEKSDVFSFGILLLEIVSGRRNTSFHYEDQCLSLLGLAWKLWNEEDVLALVDPTMPATPFEVQLSRCINVGLLCTQERAKDRPSISTVISMINSEIVDLPRPKQPAFTARKITQDTDSSGQSQKTCSANDVTLTVLQGR

SEQ ID NO: 885 - DNA, 2451 bp, Eucalyptus grandis
  Eucgr.E00547.2
atgatatttctggcaaaagcaagatttttgtctctctttcttgtgtttcattatgttgtagaattttgcattggaggagatgtcatcacagcatctgagtatatccaagaccctggaagtataacatcaagtggaggtctctacagaatgggattctttagccctaatggttctgcaaatcgctatgtggggatttggtacaataatgttcctagatatagtgttctctgggtagcgaacaggaagaatccgattttagactcttctggtgtcatgaccatatccggtgatggtaatcttgtggtcatgaatggaaagagggaattagtttggtcatcaaacgtttccaactctgtaaccaatgcaaaagctcagttgttagattctgggaaccttgtcttgctcaagcagagctctaattctagtgcaaatgatgcagagaatctatgggaaagtttccagcacatgacggattcattcttggagaaaatgaagctcagcactaactcaagaacaaatgagaagcaggcactaacatcttggaaaagcccttctgatccatcaattggaagcttctcggcaagtcttgatccacgaaacattcctgaacttttcatttggaatggcagttctctgtactggcggagcggtccatggaatggtaatatattcactggagtacctgagatgcaatcagtctatagtaatggatttgctgaggcgtcttatatgtcatatttgttattgaaatcaaatggggatttggtgcaaccatactgggatcagagtagcagttcctgggggatcgtttggtcatctcggttgagtgattgtgatgtctatggccagtgcggaccatttggaatctgcaatgccaagaaatcaccaatttgtagctgcttgaaaggttttgagcctaaaaactttgaggaatggagcagaggaaattggtccagtggatgcattcggaagtcattgctgcagtgcaatggaactacaaatggtagcagtacagccggcaaaaaggatggctttttaaagctggaaataatgaaagtgccaagttctggaatttttttttctaccctcgaagaggattgcccaggaaattgctcaatgaattgttcatgtgtagcatatgcatatgactctggtgtcggctgcgtgttctggataggagaactaattgacctgcagaagttctccattggaggaacaactctttatgttcggctggcccactcagaacttgagaaaaagggacatctgagagaaatcatagcaactacagtcatcataggaacactcgttgtcatcatcataatatggtttgccaggaggaaggcaaaaaaacaagtaaagcaaagcatggaaaaacatttgtccagtggagaagccccttcagtggtgatgcttggagagaacttgagcagagttgagttccaggagtttgtgaaatataaaattgaagaattggctgcagcaactggaaacttttgtgaggccaataagcttggacggggtggtttcgggccagtatataaggggagactaccaaacggtcaggaaatagcaatcaagaggctatcgagagcctcaggacaagggcagcaggaatttatgaacgaaatggaggtcatttgtaaggtccaacatcgaaatcttgttagactgctcggatgctgtgctgaaggagatgagaaaatgttaatctacgaattcatgccaaacaagagtctggacacatttatttttgatccactgaaacaagtacacttggattggagaacacggttcaacattgttgatggaatttgtcgaggtctgctttatctccatagggactctagactaagaattattcatagagatttgaaggcaagcaatatcctgctggataaagagctcaatccaaaaatttcagactttggaatggctcggatatttgggggaaatgaaaatcaagctaatacacgaagagttgtgggaacctatggttatatggctcctgaatatgcaatggaagggcgattttcggaaaaatcagatgtctttagctttggcatattattactagagattgtaagtggaagacggaacacgagttttcattatgaagatcaatgcttgagccttctaggattggcatggaagttatggaatgaagaggatgttctagcactagtggacccaaccatgcctgctacaccctttgaggttcagctttcaaggtgcataaatgtggggcttctctgtacacaagaaagggcaaaagatcggccttccatatcaacagttatttctatgatcaacagtgaaattgtggatcttcctcgtccaaagcaacctgcattcaccgcgaggaaaataacccaagacacggattcctctggacaaagccaaaagacatgttctgccaacgatgtcactcttactgttcttcaaggaaga

SEQ ID NO: 886 - protein, 817 aa, Eucalyptus grandis
  Eucgr.E00547.2
MIFLAKARFLSLFLVFHYVVEFCIGGDVITASEYIQDPGSITSSGGLYRMGFFSPNGSANRYVGIWYNNVPRYSVLWVANRKNPILDSSGVMTISGDGNLVVMNGKRELVWSSNVSNSVTNAKAQLLDSGNLVLLKQSSNSSANDAENLWESFQHMTDSFLEKMKLSTNSRTNEKQALTSWKSPSDPSIGSFSASLDPRNIPELFIWNGSSLYWRSGPWNGNIFTGVPEMQSVYSNGFAEASYMSYLLLKSNGDLVQPYWDQSSSSWGIVWSSRLSDCDVYGQCGPFGICNAKKSPICSCLKGFEPKNFEEWSRGNWSSGCIRKSLLQCNGTTNGSSTAGKKDGFLKLEIMKVPSSGIFFSTLEEDCPGNCSMNCSCVAYAYDSGVGCVFWIGELIDLQKFSIGGTTLYVRLAHSELEKKGHLREIIATTVIIGTLVVIIIIWFARRKAKKQVKQSMEKHLSSGEAPSVVMLGENLSRVEFQEFVKYKIEELAAATGNFCEANKLGRGGFGPVYKGRLPNGQEIAIKRLSRASGQGQQEFMNEMEVICKVQHRNLVRLLGCCAEGDEKMLIYEFMPNKSLDTFIFDPLKQVHLDWRTRFNIVDGICRGLLYLHRDSRLRIIHRDLKASNILLDKELNPKISDFGMARIFGGNENQANTRRVVGTYGYMAPEYAMEGRFSEKSDVFSFGILLLEIVSGRRNTSFHYEDQCLSLLGLAWKLWNEEDVLALVDPTMPATPFEVQLSRCINVGLLCTQERAKDRPSISTVISMINSEIVDLPRPKQPAFTARKITQDTDSSGQSQKTCSANDVTLTVLQGR

SEQ ID NO: 887 - DNA, 2487 bp, Eucalyptus grandis
  Eucgr.D00781.1
atgattcttctaagaaaaataagagtattctctctctttattttgtctcattatgctgtgaaattttgcattgggggagatgtcattacagcatctgagtacatccaagaccctggaagtatcatatcaagcggaggtctctacagactgggattctttagccccaatggtaccaccaatcggtatgttggaatttggcataacaagattcctgtgtttaacgtcttttgggttgcaaacagggagaatcctgttctagattcttctggtgtcatgaccatatccgatgccggtaatctggtgatattgaatggaaagaagcaagtactttggtcaacaaacgtttccacctctggagcaaatgcaaaagcccaattattagatactggaaatcttatcttgcaaaaacaaagttctaatatgagcacaaatgatacaacggcatgggaaagtttccagatcatgtgtgatacacaaatcgcgaaaatgaagcttagcaccaacttgagaacaaatgagaagcaggtactcacatcttggaaaagcccttctgacccatcgattggaagtttttcaattagtcttgaaccactaaatattcctgaagttttcctttggaacggcactactctatattggcggagtggtccatggaatggtaaggttttcctcggaattcccgagatggaatcagtctatgttgatcgatataccttagtggatgataaagaaggatatgtctatctgacttacagttttgcagaggtgtcttatttgtcatacttttttgtgaggtcaaatggggagttgttgcagccattctgggatgaaaatgataagtggtggcggattgattggtcaacccgggcatctgattgttatgtttatggcaagtgcggtccatttggatattgtgatgccaagaaatcaccaatttgcagttgcttgagaggctttgagccaaaaaaagttgaagaatggagcagagggaattggtccagcggatgcatccagaagtcattgctgcaatgcgataggttgaaaaacggtagtactaaagcgggaaaaattgatggatttgtaaagcttgagaatgtgaaagtgccgaattatgcaatttggttatctcctttggaagacaagtgccgagagcagtgcctcagtaattgttcatgcgcagcatatgcttatgatgctggcgttggttgcatgtactggagcggagacctaatcgacgtacagaagttctcctatccaggaacaactctttatgttcgagtggcccatacagaacttgaaggaaaaagagatctgagagcaattatagcgattgcagttgttgtggcaactgtaattttcagtattggtactttcttcgcctggcagaagtcgaaaaaacgaggtggtaaagacggagaacaattttcaaaggcttctagtgagaacatgctcggagggagcttgagcaaagttaatctccaggagcttgtgctatataaattggaagagctggcagcagcaacaagcaactttagtgatgcaaacaagctcggggagggtggttttggggcagtatatagggggagactgctaaatggaaaagaaatagcagtcaaaagactatcaggggcctctggacaaggattgcgggaatttatcaatgaaatggaagtgatttccaaggtccaacatcgaaatctcgttcgactccttggatgttgtgccgagcaagatgaaaaactattaatctatgagttcatgccaaacaagggtctagatgcatttctttttgatcctctcaaacgagagcagctggattggagaagacgattcaacatcattgatggaatatgtcgaggcctactataccttcaccgtgactccagactacggataattcatagagatcttaagacgagcaatatcctgttggatgaagagctcaatccaagaatttcagactttggaacggctagaatatttgggggaaaagaagatcaagcagatacactaagagttgtgggaacctatggttacatggctccggaatatgcaatggaagggcggttttcggaaaaatcagatgtctttagctttggggtagtattgctggagattgtaagtggaagacagaacactagcttcaatgaggaagatcagtccttgagcttgttagggttggcatggaaatattgggaggaagacaatgtacttgcgctggtggaccataaaatttctgttggatgctccgagattgagatcataaggtgcataaatgtggggctgctttgtacacaagaacttgcaaaggataggcctaccatttcaactgttatttcaatgattagcaatgaaattgttggtcttcctcgtccgaacaaacctgcattccccgagaggcaaacaactaccgacacagattcctccagacaaagtcagaaaaaatactctgccaacaatgtcactattaccgctcttgaaggcaga

SEQ ID NO: 888 - protein, 829 aa, Eucalyptus grandis
  Eucgr.D00781.1
MILLRKIRVFSLFILSHYAVKFCIGGDVITASEYIQDPGSIISSGGLYRLGFFSPNGTTNRYVGIWHNKIPVFNVFWVANRENPVLDSSGVMTISDAGNLVILNGKKQVLWSTNVSTSGANAKAQLLDTGNLILQKQSSNMSTNDTTAWESFQIMCDTQIAKMKLSTNLRTNEKQVLTSWKSPSDPSIGSFSISLEPLNIPEVFLWNGTTLYWRSGPWNGKVFLGIPEMESVYVDRYTLVDDKEGYVYLTYSFAEVSYLSYFFVRSNGELLQPFWDENDKWWRIDWSTRASDCYVYGKCGPFGYCDAKKSPICSCLRGFEPKKVEEWSRGNWSSGCIQKSLLQCDRLKNGSTKAGKIDGFVKLENVKVPNYAIWLSPLEDKCREQCLSNCSCAAYAYDAGVGCMYWSGDLIDVQKFSYPGTTLYVRVAHTELEGKRDLRAIIAIAVVVATVIFSIGTFFAWQKSKKRGGKDGEQFSKASSENMLGGSLSKVNLQELVLYKLEELAAATSNFSDANKLGEGGFGAVYRGRLLNGKEIAVKRLSGASGQGLREFINEMEVISKVQHRNLVRLLGCCAEQDEKLLIYEFMPNKGLDAFLFDPLKREQLDWRRRFNIIDGICRGLLYLHRDSRLRIIHRDLKTSNILLDEELNPRISDFGTARIFGGKEDQADTLRVVGTYGYMAPEYAMEGRFSEKSDVFSFGVVLLEIVSGRQNTSFNEEDQSLSLLGLAWKYWEEDNVLALVDHKISVGCSEIEIIRCINVGLLCTQELAKDRPTISTVISMISNEIVGLPRPNKPAFPERQTTTDTDSSRQSQKKYSANNVTITALEGR

SEQ ID NO: 889 - DNA, 2487 bp, Eucalyptus grandis
  Eucgr.D00793.1
atgattcttctaagaaaagtaagagtattctctctctttattttgtctcattatgctgtgaaattttgcattgggggagatatcattacagcatctgagtacatccaagaccctggaagtatcatatcaagtggaggtctctacaaactgggattctttagccccaatggtaccaccaatcggtatgttggaatttggcataacaagattcctgcgcttaacgtcttttgggttgcaaacagggagaagcctgttctagattcttctggtgtcatgaccatatccaatgatggtaatctcgtgatattgaatggaaagaaggaagtactttggtcatcaaacgtttccacctctggagctaatgcaaaagcccatttattagatactggaaatcttatcttgcaaaaacaaagctctaatatgagcacaaatgatacaacggcatgggaaagtttccagaccatgtgtgatacattcatcgcgaaaatgaagcttagcaccaacttgagaacaaatgagaagaaggtactcacatcttggaaaagcccttctgacccatcgattggaagtttttcaattagtcttgaaccactaaatattcctgaagttttcctttggaacggcactactctatattggcggagtggtccatggaatggtaaggttttcattggaattcccgagatggaatcagtctatcttgatggatttaccttagtggatgataaagaaggatatgtctatctgacttacaattttgcagaggtgtcttatttttcatacttttttgtgaggtcaaatggggagttgttgcagccattctgggatgaaaaatataagaagtggcggatcgattggtcaacccaagcatctgattgtgatgtttatggcaagtgtggtccatttggatactgtgatgccaagaaatcaccaatttgcagctgcttgagaggctatgagccaaaaaaagttgaagaatggagcagagggaattggtccagcggatgcatccagaagtcattgctgcaatgcgctaggttgaaaaatggtagtactaaagcgggaaaaattgatggatttgtaaagcttgagaatgtgaaagtgccgaattatgcaatctggtcatctcctttggaagacaagtgccaagagcagtgcctcagtaattgttcgtgcgcagcatatgcttatgatgccggcgttggttgcatgtactggagtggagacctaatcgacgtacggaagttctcctatgcaggaacaactctttatgttcgagtggcccatacagaactcgaaggaaaaagagatctgagagcaattatagcgactgcagcagttgtggcaactgtaattttcagtattggtactttcttcgcctggcagaagtcgaaaaaacgaggtggtaaagacggagaacaattttcaaaggcttctagtgagaacatgctcagagggagcttgagcaaagttaatctccaggagcttgtgctatataaattggaagagctggctgcagcaacaagcaactttagtgatgcaaacaagctcggggagggtggttttggggcagtatatagggggagattgctaaatggaaaagaaatagcagtcaaaagactatcaggggcctctggacaaggattgcgggaatttatcaatgaaatggaagtgatttccaaggtccaacatcgaaatctcgttcgactccttggatgctgtgccgagcaagatgaaaaactattaatctatgagttcatgccaaacaagggtctagatgcatttctttttgatcctctcaaacgagagcaactggattggagaagacggttcaacatcattgatggaatttgtcgaggcctactataccttcaccgtgactccagactacggataattcatagagatcttaagacgagtaatatcctgttggatgaagagctcaatccaagaatttcagactttggaacggctagaatatttgggggaaaagaagatcaagcagatacactaagagttatgggaacctatggttacatggctccagaatatgcaatggaagggcggttttcggaaaaatcggatgtctttagctttggggtagtattgctggagattgtaagtggaagacagaacaatagcttcaatgaggaagatcagtccttgagcctgttaggattggcatggaaatattgggaggaagacaatgtacttgcgctagtggaccctaaaatttctgttggatgctccgagattgagatcataaggtgtataaatgtggggctgctttgtacacaagaacttgcaactgataggcctaccatttcaactgtcatttcaatgattagcaatgaaattgttggtcttcctcgtccgaacaaacctgcattcaccgagaggcaaacaactacagacacaggttcctccagacaaagtcagaaaaaatactctgccaacaatgtcactattaccgctcttgaaggcaga

SEQ ID NO: 890 - protein, 829 aa, Eucalyptus grandis
  Eucgr.D00793.1
MILLRKVRVFSLFILSHYAVKFCIGGDIITASEYIQDPGSIISSGGLYKLGFFSPNGTTNRYVGIWHNKIPALNVFWVANREKPVLDSSGVMTISNDGNLVILNGKKEVLWSSNVSTSGANAKAHLLDTGNLILQKQSSNMSTNDTTAWESFQTMCDTFIAKMKLSTNLRTNEKKVLTSWKSPSDPSIGSFSISLEPLNIPEVFLWNGTTLYWRSGPWNGKVFIGIPEMESVYLDGFTLVDDKEGYVYLTYNFAEVSYFSYFFVRSNGELLQPFWDEKYKKWRIDWSTQASDCDVYGKCGPFGYCDAKKSPICSCLRGYEPKKVEEWSRGNWSSGCIQKSLLQCARLKNGSTKAGKIDGFVKLENVKVPNYAIWSSPLEDKCQEQCLSNCSCAAYAYDAGVGCMYWSGDLIDVRKFSYAGTTLYVRVAHTELEGKRDLRAIIATAAVVATVIFSIGTFFAWQKSKKRGGKDGEQFSKASSENMLRGSLSKVNLQELVLYKLEELAAATSNFSDANKLGEGGFGAVYRGRLLNGKEIAVKRLSGASGQGLREFINEMEVISKVQHRNLVRLLGCCAEQDEKLLIYEFMPNKGLDAFLFDPLKREQLDWRRRFNIIDGICRGLLYLHRDSRLRIIHRDLKTSNILLDEELNPRISDFGTARIFGGKEDQADTLRVMGTYGYMAPEYAMEGRFSEKSDVFSFGVVLLEIVSGRQNNSFNEEDQSLSLLGLAWKYWEEDNVLALVDPKISVGCSEIEIIRCINVGLLCTQELATDRPTISTVISMISNEIVGLPRPNKPAFTERQTTTDTGSSRQSQKKYSANNVTITALEGR

SEQ ID NO: 891 - DNA, 2490 bp, Eucalyptus grandis
  Eucgr.D00784.1
atgctgaatgaatgcaagagtctaaaatttcggtggcgtgcaggcttgaatgctttttctagagttgacttcgtcaatggggatatcattacagcatctgagtacatccaagaccctggaagtatcatatcaagtggaggtctctacagactgggattctttagccccaatggtactaccaatcggtatgtcggaatttggcataacaagattcctgtgtttaacgtcttttgggtcgcaaacagggagaagcctgttctagattcttctggtgtcatgaccatatccgatgacggtaatcttgtgatattgaatggaaagaaggaagtactttggtcatcaaacgtttccacctctggagcaaatgcaaaagcccaattattagatgctggaaatcttatcttgcaaaaacaaagctctaatatgagcacagattatacaacggcatgggaaagtttccagaccacgtgtgatacgctcattgcgaaaatgaagcttagcaccaacttgagaacaaatgagaagcaggtactcacatcttggaaaagcccttctgacccatcgattggaagtttttcaattagtctcgaaccactaaatattcctgaagttttcctttggaacggcaccactctatattggcggagtggtccatggaatggtaaggttttcatcggaactcctgagatgttatcagtctatcttgatggatttagcttggtggatgataaagaaggatatgtctatctgagttacaattttgcagaggtgtcttatttgtcatacttttttttgaggtcaaatggggagttgttgcagccattctgggatgaaaaaaagaagcagtggcggatcgattggtcaacccgggcatctgactgtgatgtttatggcaagtgcggtccatttggattctgtgatgccaagaaatcaccaatttgcagctgcttgaggggctttgagccaaaaaaagttgaagaatggagcagagggaattggtccagcggatgcatccagaagtcattgctgcaatgcaataagttgaaaaatggtagtagtaaagcgggaaaaattgatggatttataaagcttgagaatgtgaaagtgccgaattatgcaatctggtcatctcctttggaagacaagtgccgagagcagtgcctcagtaattgttcgtgcgcagcatatgcttatgatgccggcgttggttgcatgtactggagcggagacctaatcgacgtacggaagttctcctatgcaggaacaactctttatgttcgagtggcccatacagaactcgaaggaaaaagagatctgagagcaattatagcgactgcagctgttgtggcaactgtaattttcagtattggtactttcttcgcctggcagaagtcgaaaaaacgaggtggtaaagacggacaccaattttcaaaggcttctagtgagaacgtgctcggagggagcttaagcaaagttaatctccaggagcttgtgctatataaattggaagagctggccacagcaacaagcaactttagtgatgcgaacaagctcggggagggtggttttggggcagtttatagggggagattgctaaatggaaaagaaatagcagtcaaaagactatcagaggcctctggacaaggattgcgggaatttatcaatgaaatggaagtgatttccaaggtccaacatcgtaatcttgttcgactccttggatgctgtgccgagcaagatgaaaaactattaatctatgagttcatgccaaacaagggtctagatgcatttctttttgatccgctcaaacgagagcaactggattggagaagacgattcaacatcattgatggaatttgtcgaggcctactataccttctccgtgactccagactacggataattcatagagatcttaagacaagtaatatcctgttggatgaagagctcaatccaagaatttcagactttggaacggctagaatatttgggggagaagaaaatcaaggagatacactaagagttgtgggaacctatggttacatggctccagaatatgcaatggaagggcggttctcggaaaaatcagatgtctttagctttggggtagtattgctggagattgtaagtggaagacagaacactagcttcaatgaggaagatcagtccttgagcctgttaggattggcatggaaatattgggaggaagacaatgtacttgcactagtggaccctaaaatttctgttggatgctccgagattgagatcataaggtgcataaatgtggggctactttgtacacaagaacttgcaaatgataggcctaccatttcaactgttatttcaatgattaacaatgaaattgttggtcttcctcgtccgaacaaacctgcattcaccgagaggcaaacaactaccgacacaggttcctccagacaatgtcagaaaaaatactctgccaacaatgtcactattaccgctcttgaaggcaga

SEQ ID NO: 892 - protein, 830 aa, Eucalyptus grandis
  Eucgr.D00784.1
MLNECKSLKFRWRAGLNAFSRVDFVNGDIITASEYIQDPGSIISSGGLYRLGFFSPNGTTNRYVGIWHNKIPVFNVFWVANREKPVLDSSGVMTISDDGNLVILNGKKEVLWSSNVSTSGANAKAQLLDAGNLILQKQSSNMSTDYTTAWESFQTTCDTLIAKMKLSTNLRTNEKQVLTSWKSPSDPSIGSFSISLEPLNIPEVFLWNGTTLYWRSGPWNGKVFIGTPEMLSVYLDGFSLVDDKEGYVYLSYNFAEVSYLSYFFLRSNGELLQPFWDEKKKQWRIDWSTRASDCDVYGKCGPFGFCDAKKSPICSCLRGFEPKKVEEWSRGNWSSGCIQKSLLQCNKLKNGSSKAGKIDGFIKLENVKVPNYAIWSSPLEDKCREQCLSNCSCAAYAYDAGVGCMYWSGDLIDVRKFSYAGTTLYVRVAHTELEGKRDLRAIIATAAVVATVIFSIGTFFAWQKSKKRGGKDGHQFSKASSENVLGGSLSKVNLQELVLYKLEELATATSNFSDANKLGEGGFGAVYRGRLLNGKEIAVKRLSEASGQGLREFINEMEVISKVQHRNLVRLLGCCAEQDEKLLIYEFMPNKGLDAFLFDPLKREQLDWRRRFNIIDGICRGLLYLLRDSRLRIIHRDLKTSNILLDEELNPRISDFGTARIFGGEENQGDTLRVVGTYGYMAPEYAMEGRFSEKSDVFSFGVVLLEIVSGRQNTSFNEEDQSLSLLGLAWKYWEEDNVLALVDPKISVGCSEIEIIRCINVGLLCTQELANDRPTISTVISMINNEIVGLPRPNKPAFTERQTTTDTGSSRQCQKKYSANNVTITALEGR

SEQ ID NO: 893 - DNA, 2448 bp, Eucalyptus grandis
  Eucgr.E00549.1
atgatacttccaggaaaagtaagaatattctctctctttattttctctcattatgctgtgaaattttgcgttggtggagatgtcattacggcatctgagtacatccaagaccctggaagtatcatatcaagtggaggtctctacagactcggattctttagccccaatggttctaccaatcggtatgtcggaatatggcatgacaagattcctgcatataacgtcttttgggttgcgaacagggagaagcctgttgcagattcttctggtgtcatgaccatatctgatgacggtaatcttgtgataatgaatggaaagaaggaagtactttggtcatccaacgtttccacctctggagctaatgcaaaagcccaattattagatagtggaaatcttatcttgctcaaacaaagttctaatacgagcacaaatgatacagcaatggtatgggaaagtttccagaacatgtctgatacactcatggcgaaaatgaagcttagcaccaatgtgagaacaaatgagaagcaggtactcacatcttggaaaagcccttctgatccatcaattggaagtttctcagttagttttgaaccactaaatattcctgaagttttcctttggaatggcagtactctttattggcggagtggtccatggaatggtaaggttttcattggaattccccagatggcatctgtctatcttgatggatttagcataggggatggcgaagaaggaactgtctatctgacttacaattttgcagaggtgtcttatttgtcctacttttttgtgaagtcaaatggggtattgttgcagccatactgggatttaaaatttaagtattggcgaatcgattggtcaaccccggattccgattgtgatgtttatggcaagtgtgggccgtttggattctgcgataccaagaaatcaccaatttgcagctgcttgagaggctttcagcctaaaagagtcgaagaatggagcagagggaattggtccagtggatgcatccagagatcattgctgcaatgtgacaggataaaaaatggcagtactaaagtgggaaaaatggatggatttctaaagcttgagaatgtgaaagtgccaaattatgcaatctggtcatcatctttggaagacaagtgccgagagcagtgcctcagtaattgctcgtgtgcagcatatgcttatgatgcgggagttggttgcatgtactggaggggagacctaatcgacatacggaagttttcctatggaggaacaactctttttgtccgactgccccgttcagaacttgaaggaaaacgagatctgagagcaattatagcggctgcagttgttgtggcaacagttattttcagtattggtactttcttcgcctggaagaagtcaaaaaaacgaagaggtaaagacggagaacaattttcagaggcttctactgagaacatgcttggaaagagcttgagcaaagtttatctccaggagcttgtgctatataaattggaagagctggccgcagcaacaagcaactttagtgacgcgaacaagctcggagagggtggttttggggcagtatatagggggagattgctaaatggaaaagaaatagcagtcaaaagactatccagggcctcgggacaaggattgcaggaatttatcaatgaaatggtcgtgatttctaaggtccaacatcgaaatctagttcgactccttggatgctgtgccgagcaagatgagaaactattaatctatgagttcatgccaaataagggtctagatacatttcttttcgatccgctcaaacgagagcaactggattggagaagacggttcaacattattgatggaatttgtcgagggctactgtaccttcaccgtgactctagactacggataattcatagagatcttaagacaaactttggaacagccaggatatttgggggaaaagaagatcaagcagacacactaagagttgtgggaacctatggttacatggctccggaatatgcgatggaagggcggttttcagaaaaatcagatgtttttagcttcggagtagtattgctggagattgtaagtggaagacagaacactagcttcaatgaggaagatcaatccttgagcctgttaggattggcatggaaatactgggaggaagacaatgtacttgcactagcggaccctaaaatttctgttggaccctttggggttgagatcacaaggtgcataaacgtggggctgctctgtacacaagaattcgcacaagacaggcctaccatttcaactgttatttcaatgattaacaatgaaattgttggtcttcctagtccaaacaaacctgcattcaccgagaggcaaacaaccaccgacacaggttcctccagacaaagccagaagaaatattctgccaaccatgtcactcttacctctctggaaggcaga

SEQ ID NO: 894 - protein, 816 aa, Eucalyptus grandis
  Eucgr.E00549.1
MILPGKVRIFSLFIFSHYAVKFCVGGDVITASEYIQDPGSIISSGGLYRLGFFSPNGSTNRYVGIWHDKIPAYNVFWVANREKPVADSSGVMTISDDGNLVIMNGKKEVLWSSNVSTSGANAKAQLLDSGNLILLKQSSNTSTNDTAMVWESFQNMSDTLMAKMKLSTNVRTNEKQVLTSWKSPSDPSIGSFSVSFEPLNIPEVFLWNGSTLYWRSGPWNGKVFIGIPQMASVYLDGFSIGDGEEGTVYLTYNFAEVSYLSYFFVKSNGVLLQPYWDLKFKYWRIDWSTPDSDCDVYGKCGPFGFCDTKKSPICSCLRGFQPKRVEEWSRGNWSSGCIQRSLLQCDRIKNGSTKVGKMDGFLKLENVKVPNYAIWSSSLEDKCREQCLSNCSCAAYAYDAGVGCMYWRGDLIDIRKFSYGGTTLFVRLPRSELEGKRDLRAIIAAAVVVATVIFSIGTFFAWKKSKKRRGKDGEQFSEASTENMLGKSLSKVYLQELVLYKLEELAAATSNFSDANKLGEGGFGAVYRGRLLNGKEIAVKRLSRASGQGLQEFINEMVVISKVQHRNLVRLLGCCAEQDEKLLIYEFMPNKGLDTFLFDPLKREQLDWRRRFNIIDGICRGLLYLHRDSRLRIIHRDLKTNFGTARIFGGKEDQADTLRVVGTYGYMAPEYAMEGRFSEKSDVFSFGVVLLEIVSGRQNTSFNEEDQSLSLLGLAWKYWEEDNVLALADPKISVGPFGVEITRCINVGLLCTQEFAQDRPTISTVISMINNEIVGLPSPNKPAFTERQTTTDTGSSRQSQKKYSANHVTLTSLEGR

SEQ ID NO: 895 - DNA, 2406 bp, Glycine max
  Glyma08g46670.1
atgggtttcagcagccgtgcaaacttgttctttgtattgcttatgttatgttgttgtgtgttggatgttggtattgccatagacaccatcacctcatctcagtccatcaaggaccctgaagttctaacttccaaagatggtaacttcactttggggttcttcacccctcaaaactccacaaaccgctatgttggaatttggtggaaatctcaatccacaatcatatgggttgctaacagaaaccaaccactgaatgattcttctggaattgttacaatccatgaagatggcaatcttgtattgcttaagggacagaaacaagtaatttggacaacaaatctgtccaactcgtcatccaatagaacttcccagttttcagattatggtaagcttgtcctcaccgaagccacaacgggaaacatcttgtgggatagttttcagcaaccttcaaatacattattgcccggcatgaaactttcaacaaataatagtacaggtaagaaagtagagcttacatcgtggaaaagcccttctaatccgtccgttgggagcttctcttctggtgtcgttcaaggcataaacatagttgaagtgttcatttggaatgaaactcaaccatattggcgcagtggtccatggaatggcaggctctttacggggatacagagcatggcaactttgtatcgtactggttttcaaggtggaaatgatggggaaggatatgcaaatatctactatacaataccaagttcatcagagtttttaatctatatgttgaatttgcaaggccaattattactaacagagtgggatgatgagaggaaagaaatggaagttacatggactagtcaagactcagattgtgatgtttatggtatatgtggatcgttcgcaatctgtaatgcacagagttctcccatatgtagttgcttgaaagggtttgaggctaggaacaaagaggaatggaatagacaaaactggactggtggatgtgttaggagaacacaattgcagtgtgaaagggtcaaagatcacaacacaagtacagatacaaaagaagatggatttttgaaactgcagatggttaaagttccatattttgcagaagggtcacctgttgagccagacatatgcagaagccaatgcttggagaattgctcttgtgttgcgtattctcacgatgatgggattggttgcatgtcttggactgggaatctacttgacatacaacaattctcagatgcaggacttgatctatatgagctgtcgtcattattacttgttcttgtgcatatgtcatgcggaggacttccaatcacccaggtaagacaccaccttcggtactttagtcctattattaaggttttagtaattgaagaactgacacaagttcaacaacaggagatgttcgtatttgatttcaaaagggttgcaacagccacaaacaacttccaccaatccaacaaacttggccagggtggtttcggtccagtgtataagggtaaactgcaagatggacaggaaatagcagttaaaagactttctagggcctctggacaaggtctagaagaattcatgaatgaagttgtggtgatttccaagcttcaacaccgcaatcttgtaagactttttggctcttgtattgaaggcgaagaaaagatgttgttatatgaatacatgccaaataaaagtttggatgtgtttatctttgatccatcaaaaagtaaactcctagattggaggaaacgcattagcataatagaaggaatagctcgaggattgctttatcttcacagagactccagactaagaatcatacacagagatttgaaggcaagtaatatcttgttagatgaagagctgaatccaaaaatatcagactttggtatggctagaatctttggagggactgaagatcaggccaatactctcagggttgtgggaacctatggctatatgtcccctgaatatgcaatgcaaggactgttttcagagaaatcagatgtctttagctttggtgttttggtactagagattgttagtggaagaagaaactcaagcttttatgacaatgagaattttcttagtcttttaggatttgcctggatacaatggaaggaaggcaacatattatctctagtagatccgggaacatatgatcctagttatcataaagaaattttaaggtgcatacacataggatttctatgtgtacaagaacttgctgtagagagacccacaatggctacagtaatttctatgcttaacagtgatgatgtgtttcttcctcctccaagtcaacctgcatttatcctgaggcaaaatatgttgaattcggtgtcatctgaggaaattcataattttgtctccatcaatactgttagtattacagatattcatggtaga

SEQ ID NO: 896 - protein, 802 aa, Glycine max
  Glyma08g46670.1
MGFSSRANLFFVLLMLCCCVLDVGIAIDTITSSQSIKDPEVLTSKDGNFTLGFFTPQNSTNRYVGIWWKSQSTIIWVANRNQPLNDSSGIVTIHEDGNLVLLKGQKQVIWTTNLSNSSSNRTSQFSDYGKLVLTEATTGNILWDSFQQPSNTLLPGMKLSTNNSTGKKVELTSWKSPSNPSVGSFSSGVVQGINIVEVFIWNETQPYWRSGPWNGRLFTGIQSMATLYRTGFQGGNDGEGYANIYYTIPSSSEFLIYMLNLQGQLLLTEWDDERKEMEVTWTSQDSDCDVYGICGSFAICNAQSSPICSCLKGFEARNKEEWNRQNWTGGCVRRTQLQCERVKDHNTSTDTKEDGFLKLQMVKVPYFAEGSPVEPDICRSQCLENCSCVAYSHDDGIGCMSWTGNLLDIQQFSDAGLDLYELSSLLLVLVHMSCGGLPITQVRHHLRYFSPIIKVLVIEELTQVQQQEMFVFDFKRVATATNNFHQSNKLGQGGFGPVYKGKLQDGQEIAVKRLSRASGQGLEEFMNEVVVISKLQHRNLVRLFGSCIEGEEKMLLYEYMPNKSLDVFIFDPSKSKLLDWRKRISIIEGIARGLLYLHRDSRLRIIHRDLKASNILLDEELNPKISDFGMARIFGGTEDQANTLRVVGTYGYMSPEYAMQGLFSEKSDVFSFGVLVLEIVSGRRNSSFYDNENFLSLLGFAWIQWKEGNILSLVDPGTYDPSYHKEILRCIHIGFLCVQELAVERPTMATVISMLNSDDVFLPPPSQPAFILRQNMLNSVSSEEIHNFVSINTVSITDIHGR

SEQ ID NO: 897 - DNA, 2430 bp, Glycine max
  Glyma08g46680.1
atgtgtttcagcagctgtgcaaacttgttctttgttctgttcatactgttttgttatgtgttggatgttgctattgccgtagacaccatcacatcatcacaacccgtcaaggaccctgaaacactaagatccaaagatggtaacttcactttggggttcttcagtcctcaaaactccaaaaaccgctatgttggaatttggtggaaatctcagtccacagtcgtatgggttgctaacagaaaccaaccactgaatgattcttctggaattattacaatctctgaagatggcaatcttgtggtgttgaatggacagaaacaagtggtttggtcatcaaatgtgtccaacacatcatccaatacaacttcccagttttcagattatggcaaacttgtacttaccgaaaccacaacgggaaacatcttatgggatagttttcagcaaccttcagatacattattgcccggcatgaaactttcaagcaacagtacaagtatgagagtaaaacttgcatcatggaaaagcccctctaatccctctgttgggagcttctcttcgggtgttgttgaacgcataaacatacttgaagtgttcgtttggaatgaaactcaaccatattggcgcagtggtccatggaacggtgggatatttacggggataccgagcatgtcaccatatcgtaatggtttcaaaggtggggatgatggggaagcaaatacggaaatctattacacagttccaagtgcattaacatttacaatctatatgttgaattcgcaaggccaatatgaagaaaagtggtggtatgatgagaagaaagaaatgcaacttgtgtggacaagtcaagaatcagattgtgatgtttatggcatgtgtggaccgttcaccagctgtaatgcacagagctcacccatatgtagctgtttgaaagggtttgagccaaggaacaaagaggaatggaatagacaaaactggactggtggatgtgttcggagaacacaattgcagtgtgaaagggtcaaagatcacaacacaagtagagatacaaaggaagatggatttttgaaactgcaaatggttaaagttccagattttccagaagggtcccctgttgagccagacatatgcagaagccaatgcttggagaattgctcttgtgttgcatatactcatgatgatgggattggttgcatgtcttggactgggaatctacttgacatacaacaattctcagaaggaggacttgatctatatattcgtgtagcccacaccgaacttggttttgttggtaaagtaggtaagcttactttatatatgtttctcactccaggcaggatatggaacttaattaaatcagcaaggaaagggaacaacagggcttttgtacgatttaacaatgatgaaacaccaaaccatccaagccacaaactgttactgttcaactttgaaagggttgcaacagctacaaacagcttcgacttgtccaacaaacttgggcagggtggttttggtccagtgtacaagggaaaactacaagatggacaggaaatagcagttaagagactttctagagcgtctggacaaggtctagaagaattcatgaatgaagttgtggtgatttccaagcttcaacaccgcaatcttgtaagactttttggctgctgtgctgaaggcgatgaaaagatgttgatatatgaatacatgccaaacaaaagtttggatgtgtttatctttgatcaatcaagaagtaaactccttgattggaggaagcgcagtagcataatagaaggaatagctcgagggttgctttatcttcacagagactccagactaagaattatacacagagatttgaaggcaagtaatatcttgctagatgaagagctgaatccaaaaatatcagactttggtatggctagaatctttggagggactgaagatcaggccaacactaataggattgttggaacctatggctatatgtcccctgaatatgcaatgcaaggattattttcagagaaatcagatgtctttagctttggtgttttggtactagagattgttagtggaagaagaaactcaagcttttacgacaacgtgcatgctcttagccttttgggatttgcctggatacaatggagagaaggcaatacgttatctttaatgatggatcaagaaatacacgatcctagtcatcatgaagatattttaaggtacatacacataggacttctttgtgtacaagaacatgctgtagacaggcccactatggctgcggtaatttctatgcttagcagtgagcttgcgcttcctcctccaagtcaacctgcattcatcctgcagcaaaatatgttaaatttggcgtcatctgaagaaactcttagatgttgctccatcaatattgttagtgtcacagatatccaaggtaga

SEQ ID NO: 898 - protein, 810 aa, Glycine max
  Glyma08g46680.1
MCFSSCANLFFVLFILFCYVLDVAIAVDTITSSQPVKDPETLRSKDGNFTLGFFSPQNSKNRYVGIWWKSQSTVVWVANRNQPLNDSSGIITISEDGNLVVLNGQKQVVWSSNVSNTSSNTTSQFSDYGKLVLTETTTGNILWDSFQQPSDTLLPGMKLSSNSTSMRVKLASWKSPSNPSVGSFSSGVVERINILEVFVWNETQPYWRSGPWNGGIFTGIPSMSPYRNGFKGGDDGEANTEIYYTVPSALTFTIYMLNSQGQYEEKWWYDEKKEMQLVWTSQESDCDVYGMCGPFTSCNAQSSPICSCLKGFEPRNKEEWNRQNWTGGCVRRTQLQCERVKDHNTSRDTKEDGFLKLQMVKVPDFPEGSPVEPDICRSQCLENCSCVAYTHDDGIGCMSWTGNLLDIQQFSEGGLDLYIRVAHTELGFVGKVGKLTLYMFLTPGRIWNLIKSARKGNNRAFVRFNNDETPNHPSHKLLLFNFERVATATNSFDLSNKLGQGGFGPVYKGKLQDGQEIAVKRLSRASGQGLEEFMNEVVVISKLQHRNLVRLFGCCAEGDEKMLIYEYMPNKSLDVFIFDQSRSKLLDWRKRSSIIEGIARGLLYLHRDSRLRIIHRDLKASNILLDEELNPKISDFGMARIFGGTEDQANTNRIVGTYGYMSPEYAMQGLFSEKSDVFSFGVLVLEIVSGRRNSSFYDNVHALSLLGFAWIQWREGNTLSLMMDQEIHDPSHHEDILRYIHIGLLCVQEHAVDRPTMAAVISMLSSELALPPPSQPAFILQQNMLNLASSEETLRCCSINIVSVTDIQGR

SEQ ID NO: 899 - DNA, 2499 bp, Glycine max
  Glyma13g32190.1
atggatttcacaagtctgatacttgctctggtcatagtttgctgtttttgtcagtgcttaagttctggcaacgataccattacaccaggccaattcatcagagatcctcacactctcacctcagctaatagtgccttcaagctaggattcttcagccctcaaaattcttcaaatcgctacctgggaatctggtatctctctgactccaatgtcatatgggtagctaacagaaaccagccactaaagaagagctcttccggaactgttcaaatttctgaggatggcaatctcgtggtattagatagcaacaaaagggctgtttggtcaacaaatttgacacataatattgcaaccaattcaactgccaaacttttagagactggaaatctagtcctcctagatgatgcatcggggcaaactacatgggagagtttccgacatccttgtcatgctctcgtgccaaagatgaagtttggtagtaaccaaaaaacaggtgagaaaatacgcataacatcatggagaagtgcttctgatccttctgttggatactattctactactcttgaacacccaaacactccagaaatgtttttctggttgaatgaaacgcgaccatatcatcggtctggtccgtggaatagccagatttttattggctcaactgagatgtcacctggttatctaagtggatggaatataatgaatgatgtagatgatgaaactgtttatctttcttatactctgccaaatcaatcttactttggaatcatgaccttgaatccacatggtcaaattgtatgctcctggtggttcaatgaaaagttagttaagaggatggtgatgcaaagaacttcctgcgatctttatggatattgtggggcatttggaagctgtagtatgcaggattctccaatatgcagctgtttgaatggatataagcccaaaaatgtggaggagtggaatagaaaaaattggactagtgggtgtgtaaggagtgagccactgcaatgtggggaacacacaaatggaagtaaagtcagcaaagatgggtttttgaggcttgagaatatcaaagtgccagattttgtacgaagattagattatttgaaagatgaatgcagagctcagtgtttggagagttgctcttgcgtggcctacgcatatgacagtggcattggatgcatggtttggagtggagacttgatcgacatacagaaattcgcaagtggaggggttgatctttacattcgtgtgccaccttcagaacttgaaaaacttgcagataaaagaaaacacaggaaatttataattccagttggagtaactataggaacgattactttggttggctgtgtttatctctcatggaaatggactactaaaccaacaggtatgtgtattacttttggtcggaatatgtatataaattctatagaaatatgttgctccccactgcaacgaaaagagaaggaagaggataaattaagagatcgtaatttgccactttttagttttgaagaacttgtaaatgctacaaacaattttcactcagccaacgaactaggcaagggaggttttggttcagtatataagggacaattgaaagatggacatgaaatagcagtaaaaagactttcaaaaacctctggacaagggttagaagaatgtatgaatgaggttttagttatatcaaagcttcaacatcgcaatcttgtcagacttcttggctgctgtattaaaaagaaggaaaatatgttggtatacgagtacatgcctaacaagagtttggatgtaatattatttgatccagtcaaaaagaaagatctagattggccaaaacgcttcaacattattgaaggaatctctcgaggtttgctttatctccacagagattctagactaaaaattatacacagagatttaaaggttagtaacatcttgttggatggagagctaaatccaaaaatatctgactttggtatggctagaatctttggaggcaatgatatacagaccaatactagaagggttgttggaacatttggttatatgcctccagaatatgcattccgaggactggtttctgagaaattagatgtctttagctttggagtcttgttgctagagattattagtgggagaaaaatcagtagctattacgatcatgaccaatcaatgagtctcttaggatttgcttggaaattatggaatgaaaaggacatccaatccgtgatagaccctgaaatatctaatccaaatcatgtgaatgacatcgagagatgcatacacatcggacttctttgtttgcaaaatcttgcaaccgaaaggccaattatggctacagtagtttcaatgctcaatagtgagattgtcaatcttcctcggccatcacatcctgcatttgtcgataggcaaattgtatcgtctgcggagtcatctcgacagaaccacagaacacagtccatcaacaatgttactgtcacagacatgcaaggtaga

SEQ ID NO: 900 - protein, 833 aa, Glycine max
  Glyma13g32190.1
MDFTSLILALVIVCCFCQCLSSGNDTITPGQFIRDPHTLTSANSAFKLGFFSPQNSSNRYLGIWYLSDSNVIWVANRNQPLKKSSSGTVQISEDGNLVVLDSNKRAVWSTNLTHNIATNSTAKLLETGNLVLLDDASGQTTWESFRHPCHALVPKMKFGSNQKTGEKIRITSWRSASDPSVGYYSTTLEHPNTPEMFFWLNETRPYHRSGPWNSQIFIGSTEMSPGYLSGWNIMNDVDDETVYLSYTLPNQSYFGIMTLNPHGQIVCSWWFNEKLVKRMVMQRTSCDLYGYCGAFGSCSMQDSPICSCLNGYKPKNVEEWNRKNWTSGCVRSEPLQCGEHTNGSKVSKDGFLRLENIKVPDFVRRLDYLKDECRAQCLESCSCVAYAYDSGIGCMVWSGDLIDIQKFASGGVDLYIRVPPSELEKLADKRKHRKFIIPVGVTIGTITLVGCVYLSWKWTTKPTGMCITFGRNMYINSIEICCSPLQRKEKEEDKLRDRNLPLFSFEELVNATNNFHSANELGKGGFGSVYKGQLKDGHEIAVKRLSKTSGQGLEECMNEVLVISKLQHRNLVRLLGCCIKKKENMLVYEYMPNKSLDVILFDPVKKKDLDWPKRFNIIEGISRGLLYLHRDSRLKIIHRDLKVSNILLDGELNPKISDFGMARIFGGNDIQTNTRRVVGTFGYMPPEYAFRGLVSEKLDVFSFGVLLLEIISGRKISSYYDHDQSMSLLGFAWKLWNEKDIQSVIDPEISNPNHVNDIERCIHIGLLCLQNLATERPIMATVVSMLNSEIVNLPRPSHPAFVDRQIVSSAESSRQNHRTQSINNVTVTDMQGR

SEQ ID NO: 901 - DNA, 2481 bp, Glycine max
  Glyma13g32220.1
atgggattcctaaatgctttgctcatagtatttcccatcattttcctgggtttgacctctgccacggacacccttacatcttctcaatccattagagactcagagacagtagtaacttcaaacgacagtgtcttcaaacttggtttcttcagccctcaaaattcaacacaccgctacgtaggaatctggtacctctctgactccaacgtcatatggatagctaacagaaacaaaccactcttagattcttctggggttttgaaaatctccaaagacggtaacctcgtgctagttgatggaaaaaaccatgttatttggtcgtcaaatgtgtcaaacactgcaacaatcacttccaccgctcaactttcacgttccgggaatctagtgctgaaagatgactccactggacagaccctatgggagagcttcaagcatccttgtgattcagcagtgccaaccatgaggatcagtgctaacagaatcacaggtgagaaaatacggtttgtgtcgaggaaaagcgcttctgatccttctactggctacttctctgcttcccttgaacgtttggatgctccagaagtgtttttgtggattaatggaactcgcccttattggaggactggtccatggaatggtagaatcttcattgggacaccactgatgtcaactgggtatttgtatggatggaatgtaggatatgaagggaatgaaactgtttatctaacttacagtttcgccgatccttcttcgtttggaatccttaccttgattccacaaggaaagcttaaattggtaaggtattataacagaaagcacacgttgactttggatttgggaatttctgattgtgatgtttatggcacgtgtggggcatttggaagctgtaatgggcagaattcaccaatatgcagctgtttgagtggatatgaaccaaggaatcaagaggagtggagtaggcaaaattggactagtgggtgtgtgagaaaggtgccactcaagtgtgagaggtttaaaaatgggagtgaagatgagcaagaagatcaatttttgaaacttgaaactatgaaagttccagacttcgcggagaggttggatgtcgaggaaggtcaatgtggaacgcagtgcttgcagaattgctcttgtttggcgtatgcatatgatgctggcattggatgcttgtattggactagagacttaattgacttacaaaaattccaaactgcaggagttgatctctacatccgtctcgcccgttcagaatttcaatccagtaatgcacaagagcatactaataagacaagaggcaagagattaatcattggaattacagtggcaactgctggaacaattatctttgccatctgtgcttatctagccattcgtagatttaactcgtggaagggaactgctaaagattcggaaaatcagagtcaaagggtgactgaggtccagaaaccagctaaactggatgagctaccgctatttgattttgaagtcgttgcaaatgccacagacaactttcacttagctaatacgcttggaaagggcggtttcggtccggtgtacaagggagtattgcaagatggacaagaagtagcagtgaaaagactttcaagaacatctagacaggggacagaagaatttatgaatgaagtgactgtaatttcaaaacttcaacaccgtaatctcgtaagactcctaggttgctgtattgaaggggaggaaaagatgttgatctttgagtacatgcccaataagagtttagatttttatctgtttggttacttcttcaagattacctcactgtctattgtttcttcagatccagtcaaaaaggtagttttagattggcaaaaacgatttaatataattgaaggaatctctagaggctcgctttatctccatagagattctagattaaggataatacacagagacctgaagccaagcaatatcttgttggatggagaattgaatccaaaaatatcagattttggtatggccaaaatctttggaggcagcgaagatgaggccaatactagaagggtggtgggaacatatggctacatgtcacctgaatatgcaatggaagggctgttttcagagaaatcagatgtctttagctttggagttttgctgttggaaataattagtggtagaaaaaactcaagatatgcatggaaactatggaatgaagaggagattgtatctctggttgatccagaaatatttagtcccgataatgtctatcacacattgagatgcatacacatcggacttctatgtgtacaagaattagcaaaggagaggcctactatggccactgtggtttcaatgcttaatagtgagattgtgaattttcctcctccacagcaacccgcgttcatacaaagacaaattgagttgagaggagagtcgtctcaacagagtcacaattcaaattccatcaataatgtcactgtcacaaatttgcaaggtaga

SEQ ID NO: 902 - protein, 827 aa, Glycine max
  Glyma13g32220.1
MGFLNALLIVFPIIFLGLTSATDTLTSSQSIRDSETVVTSNDSVFKLGFFSPQNSTHRYVGIWYLSDSNVIWIANRNKPLLDSSGVLKISKDGNLVLVDGKNHVIWSSNVSNTATITSTAQLSRSGNLVLKDDSTGQTLWESFKHPCDSAVPTMRISANRITGEKIRFVSRKSASDPSTGYFSASLERLDAPEVFLWINGTRPYWRTGPWNGRIFIGTPLMSTGYLYGWNVGYEGNETVYLTYSFADPSSFGILTLIPQGKLKLVRYYNRKHTLTLDLGISDCDVYGTCGAFGSCNGQNSPICSCLSGYEPRNQEEWSRQNWTSGCVRKVPLKCERFKNGSEDEQEDQFLKLETMKVPDFAERLDVEEGQCGTQCLQNCSCLAYAYDAGIGCLYWTRDLIDLQKFQTAGVDLYIRLARSEFQSSNAQEHTNKTRGKRLIIGITVATAGTIIFAICAYLAIRRFNSWKGTAKDSENQSQRVTEVQKPAKLDELPLFDFEVVANATDNFHLANTLGKGGFGPVYKGVLQDGQEVAVKRLSRTSRQGTEEFMNEVTVISKLQHRNLVRLLGCCIEGEEKMLIFEYMPNKSLDFYLFGYFFKITSLSIVSSDPVKKVVLDWQKRFNIIEGISRGSLYLHRDSRLRIIHRDLKPSNILLDGELNPKISDFGMAKIFGGSEDEANTRRVVGTYGYMSPEYAMEGLFSEKSDVFSFGVLLLEIISGRKNSRYAWKLWNEEEIVSLVDPEIFSPDNVYHTLRCIHIGLLCVQELAKERPTMATVVSMLNSEIVNFPPPQQPAFIQRQIELRGESSQQSHNSNSINNVTVTNLQGR

SEQ ID NO: 903 - DNA, 2493 bp, Populus trichocarpa
  POPTR_0004s02640.1
atggggtttgtctactgcaaatttgtagcaattcttcttcttctcttcgtgctccttttctgtttcgattttggggttgcggtagatatcattacatcatctcagtttatcaaagatcctgaagctatagtatctgctagaaacatcttcaaactgggatttttcagtcctgttaattccacaaatcgttatgttggaatatggtacaatgatatgcctacagtgactacagtatgggtagctaatagaaacgagccactcaatgattcatctggggtcctgaaaatattccaggatggaaatcttgtagttttgaatggtcagcaagagattctttggtcatcaaatgttttagctggagttaaagactcaagagcacagcttacagatgagggaaaccttgtcttgctcggtaaaaacaatggaaatgtcatatgggagagttttcagcagccttgtaatacactcttgccaaatatgagagttagtgctaatgcaagaactggcgagtcgacagtactaacatcatggataagcccttctgatccatccgtcggacgcttctctgtttccatggatcccttaagaattcccgaagtatttgtgtggaactataagagtccatattggcggagtggtccatggaatggtcagatctttattgggattcctgagatgaactctgtttatctggatggatttaatcttgcaaaaactgcagatggagccgtgtctctaagtttcacttatgtaaatcagcctaatagcaattttgttttgcgttctgatggaaaattgatagaaagagcctggaaagtggagaaccaggattggttcaatatctggaataggccagaaacagagtgtgacatttatggaaagtgtggagcatttggaagctgtaatgctgtgaattcaccaatctgcagctgtttgagagggtttgttccaaaaaatccagatgaatggaataaaggaaactggacaagtggttgccttaggaggacaccactagaatgcacagaaacacaaaatataagagaagtgaacccaaaagatgggttcttgaagcttgagatgatcaaagtaccagacttttcagagtggtcatctctgtattcagaactagaatgcagaaatgaatgcttaagtaattgttcctgtatagcttattcatattacaagggtattggttgcatgttgtggaccagaagcttaattgatatacagaagttttccgttggtggggcagatctttaccttcgcttagcatattcagaacttgatacaaagaaaagcgtgaagatagttatcagtataacagtgattttcggaactattgccttttcaatctgtgcatttctttcatggaggtggatggttaaacatggagaaaggaagaggaagagcaaggagatatcattatccaaaagcgaggagccatgtcggtcatcttcgtatggaaatatgattaggaacagtgggggcaaagttaaactccaggaactaccagctgtattcagtttacaggagttggaaaatgcaacgaatagctttgaaatatccaagaagcttggagagggaggttttggtccagtatacagggggaaattaccagatgggcaggaaatagctgtgaagagactttcaagagcatctcagcaagggcttgaagaatttatgaatgaggtttctgtgatatccaaactccaacaccgaaatcttgtgaaactcctagcttactgcgttgaaggtgaagaaaagatgttggtctacgagtacatgccaaataaaagcttggatgcatttctgtttgatccagccaagcaagaacttctagactggaagaagcgcttcaatattatcgaaggagtttgtcgaggtctcctgtatcttcacagagattctagactaagaattattcatagagatctgaaggcgagtaatattctgctggatcaagaacttaatgctaaaatatcagacttcggaatggccaggacttttggaggcagtgaagatcaagccgatacgacaagggttgttggaacctatggctatatggcccctgaatatgcaatggaagggcgtttttcagagaaatccgatgtctatagctttggagttttgctgttagagataataagtggtagaagaaacagtagtttttacgacaatgagaaggatttgagtttcttgggatttgcatggaaattgtggactgaaggcaagctttcagctctagcagatcgagtactatctgatccatgttttcaagatgaaatttatagaagcatacatgtaggtcttttgtgtgttcaagagtttgcaagagataggccagctgtgcctacaatcatttcaatgcttcatagcgaaattgtggatcttcctgctcccaagaaacctgcacttggtttcgatatggactcccttcaacggagccaaacgatatgttctaatgacataacaattactgttattggagggcga

SEQ ID NO: 904 - protein, 831 aa, Populus trichocarpa
  POPTR_0004s02640.1
MGFVYCKFVAILLLLFVLLFCFDFGVAVDIITSSQFIKDPEAIVSARNIFKLGFFSPVNSTNRYVGIWYNDMPTVTTVWVANRNEPLNDSSGVLKIFQDGNLVVLNGQQEILWSSNVLAGVKDSRAQLTDEGNLVLLGKNNGNVIWESFQQPCNTLLPNMRVSANARTGESTVLTSWISPSDPSVGRFSVSMDPLRIPEVFVWNYKSPYWRSGPWNGQIFIGIPEMNSVYLDGFNLAKTADGAVSLSFTYVNQPNSNFVLRSDGKLIERAWKVENQDWFNIWNRPETECDIYGKCGAFGSCNAVNSPICSCLRGFVPKNPDEWNKGNWTSGCLRRTPLECTETQNIREVNPKDGFLKLEMIKVPDFSEWSSLYSELECRNECLSNCSCIAYSYYKGIGCMLWTRSLIDIQKFSVGGADLYLRLAYSELDTKKSVKIVISITVIFGTIAFSICAFLSWRWMVKHGERKRKSKEISLSKSEEPCRSSSYGNMIRNSGGKVKLQELPAVFSLQELENATNSFEISKKLGEGGFGPVYRGKLPDGQEIAVKRLSRASQQGLEEFMNEVSVISKLQHRNLVKLLAYCVEGEEKMLVYEYMPNKSLDAFLFDPAKQELLDWKKRFNIIEGVCRGLLYLHRDSRLRIIHRDLKASNILLDQELNAKISDFGMARTFGGSEDQADTTRVVGTYGYMAPEYAMEGRFSEKSDVYSFGVLLLEIISGRRNSSFYDNEKDLSFLGFAWKLWTEGKLSALADRVLSDPCFQDEIYRSIHVGLLCVQEFARDRPAVPTIISMLHSEIVDLPAPKKPALGFDMDSLQRSQTICSNDITITVIGGR

SEQ ID NO: 905 - DNA, 2463 bp, Populus trichocarpa
  POPTR_0006s22670.1
atgggacttggcaactgcgaacttgcagtggctcttcttctgtttctctcattttcctgttcattttatggtgatgcaggagataccataactacttctcaacccatcaaagatccggaagctatagagtctgccggaaaaatgtttcaactgggatttttcagcccagttaattcaacatatcgatatgtcggaatatggtatagtaatatatcagcatcaactccagtactatgggtggccaacagaaacaagccaatcaacgattcttctgggatgatgacaatatctgaagatggaaatcttgtggttttgaatggtcagcgagaggttctgtggtcatcaaatgtttcaattgggttcaatcagtcaactgcacagcttactgatgatggaaaccttgtcttgaaagctggaccgaatggaaaccttgaatggcaaagtttccagcagcctacggatacttacttaccaaagatgagacttagtgctaacgcaagaacggggaacaagacactgctaatgtcatggagaagctcatctgatccttcagttggaaacttctctgctggtgtcaatccattaggaattcctgagttcttcatctggtacaatggtcatccattttggcgtagtggtccatggggtggccagaactttactggaaaaccaggaatgtctacttctgtgtatctaagtggatttactccacaagatgaaggagatggcactttcactctgagttcaattcaagacccagctttccgattaacgtatgttttgacttctcatggaaaacttacagagcaatactgggattatgggaagggaggttggaagtatgactgggaagctccatccattgagtgtgatatttatggcaagtgcgggtcatttggaagctgcgatgaacataattcacctatctgcagatgcttaaaagggtttgttccaaaaaatcaagatgaatggaagaaaggaatttggactagcggttgtgttaggatgacatcgttgcagtgtgatagaataaagaatggtagtgaagtgggtaaagaagatggatttatgaagctagagatgatgaaggtgccaacctttgccgagtactggtcatatccgtcctccgaacaagaatgcaaagatgagtgcttgaggaattgttcctgtgtcggttattcatattataatggttttggctgcatggcatggacaggaaacttgattgatatacaaaagttctctgaaggagggacagatctcaacattcgcctggcgtatacagaacttgttgcagataacaagagaaacatgaaagtaatcatcagtatgtcagtgattgtaggagccattcttactggacttctaaactttacaatttttacaattaaagaaaaacacaattcacaaataataacgatatttccacttgaattcagaaaggaagttgacaaggaagttaaactggaaccactcttcaaattacaaattcttgaaactgctacaaacaactttgacatatcgaagaagcttgggcagggcggctttggtgcagtatacaggggaaaattaccagatgggcaggaaatagctgtcaaaagactttctaaaacatctggtcaaggtctcgaagagtttatgaatgaagttgcggtgatttctaaactccaacataggaatcttgtgagacttcttggttgctgtgttgaaggagaagagatgatgttggtttatgagtacatgccgaataaaagcttggatgcctttctctttgattcactcaggaaaggacagctagattgggaaagacgcttcgacattattaacgggatttgtcgaggtcttctttaccttcacagagattctagactaagaattattcatagagatctgaagccaagtaacatcttattggaccacgagctgaatccaaaaatttcagacttcggattagccaggatttctggcggcaatgaagtgaatactaccagggttgttggaacctttggctttatgtcccctgaatatttaatggaaggaagattttcagagaaatcagatgtatttagctttggagtgttgttgctggagattgtgagcggaagaaagaacgctcatttttatagcaatgagcatgctttgagtcttataggatttgcttggaaactgtggaatgaaggtgacattgcagctttggttgatcctgcaatatcagatccatgtgttgaggtggagatattccgatgcatacatattggtctgttgtgtgtgcaggaattggcgaaagacagaccggccgtgtcaactatcatttccatgctaaatagtgaaattgtggatcttcctactccaaagaaaccagcatttgttgaaaggcagacttcattgggtacagaggccactactcagagccaaaagataaattccattaacaatgtgacaatttctgatcttaaaagccga

SEQ ID NO: 906 - protein, 821 aa, Populus trichocarpa
  POPTR_0006s22670.1
MGLGNCELAVALLLFLSFSCSFYGDAGDTITTSQPIKDPEAIESAGKMFQLGFFSPVNSTYRYVGIWYSNISASTPVLWVANRNKPINDSSGMMTISEDGNLVVLNGQREVLWSSNVSIGFNQSTAQLTDDGNLVLKAGPNGNLEWQSFQQPTDTYLPKMRLSANARTGNKTLLMSWRSSSDPSVGNFSAGVNPLGIPEFFIWYNGHPFWRSGPWGGQNFTGKPGMSTSVYLSGFTPQDEGDGTFTLSSIQDPAFRLTYVLTSHGKLTEQYWDYGKGGWKYDWEAPSIECDIYGKCGSFGSCDEHNSPICRCLKGFVPKNQDEWKKGIWTSGCVRMTSLQCDRIKNGSEVGKEDGFMKLEMMKVPTFAEYWSYPSSEQECKDECLRNCSCVGYSYYNGFGCMAWTGNLIDIQKFSEGGTDLNIRLAYTELVADNKRNMKVIISMSVIVGAILTGLLNFTIFTIKEKHNSQIITIFPLEFRKEVDKEVKLEPLFKLQILETATNNFDISKKLGQGGFGAVYRGKLPDGQEIAVKRLSKTSGQGLEEFMNEVAVISKLQHRNLVRLLGCCVEGEEMMLVYEYMPNKSLDAFLFDSLRKGQLDWERRFDIINGICRGLLYLHRDSRLRIIHRDLKPSNILLDHELNPKISDFGLARISGGNEVNTTRVVGTFGFMSPEYLMEGRFSEKSDVFSFGVLLLEIVSGRKNAHFYSNEHALSLIGFAWKLWNEGDIAALVDPAISDPCVEVEIFRCIHIGLLCVQELAKDRPAVSTIISMLNSEIVDLPTPKKPAFVERQTSLGTEATTQSQKINSINNVTISDLKSR

SEQ ID NO: 907 - DNA, 2394 bp, Populus trichocarpa
  POPTR_0011s03850.1
atgggacttggcaactgcgaagttgcagtagctcttcttctgtttctatcatattcctcttcagtttatggtgatgcaggagataccataactacttctcaacccatcaaagatccagaagctatagtctctgccggcaataaattcgaactgggatttttcagcccagttaattcaacatatcgatatgtcggaatatggtatagtaatatatcagaagcaactccagtactatgggtggccaacagaaacaagccaatcaacgattcttcagggatgatgacaatatctgaagatggaaatctcgtggttttgaatggtcagggagagtttctgtggtcatcaaatgtttcaattgggttcaataagtcaactgcacagcttactgatgatggaaaccttgtcttgaaagctggaccgaatggaaaccttgtatggcaaagtttccagcagcctacggatacttacttaataaagatgagacttagtgctaacgcaagaacagggaacaagacactgctaatgtcatggagaagctcatctgatccttcagttggaaacttctctgctggtatcaatccattaggaattcctgagttcttcatgtggtacaatggtcatccattttggcgtagtggtccatggtgtggtcagacttttattggaataccaggaatgtatacttctgtgtatctaaggggatttactctacaagatgaaggagatggcactttcactctgagttcaattcaagacccagcttaccgtttaacacatgttttgacttctcatggaaaatttatagaacaatactgggattatgggaagcaaggttgggagaataacttggaagttccatcaactgagtgtgatatttatggcaagtgcgggccatttggaagctgcgatgcacagaattcacctatctgcagatgtttagaagggttcgttgcaaaaaatcaagatgaatggaataaaggaatttggactagcggatgtgttaggatgacatcgttgcagtgtgatagaatacagaatggtagtgaagtgggaaaagaagatggctttatgaagctagagatgaggaaggtgccaacctttgccgagtactggtcaaatgcgtcctcgtccggacaacaatgcgaagatgagtgcttgaggaattgttcctgtgtcgcttattcatattataatggttttggttgtatggcttggacaggaaacttgattgatatacaaaagttctctgaaggaggaacagatctcaacattcgcctggcgtatacagaacttgaaaggaagttgataagtgagaagatcatatcgttcaaaacgagagaagcacaagaaacagtttttgatggaaacttgcccgaaaacgtcagggaagttaaacttgaacctctcttcaaattacaaattcttgaaactgctacaaacaactttgacatatcgaagaagcttgggcagggcggctttggtgcagtatacaggggaaaattaccagatgggcaggaaatagctgtcaaaagactttctaaaacatctggtcaaggggtcgaagagtttatgaatgaagttgcggtgatttctagactccaacataggaatcttgtgagacttcttggttgctgtgttgaaggagaagagatgatgttggtttatgagtacatgccgaataaaagcttggatgcatttctctttgattcactcaggaaaggacaactagattggaaaagacgcttcaacattattaatggaatttgtcgaggtcttctataccttcacagagattctagactaagaattattcatagagatctgaagccaagtaacatcttattggaccacgagctgaatccaaaaatttcagactttggaatagccaggatttctggcggcaatgaagtgaatactaccagggttgttggaacctttggctatatgtcccctgaatatttaatggaaggaagaatttcagagaaatcagatgtgtttagctttggagtgttgttgctggagatcgtgagcggaagaaggaacgctcatttttatagcaatgagcatgctttgagtcttataggatttgcttggaaactgtggaatgatggtgacattgcagctttggtcgatcctgcaatatcagatccatgtgttgaggtggagatattccgatgcatacatattggtctgttgtgtgtgcaggaattggcaaaagatagaccggccgtgtcaactatcatttccatgctaaatagtgaaattgtggatcttcctactccaaagaaaccagcatttgttgaaaggcagacttccttgggtacagaggccactactcagagccaaaagataaattccattaacaatgtgacaatttctgatcttaaaggccga

SEQ ID NO: 908 - protein, 798 aa, Populus trichocarpa
  POPTR_0011s03850.1
MGLGNCEVAVALLLFLSYSSSVYGDAGDTITTSQPIKDPEAIVSAGNKFELGFFSPVNSTYRYVGIWYSNISEATPVLWVANRNKPINDSSGMMTISEDGNLVVLNGQGEFLWSSNVSIGFNKSTAQLTDDGNLVLKAGPNGNLVWQSFQQPTDTYLIKMRLSANARTGNKTLLMSWRSSSDPSVGNFSAGINPLGIPEFFMWYNGHPFWRSGPWCGQTFIGIPGMYTSVYLRGFTLQDEGDGTFTLSSIQDPAYRLTHVLTSHGKFIEQYWDYGKQGWENNLEVPSTECDIYGKCGPFGSCDAQNSPICRCLEGFVAKNQDEWNKGIWTSGCVRMTSLQCDRIQNGSEVGKEDGFMKLEMRKVPTFAEYWSNASSSGQQCEDECLRNCSCVAYSYYNGFGCMAWTGNLIDIQKFSEGGTDLNIRLAYTELERKLISEKIISFKTREAQETVFDGNLPENVREVKLEPLFKLQILETATNNFDISKKLGQGGFGAVYRGKLPDGQEIAVKRLSKTSGQGVEEFMNEVAVISRLQHRNLVRLLGCCVEGEEMMLVYEYMPNKSLDAFLFDSLRKGQLDWKRRFNIINGICRGLLYLHRDSRLRIIHRDLKPSNILLDHELNPKISDFGIARISGGNEVNTTRVVGTFGYMSPEYLMEGRISEKSDVFSFGVLLLEIVSGRRNAHFYSNEHALSLIGFAWKLWNDGDIAALVDPAISDPCVEVEIFRCIHIGLLCVQELAKDRPAVSTIISMLNSEIVDLPTPKKPAFVERQTSLGTEATTQSQKINSINNVTISDLKGR

SEQ ID NO: 909 - DNA, 2277 bp, Populus trichocarpa
  POPTR_0011s03810.1
atgggacttggcaactgcgaagttgcagtagctcttcttctgtttctatcatgttcctcttcagtttatggtgacgcaggagataccattactccttctcaacccatcaaagatccagaagctatagtctctgccggcaaaaagttcgaacttggatttttcagcccagttaattcaacatatcgatatgttggactatggtatagtaatatatcagcggaaactcaagtactatgggtggccaacagaaacaacccaatcaacgattcttctgggatgatgacaatatctgaagatggaaatcttgtggttttgaatggtcagggagaggttctgtggtcatcaaatgtttcaaatgggttctatcagtcaactgcacagcttactgatgatggaaaccttgtcttgaaagctggactgaatggaaaccttgtatggcaaagtttccagcagcctacggatacttacataccaaagatgagacttagttctaacgcaagaactgggaaaaagacactattaatgtcatggagaagctcatctgatccttcagttggaaatttctctgctggtctcaatccactaggaattcctgagttcttcatctggtacaatggtcatccattttggcgtagtggtccatggggtggtcagaattttattggaataccaggaatgtacacttctgtgtatttagaaggatttagtgtacaagaagcagatgacactttcactcttagtttaattcgagacccagttttccgtgcaacgtatgttttgacttctcatggaaaatttatagaacaatactgggattatgggaagcaaggttgggagtatacctgggaagctccatcaactgagtgtgatatttatggcaagtgcgggccatttggaagctgcggtgcacagaattcaccaatctgcacatgtttaaaagggtttgttgcaaaaaataaagatgaatggaacaaaggaatttggactagcggatgtgttaggatgacatcgttgcagtgtgatggaatacaaaatggtagtgaagtgggaaaagaagatgggtttatgaagctagagatgatgaaggtgccaacctttgccgagtactggtcaaatccgtcctccgaacaagaatgcaaagatgagtgcttgatgaattgttcttgtgtcgcttattcatattataatggttttggctgtatggcatggacaggaaacttgattgatatacaaaagttctctgaaggagggacagatctcaacattcgcctggcgtatacagaacttgtcttcaaattacaaattcttgaaactgctacaaacaactttgacatatccatgaagcttgggcagggcggctttggtgcagtatacaggggaaaattgccagatggacaggaaatagctgtgaaaagactctctagaacatctggtcaagggcttgaagagctcatgaatgaagttgtggtgatttcaaaactccaacacaggaatcttgtgagacttcttggttgctgtgttgaaggagaagagatgatgttggtttatgagtacatgccgaataaaagcttggatgcatttctctttgattcactcaggaaaggacaactagattggaaaagacgcttccacattattaatggaatttgtcgaggtcttctttaccttcacagagattctagactaagaattattcatagagatctgaagccaagtaacatcttattggaccacgagctgaatccaaaaatttcagactttggaatagccaggatttctggcggtaatgaagtcaatactaccagggttgttggaacatttggctttatgtcccctgaatatttaatggaaggaagattttcagagaaatcagatgtgttcagctttggagtggtgttgctggagatcgtgagcggaagaaggaacgctcatttttatagcaatgagaatgctttgagtcttataggatttgcttggaaactgtggaatgaaggtgacattgcagctttggtcgatcctgcaatatcagatccatgttttcaggtggagatattccgatgcatacatattggtctgttgtgtgtgcaagaattggcaaaagatagaccggccgtgtcaactatcatttccatgctaaatagtgaaattgtggatcttcctactccaaagaaaccagcatttgttgaaaggcagagttccttggatacagagtccattactcagagccataagataaattccattaacaatgtgacgatttctgatcttaaaggccga

SEQ ID NO: 910 - protein, 759 aa, Populus trichocarpa
  POPTR_0011s03810.1
MGLGNCEVAVALLLFLSCSSSVYGDAGDTITPSQPIKDPEAIVSAGKKFELGFFSPVNSTYRYVGLWYSNISAETQVLWVANRNNPINDSSGMMTISEDGNLVVLNGQGEVLWSSNVSNGFYQSTAQLTDDGNLVLKAGLNGNLVWQSFQQPTDTYIPKMRLSSNARTGKKTLLMSWRSSSDPSVGNFSAGLNPLGIPEFFIWYNGHPFWRSGPWGGQNFIGIPGMYTSVYLEGFSVQEADDTFTLSLIRDPVFRATYVLTSHGKFIEQYWDYGKQGWEYTWEAPSTECDIYGKCGPFGSCGAQNSPICTCLKGFVAKNKDEWNKGIWTSGCVRMTSLQCDGIQNGSEVGKEDGFMKLEMMKVPTFAEYWSNPSSEQECKDECLMNCSCVAYSYYNGFGCMAWTGNLIDIQKFSEGGTDLNIRLAYTELVFKLQILETATNNFDISMKLGQGGFGAVYRGKLPDGQEIAVKRLSRTSGQGLEELMNEVVVISKLQHRNLVRLLGCCVEGEEMMLVYEYMPNKSLDAFLFDSLRKGQLDWKRRFHIINGICRGLLYLHRDSRLRIIHRDLKPSNILLDHELNPKISDFGIARISGGNEVNTTRVVGTFGFMSPEYLMEGRFSEKSDVFSFGVVLLEIVSGRRNAHFYSNENALSLIGFAWKLWNEGDIAALVDPAISDPCFQVEIFRCIHIGLLCVQELAKDRPAVSTIISMLNSEIVDLPTPKKPAFVERQSSLDTESITQSHKINSINNVTISDLKGR

SEQ ID NO: 911 - DNA, 2457 bp, Populus trichocarpa
  POPTR_0011s03880.1
atggcacttggaaactgcaaagttgcagtagctcttcttctgtttctatcatgttctagttcattttatggtgatgcaagagatatcattactccttctcaacccatcaaagatcaagaagctatagtctctgccggcaataagttcgaactgggatttttcagcccagttaattcaacatatcgatatgtcggaatatggtacagtaatatatcagcagaaactcaagtactatgggtcgctaacagaaacaagccaatcaccgattcttctgggatgatgaaaatatctgaagatggaaatcttgtggttttgaatggtcagggagagcttactgatgatggaaaccttgtcatgaaagctggaccgaatggaaaccttgtatggcaaactttccagcagcctacggatacttacttaccaaagatgagacttagtgctaacgcaagaactgggaacaagacactgctaatgtcatggagaagctcatctgatccttcagttggaaacttctctgctggtgtcaatccattaggaattcctgagctcttcatctggtacaatggtcatccattttggcgtagtggtccatgggttggacagaactttataggaataccaggaatgtctatttctgtgtatctaagtggatttactctacaagatgaaggagatggcactttcactatgagtttaattgtagacccagcttcccgattcaagtatgttttgacttctcatggaaaatttaaagaacaatactgggattatgggaagcaaggttgggagtatacctgggaagctccatcaactgactgtgatatttatggcaagtgcgggtcatttggaagctgcgatgcacagaattcacctatctgcacatgtttaaaagggtttgttgcaaaaaatcaagatgaatggaacaaaggaatttggactagcggttgtgttaggatgacatcgttgcagtgtgatagaatacagaatggtagtgaagtgggaaaggaagatgggtttaagaagctggagatgatgaaggtgccagcctctgccgagtactggtcatatgcgtcctcgtccgaacaagaatgcaaagatgagtgcttgaggaattgttcctgtgttgcttgttcatattataatggttttggctgcatggcatggacaggaaacttgattgatatacaaaagttctctgaaggaggaacggatctcaacattcgcctggcgtctacagaacttgataacaagagaaacatgaaagtaataatcagtatggcagtgattgtaggagccatagctatctgcatctgtgtgtttctttcttggaagtggatggctacacatagagaaaggaagttgataagtgaggagaccttatcgttcaaaacgagagaagcacaagaaacagtttttgatggaaactcgcccgaaaacgtcaaggaagttaaacttgaaccactcttcaaattaaaaattcttgaaactgcaacgaacaactttgacatatccaagaagcttgggcagggcggctttggtgcagtatacaggggaaaattgccagatgggctggaaatagctgtcaaaagactctctagaacatctggtcaagggcttgaagagctcatgaatgaagttgtggtgatttcaaaactccaacacaggaatcttgtgagacttcttggttgctgtgttgaaggagaagagatgatgttggtttatgagtacctgccgaataaaagcttggatgcatttctctttgattcactcaggaaaggacaactagattgggaaagacgcttcgacattattaacgggatttgtcgaggtcttctttaccttcacagagattctagactaagaattattcatagagatctgaagccaagtaacatcttattggaccatgagctgaatcccaaaatttcagactttggaatggccaggattttttgtggcaatgaagatcaagtgaatactaccagggtcgttggaacctatggctatatgtcccctgaatatttaatgaaaggaagattttcagagaaatcagatgtatttagctttggagtgttgttgctggagattgtaagcggaagaaggaactctaacttttatgacaatgagcattctctgagtcttataggatatgcctttaaattgtggaaggaacgtgacattacagctttagtcgatcctgcaatatcagatccatgttttgaggtggagatattccgatgcatacatattggtctgttgtgtgtgcaagaattggcgaaagacagaccggccgtgtctaccatcacttccatgctaaatagtgaaattgtggatcttcctcctccaaagaaaccagcattttttgaaaggcagagttccttggatacagagtccattacacagaaccagaagataaattccattaacaatgtgacgatttctgatgttaacggccga

SEQ ID NO: 912 - protein, 819 aa, Populus trichocarpa
  POPTR_0011s03880.1
MALGNCKVAVALLLFLSCSSSFYGDARDIITPSQPIKDQEAIVSAGNKFELGFFSPVNSTYRYVGIWYSNISAETQVLWVANRNKPITDSSGMMKISEDGNLVVLNGQGELTDDGNLVMKAGPNGNLVWQTFQQPTDTYLPKMRLSANARTGNKTLLMSWRSSSDPSVGNFSAGVNPLGIPELFIWYNGHPFWRSGPWVGQNFIGIPGMSISVYLSGFTLQDEGDGTFTMSLIVDPASRFKYVLTSHGKFKEQYWDYGKQGWEYTWEAPSTDCDIYGKCGSFGSCDAQNSPICTCLKGFVAKNQDEWNKGIWTSGCVRMTSLQCDRIQNGSEVGKEDGFKKLEMMKVPASAEYWSYASSSEQECKDECLRNCSCVACSYYNGFGCMAWTGNLIDIQKFSEGGTDLNIRLASTELDNKRNMKVIISMAVIVGAIAICICVFLSWKWMATHRERKLISEETLSFKTREAQETVFDGNSPENVKEVKLEPLFKLKILETATNNFDISKKLGQGGFGAVYRGKLPDGLEIAVKRLSRTSGQGLEELMNEVVVISKLQHRNLVRLLGCCVEGEEMMLVYEYLPNKSLDAFLFDSLRKGQLDWERRFDIINGICRGLLYLHRDSRLRIIHRDLKPSNILLDHELNPKISDFGMARIFCGNEDQVNTTRVVGTYGYMSPEYLMKGRFSEKSDVFSFGVLLLEIVSGRRNSNFYDNEHSLSLIGYAFKLWKERDITALVDPAISDPCFEVEIFRCIHIGLLCVQELAKDRPAVSTITSMLNSEIVDLPPPKKPAFFERQSSLDTESITQNQKINSINNVTISDVNGR

SEQ ID NO: 913 - DNA, 2472 bp, Populus trichocarpa
  POPTR_0011s03900.1
atggcagctcttcgtctcttactatgttgtttctgttggcaacttggtgctgccgtagataccataacatcatctcaatacatcaaagatcctgaagctgtagtttctgctggaaataagttcaaactgggattttttagccctggtaattcaacaaaccggtatgtaggaatatggtacagcaatatatctgttacaactccagtctggatagctaacagaaacaagccactcaatgattcttctgggattatgacaatatctgaagatggaaatattgtagttttggacggtcggaaagagattctttggtcgtcaaatgtttcaaatggggtcagtaactcaagtgcacagcttacggatgatggaaacgtaatcctgcgagggggcgaaattggaaacagcttatggcagagtttccaggaaccatctgatactttcatgctgaagatgagacttactgctaatagaagaacgggtaagaagacgcaaataacatcatggaaaagcccttctgatccatctgttggaagtttttcttctggtattgaaccctcaagcattcctgaggttttcgtttggaatgatagccgtccattctggcggagtggtccatggaatggtcaagcctttataggaattccagaaatgaattcagtttatcttaatgggtataatcttgtacaagatggagatggaactttttcactaagcgttgggctggccaatgaatcttatatcaccaattttgctttgagttatgaaggaagatttggagaaatgtattgggattctgccaatgagaggtgggaacataagaagcaatatccaggagatgattgtgatatttatggaaaatgtgggccttttggattctgtaatacacagaattcactaatttgcaggtgcttgaaagggtttgaaccaaaaaattctgacgagtggaatagaagaaattggacaaatggttgtgtcaggaggagggaattgaaatgcgaaagaacacaaagtgatggtcaagtgcccaaagaagatgagtttttgaaactggataaggtgaaagtgccagacttttctgagtggtcatcttcagcatccgaacaaaattgtaaggatgagtgcttgaataattgctcatgtatagcttactcatatcatactggtattggttgtatgctatggaggggaaagttaactgatataaggaagttttccagtggaggggctaatctttatgtccgccttgcagatttggaattcggaaaaaacagagatatgaaagcagttatcagtataactgtggttacaggagcaattattgttgcagttggtgcttttttttggtggaggaggatggctaaatatagagaaaggaagagggaaagcgagcgaatcttatcatcgagaaggaagaaaggatatccaatattcttcaatggaaacttgatccaagagagcatgaaccaagttaaatttcaagaactaccactattcaaattacaaatgctgatagctgcaacagactactttgatgctgccaacaagcttggggagggtggttttgggccagtgtacaggggaaatctgccagatgggcaagaaatagcggtgaaaagactgtcaagagcatctgggcaagggcaagaagaatttatgaacgaggttgtggtgatttctgaactccaacacaagaatcttgtgagacttcttggttgctgtgttgaaggagatgaaaagatgctggtctatgaatacatgccaaataaaagcttggatgcatctctctttgatccagttagaaaagaagttctagactggaaaaaacgcttcaacattgtcgatggaatttgtcgaggtctcctttaccttcacagagattccagactaagaattattcatagagatctgaagccaagtaacatcttgttggaccaagaactaaatccaaaaatttcagactttgggatggctaggatatttggaggcaatgaagatcatgttaaaacgagaagggttgtaggaacctatggctatatgtcccctgaatacgcaatgcatgggagattttcagagaaatcagatgttttcagctttggagtcttgctgttagagattgtgagtggaagaagaagtactaaaattgatggcaatgaacagggtttgaaccttttggaatttgcatggaaactgtggaatgaagggaacgctccagctctagtcgatcctgcattaacattagatcaatattccaaggtggaaatttttagatgcatacatgtaggtttgctgtgtgttcaggaattcgcaaaagataggccagctatctctaccatcatttcaatgctaaatagtgaaatcgtggatcttcctcttcctaacaacccagcatacacagaaaggcttattggtttacatacagagaggaggggagactccataaactttgtttcaactacacttttcactggccga

SEQ ID NO: 914 - protein, 824 aa, Populus trichocarpa
  POPTR_0011s03900.1
MAALRLLLCCFCWQLGAAVDTITSSQYIKDPEAVVSAGNKFKLGFFSPGNSTNRYVGIWYSNISVTTPVWIANRNKPLNDSSGIMTISEDGNIVVLDGRKEILWSSNVSNGVSNSSAQLTDDGNVILRGGEIGNSLWQSFQEPSDTFMLKMRLTANRRTGKKTQITSWKSPSDPSVGSFSSGIEPSSIPEVFVWNDSRPFWRSGPWNGQAFIGIPEMNSVYLNGYNLVQDGDGTFSLSVGLANESYITNFALSYEGRFGEMYWDSANERWEHKKQYPGDDCDIYGKCGPFGFCNTQNSLICRCLKGFEPKNSDEWNRRNWTNGCVRRRELKCERTQSDGQVPKEDEFLKLDKVKVPDFSEWSSSASEQNCKDECLNNCSCIAYSYHTGIGCMLWRGKLTDIRKFSSGGANLYVRLADLEFGKNRDMKAVISITVVTGAIIVAVGAFFWWRRMAKYRERKRESERILSSRRKKGYPIFFNGNLIQESMNQVKFQELPLFKLQMLIAATDYFDAANKLGEGGFGPVYRGNLPDGQEIAVKRLSRASGQGQEEFMNEVVVISELQHKNLVRLLGCCVEGDEKMLVYEYMPNKSLDASLFDPVRKEVLDWKKRFNIVDGICRGLLYLHRDSRLRIIHRDLKPSNILLDQELNPKISDFGMARIFGGNEDHVKTRRVVGTYGYMSPEYAMHGRFSEKSDVFSFGVLLLEIVSGRRSTKIDGNEQGLNLLEFAWKLWNEGNAPALVDPALTLDQYSKVEIFRCIHVGLLCVQEFAKDRPAISTIISMLNSEIVDLPLPNNPAYTERLIGLHTERRGDSINFVSTTLFTGR

SEQ ID NO: 915 - DNA, 2481 bp, Populus trichocarpa
  POPTR_0011s03910.1
atggatcatggcagattcacatccacaatagcttttctcctaatactatattgtttttgttgggaatttggagcttccgtagataccattacatcatctcagtatatcaaagatcctgaagatatagtctctgctgggaacaagttcaaactgggatttttcagccctgtaaattccacaaatcgttatgcagcgatatggtacagtaatatttctattacaactccagtttgggtggctaacagaaatatgccactcaacgattcttctgggattatgacaatatctgaagatggaaatcttgttgttttgaatggtcagaaagaaattctttggtcatcaaatgtctcgactggaatgaatgattcaagagcgcagcttatggatgatggaaaccttgtcttgggagggagtgaaaatgggaacagcttatggcagagtttccaggaaccttcagatacttacatgccaaagatgagacttactgctaattccagaacaggtaaaaagacgctactaaaatcatggacaagcgtttcggatccatcaatcggaagcatctctggtggtattgatccttcaagaattcctcagttttacatttggaatggtagtcgtccaatctggcgtacaggtccctggaatggtcaggtttttattggaattcctgaaatggtatctgtttatcttgatggatttaatattgcagatgaaggaaatggaacttttactctaagtgttggtttcgctaacgagtctttaatcagcaattatatcctgagttctgaaggtaaattcggaaaagtactttgggatgatacggaggggtcatggagatatgagtggaaatttcctaaagatgagtgtgatgtttatggaaagtgcgggtcatttggaagctgtaacccaaaggattcaccaatttgcagttgtttaaaaggttttgaaccaaaaaatgcagacgaatggaataatggaaattggactaatggttgtgttaggaggagggaattgcaatgtgaaagaacacaaaatggtggtcaagtgggcaaagaagacgggtttttgaaactggaaaggatgaaagtgccagacttttctgagtggttatcttcgacatccgaacacacttgtaaaaacgagtgcttgaatattaattgctcttgcatagcttattcatattatccaggttttggatgtatgttatggagggggaacttaacagatttaaagaagtttcccataaaagcggcagatctttacattcgcctagctgattcagaacttgataataaaaagataaacctgaaagtaattatcagtttaacagtggtcgtgggagcgattgccattgcgatctgtgtgttttattcctggaggcggatagacaggaagaggaaaagcaagaaggtattcttatcaaaaaggaaggtaggatatccaatattatcagatgaaaacatgatccaagataacttgaaccatgttaaacttcaagaactacctctgttcagtttacaaacgctgatagctgcaacagacaactttaatacagccaataagctcgggcagggtggatttggtccagtatacaagggaaatttgtcagatggacaggaaatagctgtgaaaagactctctagatcatctggacaaggacttgaagaatttatgaatgaggttgtggtgatttctaaactgcaacacagaaatcttgtaagaattcttggttgttgtgttgaaggagaggaaaagatgttgatctatgaatacatgccaaataaaagcttggatgcatttctttttgattctcttagaaagcaacttctagattggaaaaatcgtttcaaaatcgtggaaggaatctgtcgaggtctgctttaccttcacagggattctaggctacggattattcatcgagatctgaaggcaagtaacatcctactggaccaagaactgaatccaaaaatctcagatttcggaatggctaggatatttggtaaccacgaagaccaagctaacactagaagggttgttggaacatacggctatatgtcccctgaatatgccatggaaggtcgattttcagagaaatccgatgtctttagctttggagttttgttgttagagactataagtggaagaaaaaataccacatattttttgacttctcaggcctggaaattgtggaacgagggcaacattgcagctctggtagatcctggaatttcatatccttctttccatgaggagatttttcgttgcgtacacgttggattgctatgtgttcaggaatttgcaaaagacaggccagctatattcactgtcatttccatgctaaatagtgaaattgcggatcttcccactcccaagcaacctgcattttcagaaaggcggagtgagctagacacaaagtcccttcagcacgaccagaggccagaatccatcaacaacgtcacggttacacttctttccggccgt

SEQ ID NO: 916 - protein, 827 aa, Populus trichocarpa
  POPTR_0011s03910.1
MDHGRFTSTIAFLLILYCFCWEFGASVDTITSSQYIKDPEDIVSAGNKFKLGFFSPVNSTNRYAAIWYSNISITTPVWVANRNMPLNDSSGIMTISEDGNLVVLNGQKEILWSSNVSTGMNDSRAQLMDDGNLVLGGSENGNSLWQSFQEPSDTYMPKMRLTANSRTGKKTLLKSWTSVSDPSIGSISGGIDPSRIPQFYIWNGSRPIWRTGPWNGQVFIGIPEMVSVYLDGFNIADEGNGTFTLSVGFANESLISNYILSSEGKFGKVLWDDTEGSWRYEWKFPKDECDVYGKCGSFGSCNPKDSPICSCLKGFEPKNADEWNNGNWTNGCVRRRELQCERTQNGGQVGKEDGFLKLERMKVPDFSEWLSSTSEHTCKNECLNINCSCIAYSYYPGFGCMLWRGNLTDLKKFPIKAADLYIRLADSELDNKKINLKVIISLTVVVGAIAIAICVFYSWRRIDRKRKSKKVFLSKRKVGYPILSDENMIQDNLNHVKLQELPLFSLQTLIAATDNFNTANKLGQGGFGPVYKGNLSDGQEIAVKRLSRSSGQGLEEFMNEVVVISKLQHRNLVRILGCCVEGEEKMLIYEYMPNKSLDAFLFDSLRKQLLDWKNRFKIVEGICRGLLYLHRDSRLRIIHRDLKASNILLDQELNPKISDFGMARIFGNHEDQANTRRVVGTYGYMSPEYAMEGRFSEKSDVFSFGVLLLETISGRKNTTYFLTSQAWKLWNEGNIAALVDPGISYPSFHEEIFRCVHVGLLCVQEFAKDRPAIFTVISMLNSEIADLPTPKQPAFSERRSELDTKSLQHDQRPESINNVTVTLLSGR

SEQ ID NO: 917 - DNA, 2496 bp, Populus trichocarpa
  POPTR_0011s03920.1
atggatcttggcagctgcacatccataatagctcttcatctaatactatattgtttttgtttggaatttggagcttccatagataccatttcattgtctcagttcatcagagatcctgaaactatagtctctgctgggaaaaagtttgaactgggatttttcagccctgttaattccacaaatcgttatgtagcgatatggtacagtaatatttctattacaactccagtctgggtggctaacagaaacaagccactcaacgattcttctgggattatgacaatatctgaagatggaaatcttgttgttttgaatggtcagaaagaaactctttggtcatcaaatgtctcgactggaatgaatgattcaagagcgcagcttatggatgatggaaaccttgtcttgggagggagtgaaaatgggaacagcttatggcagagtttccaggaaccatcagatacttacattccgaagatgagacttactgctaatcccagaacaggtaagaagacgccactgacatcatggaaaagcccttcagatccgtctatcggaagcttctctttgggtattgatccctcgagcattcctgaagtggttctttggaatgatagtcgtccaatctggcgtacaggtccctggaatggtcaggtttttattggagtcccagaaatgaattctgtttatcttgatggatttaatcttgcggatgatggaaatggaggttttactctaagtgtaggttttgctgatgagtcttacatcaccaattttgttttgagttctgaaggaaaatttggacaagtattttgggatgatatgaatgagggatcatggagatatcaatgggaaagtgttcaagatgagtgtgatgtttatggcaagtgtggttcatttgcaagctgtgatgcaaagaacacaccaatttgcagttgcttgaaaggttttgaaccaaaaaatgccgatgaatggaatagcagaaactggactcatggttgtgttcgaaggaaagcgatgcggtgtgaaagaatacaaaatggtggtgaactgggaaaagaagatggattttcgaagctggagagagtgaaagtgccaggctttgctgagtggtcatcttcgattactgaacaaaaatgcagagatgactgctggaataattgttcttgtatagcttatgcctattatactggtatatattgtatgttatggaagggaaacttaactgatataaagaagttttctagtggaggggcagatctttacattcgccttgcttatacagaacttgataataaaaagataaacatgaaagtaattatcagtttaacagtggtcgtgggagccattgccattgcgatctgcgtgttttattcctggaggtggatagaaaggaagaggacaagcaagaaggtattattaccaaaaaggaagcatccaatattattggacgaaaacgtgatccaagacaacttgaaccatgttaaacttcaagaactacctctgttcagtttacaaatgctgatagttgcaacagacaactttaatacagccaataagcttgggcagggtggatttggtccagtgtacaagggaaaattcccagatgggcaggagatagctctgaaaagactgtcaagagcatctggacaagggcaagaagaatttatgactgaggttgtggtgatttcaaaactgcaacatatgaatctcgtgagacttcttggatgctgcgttgaaggagaagagaagatgttggtttatgagtacatgccaaataggagcttggatgcttttctttttgatccttcaagaaaacaacttctagattggaaaaaacgcttcaacattgtcgaaggaatctgtcgaggtctgctttaccttcacagggattctaggctgcggattattcatcgagatctgaaggcaagtaacatcctactggaccaagaactgaatcctaaaatctcagatttcggaatggctaggatatttggtcgcaacgaagaccaagctgacactggaagggttgttggaacattcggctatatgtcccctgaatatgccatggaaggtcgattttcagagaaatccgatgtctttagctttggagttttgttattagagattataagtggaaggaaaaataccagtttctatggaaacgaggaggctttgagcctgctaggatatgcctggaaattgtggaacgagggcaacattgcagctctggtagatcctggaatttcatatccttctttccacgaggaaatttttcgttgcgtacacgttggtttgctatgtgttcaggaatttgcaaaagacaggccagctatattcactgtcatttccatgctaaatagtgaaattgtggatcttcccactcccaagcaacctgcattttcagaaaggcggagtgagctagacacagcgtcccttcagcacgaccagaggccagaatccatcaacaacgtcacggttacacttctttcaggccga

SEQ ID NO: 918 - protein, 832 aa, Populus trichocarpa
  POPTR_0011s03920.1
MDLGSCTSIIALHLILYCFCLEFGASIDTISLSQFIRDPETIVSAGKKFELGFFSPVNSTNRYVAIWYSNISITTPVWVANRNKPLNDSSGIMTISEDGNLVVLNGQKETLWSSNVSTGMNDSRAQLMDDGNLVLGGSENGNSLWQSFQEPSDTYIPKMRLTANPRTGKKTPLTSWKSPSDPSIGSFSLGIDPSSIPEVVLWNDSRPIWRTGPWNGQVFIGVPEMNSVYLDGFNLADDGNGGFTLSVGFADESYITNFVLSSEGKFGQVFWDDMNEGSWRYQWESVQDECDVYGKCGSFASCDAKNTPICSCLKGFEPKNADEWNSRNWTHGCVRRKAMRCERIQNGGELGKEDGFSKLERVKVPGFAEWSSSITEQKCRDDCWNNCSCIAYAYYTGIYCMLWKGNLTDIKKFSSGGADLYIRLAYTELDNKKINMKVIISLTVVVGAIAIAICVFYSWRWIERKRTSKKVLLPKRKHPILLDENVIQDNLNHVKLQELPLFSLQMLIVATDNFNTANKLGQGGFGPVYKGKFPDGQEIALKRLSRASGQGQEEFMTEVVVISKLQHMNLVRLLGCCVEGEEKMLVYEYMPNRSLDAFLFDPSRKQLLDWKKRFNIVEGICRGLLYLHRDSRLRIIHRDLKASNILLDQELNPKISDFGMARIFGRNEDQADTGRVVGTFGYMSPEYAMEGRFSEKSDVFSFGVLLLEIISGRKNTSFYGNEEALSLLGYAWKLWNEGNIAALVDPGISYPSFHEEIFRCVHVGLLCVQEFAKDRPAIFTVISMLNSEIVDLPTPKQPAFSERRSELDTASLQHDQRPESINNVTVTLLSGR

SEQ ID NO: 919 - DNA, 2505 bp, Populus trichocarpa
  POPTR_0608s00200.1
gtttaccttctgtttgagttgataacactcgccataagaggacagaaacttgacaatagaagcgatatttgtttcaaattcatggtggcccttctactcctactgtgttttttttgtttgcaacttggtgctgccagagatacaattacgtcatctcagtatgtcaaagatcctgatgctatagtctctgcgggaaataagttcaaactgggatttttcagccctgttaattccactaatcgctatgtaggaatatggttcagtagttttacgcctataacacgagtctgggtagctaacagaaacaagccactcaacgattcttctggggtgatgacaatatctggcgatggaaatcttgtggttttgaatggtcagaaagaaactctttggtcatcaaatgtctcaaacggagtcagtaattcaagtgcacggcttatggatgatggaaaccttgtcttgcgagatatcggaagtggaaaccgcttatgggagagttttcaggaaccttctgatacaatgataacaaacatgagacttactgctaaagtaagaacaggcgagaagacattgctatcctcatggagaagcccttcagatccatccattgggaccttctctgttggaattgatccagtaaggatacctcagtgtttcatttggaatcatagtcatccaatctatcggactggtccatggaatggtcaggtatttattggaattccaggaatgaattcagttaatatcaatggatttgatattgaacaagatggaaatgggacgtttaccctaatcttaaattctgccaacgaatcatatatcggaagttttgttttgagttatgatggaaattttaatgaactatattgggattatgggaaggaggaatgggtttacgtggggcgacttccaaacgatgagtgcgatgtctacggtaagtgcgggtcatttggaatctgtaatgcaaagtactcaccaatttgcagttgtatgaaagggtttgaaccaaaagatgcagatgaatggaatagtagaaactggactagtggttgtgttaggaggagacctatgcagtgcgaaagaatacaatatggtggtgaaccgggcaaagaagatgggttcttgaagctgcggacagtgaaagtgccagactttgctgaccggtccttggcagtttcggagcaaacatgtagagaaaattgcatgaataattgttcctgcatagcttatgcatattatactggtatacgctgtatgttgtggtgggaaaacttaactgatataaggaaatttcctagtggaggagcagatctttacgttcgcctagcttattcagaactcgataatagaactacaagtatgaaggtaattatcggtttaacagtggttgtgggagctattatcagcgcaatctgtgtgttctgtatgtggaggcgaattgctcattatagagaaaggaagaagagaagcatgaagatcttactagacgaaagcatgatgcaagacgacttgaaccaagctaaactaccacttttaagtttaccaaagcttgtagctgcaacaaacaactttgacattgccaataagcttgggcagggtggttttggtccagtgtacaagggaagattgccagatggacaggaaatagctgtgaagagactgtcaagagcatctgggcaaggactagaagaatttatgaatgaggttgtggtgatttctaaactgcaacataggaatcttgtgagactccttggttgctgtgttgaaggagaagagaagatgttggtctatgagtacatgccaaacaaaagcttagatgcctttctttttgatcctctcaggaaacaacttctagattggaataaacgttttgacattgttgacggaatctgtcgaggtctgctctaccttcacagggattccagactaaaaattattcatcgagatctgaaggcaagtaacatcctgctggacgaaaatttgaatccgaaaatttcagactttggtatggccaggatatttggtggcaatgaagatcaagcaaacactataagggttgtcgggacatatggctatatgtcccctgaatatgcaatacagggccgattttcagagaaatcagatgtttttagttttggagttttgttgttggagattgcaagtgggaggaaaaataccagtttctatgactgtgaacaagcatggaaatcatggaatgagggcaacattggagctatagtagatcctgtaatttcaaacccttcttttgaggttgaagtttttcggtgcataaatattggtctgttatgcgttcaggagcttgcaagagatagaccaactatatctacagtaatttcaatgctaaacagcgaaattgtggatcttcctgctcccaaacaatcagcattcgctgaaaggttcagttatttagacaaagaatcctccgaacagaacaaacagagatattctattaacaatgtctcgatcacagcacttgaagctcga

SEQ ID NO: 920 - protein, 835 aa, Populus trichocarpa
  POPTR_0608s00200.1
VYLLFELITLAIRGQKLDNRSDICFKFMVALLLLLCFFCLQLGAARDTITSSQYVKDPDAIVSAGNKFKLGFFSPVNSTNRYVGIWFSSFTPITRVWVANRNKPLNDSSGVMTISGDGNLVVLNGQKETLWSSNVSNGVSNSSARLMDDGNLVLRDIGSGNRLWESFQEPSDTMITNMRLTAKVRTGEKTLLSSWRSPSDPSIGTFSVGIDPVRIPQCFIWNHSHPIYRTGPWNGQVFIGIPGMNSVNINGFDIEQDGNGTFTLILNSANESYIGSFVLSYDGNFNELYWDYGKEEWVYVGRLPNDECDVYGKCGSFGICNAKYSPICSCMKGFEPKDADEWNSRNWTSGCVRRRPMQCERIQYGGEPGKEDGFLKLRTVKVPDFADRSLAVSEQTCRENCMNNCSCIAYAYYTGIRCMLWWENLTDIRKFPSGGADLYVRLAYSELDNRTTSMKVIIGLTVVVGAIISAICVFCMWRRIAHYRERKKRSMKILLDESMMQDDLNQAKLPLLSLPKLVAATNNFDIANKLGQGGFGPVYKGRLPDGQEIAVKRLSRASGQGLEEFMNEVVVISKLQHRNLVRLLGCCVEGEEKMLVYEYMPNKSLDAFLFDPLRKQLLDWNKRFDIVDGICRGLLYLHRDSRLKIIHRDLKASNILLDENLNPKISDFGMARIFGGNEDQANTIRVVGTYGYMSPEYAIQGRFSEKSDVFSFGVLLLEIASGRKNTSFYDCEQAWKSWNEGNIGAIVDPVISNPSFEVEVFRCINIGLLCVQELARDRPTISTVISMLNSEIVDLPAPKQSAFAERFSYLDKESSEQNKQRYSINNVSITALEAR

SEQ ID NO: 921 - DNA, 2493 bp, Populus trichocarpa
  POPTR_0004s02660.1
atgggacttggcagaggcaaaatttcagtagctctgcttctcttaacatcttctttttgcgtagagattatcactgccatagataccatcacatcaacccaattcctgaaggatccagaggctatagtctctaatggaaatatatacacactgggatttttcagccctgttaattccaccgatcgatatgtaggaatttggtttaatgaagttcctgtagtgacagccatatgggtagctaatagaaacaaccctctaaatgactcatctgggattctggccatatcgaaagatggcgctcttgtagttttgaatgggcagcaagagattctttggtcaactaatgtgtcgaattttgtttcaaattcaagtgcacagctctcggacaccggaaaccttgttttgcgagataacaacaacgaagaaatcatgtgggagagcttccaatatccttccgatacattcttttcgaatatgaaattaagcgccaataaaagaacaggtgggaagacacttataacatcatggaaaagtgctactgatccatccattggaagcttctctgcgggtcttaatcacctagacatacctgagatattcatatggaaggataattatccgtattttcggagtggtccatggaaccgtcttgtctttattggagttccttatatgaattctgctgctgttgatgggctcaatcttgtagatgatggagaaggtactattgatctaactttctcttatgctaatcagtctattatgtcgagctttgttttgacctcacaaggacaactagaacaaacacgttgggagcatggcatggaggatcggattgttctatggagtgttccaatgtttgattgtgaattttacggcagatgtggcctttttggaagctgtaatgcacaggcatcgcctatctgcagctgtttaagagggtttgagccaaacaatccagaggaatggtacgtaggaaactggactggtggttgtatcaggaggaaatcattgcagtgtgagagagtaaagagcgagagtgaagctgcaggaaaaaatgatgtctttttgaagctaggtaatatgaaggtgcctgacttagcacaatggtctcgtttgactgaaattgaatgcaaagacaagtgcttgacaaattgttcttgcatagcatatgcgtatgactctggtattggttgcatgtcatggattggagatctaattgatgtacaggagtttcccacaggtggtgcagatctttacattcgaatggcgtattccgaattagatggaaaccataggaaaaaagtgattgtcatcgtaagtgccgttataggaacaatcaccagtgccatgatctgtgctcttttgacatggaggttcatgtctaaacatagaggagagaagttgcattctgatacgaatgaaaaacatccatcatttttggatagagacatggctggagacagcatggaccatgttaaactgcaggagctaccactattcagtttagagagtctgacagctgcaacagacggttttgatctttcaaataagcttggccagggtggtttcggtccagtgtacaagggaaaattgtcagatggaaaggaaatagcagtgaaaagactctcaagagcatctgggcaagggctcaaagaatttatgaatgaggttgaggtgatttctaaactgcaacataggaatcttgtaagacttcttggttgctgtgttgaaggagaagaaaagctgttggtctatgagtacatgccaaacaaaagcttggatgcatttctctatgatcctctcagaaaacaacttctggattggaaaaagcgcttcaacattatcgaaggaatctgccgaggtctcctttatctccacagggattctagactaagaattattcatcgagatctaaaggcaagcaacattttgttggacccagaacttaagccaaaaatctcagatttcggagcggccaggatatttggaggagatgaagatcaagccaataccataagagttgttggaacctatggctatatatcccctgaatatgcaatggaaggtagattttctgagaaatcagatgtctacagctttggagttttgctgttagagattgtaagcgggagaagaaatactagtttctatgggaatgagcaagctttgagtcttttaggatttgcatggaaactgtggaatgaaggcaacatttcagctctagtagatccagcaatatctgatccgagttcgcaggtggaaatatttagatgcatacatgtgggcctattgtgtgttcaagaatttccagaagataggccaacagcttctactgtcgtttcaatgctgaatagtgaaatttcttatcttgcaactccaaagcaaccgccatttgctgaaaggaaataccacttcaatgaagaaagaccccatcaaaacgaagaaaagtgttccatcaattacgtgacagtcacagttgttgatgccaga

SEQ ID NO: 922 - protein, 831 aa, Populus trichocarpa
  POPTR_0004s02660.1
MGLGRGKISVALLLLTSSFCVEIITAIDTITSTQFLKDPEAIVSNGNIYTLGFFSPVNSTDRYVGIWFNEVPVVTAIWVANRNNPLNDSSGILAISKDGALVVLNGQQEILWSTNVSNFVSNSSAQLSDTGNLVLRDNNNEEIMWESFQYPSDTFFSNMKLSANKRTGGKTLITSWKSATDPSIGSFSAGLNHLDIPEIFIWKDNYPYFRSGPWNRLVFIGVPYMNSAAVDGLNLVDDGEGTIDLTFSYANQSIMSSFVLTSQGQLEQTRWEHGMEDRIVLWSVPMFDCEFYGRCGLFGSCNAQASPICSCLRGFEPNNPEEWYVGNWTGGCIRRKSLQCERVKSESEAAGKNDVFLKLGNMKVPDLAQWSRLTEIECKDKCLTNCSCIAYAYDSGIGCMSWIGDLIDVQEFPTGGADLYIRMAYSELDGNHRKKVIVIVSAVIGTITSAMICALLTWRFMSKHRGEKLHSDTNEKHPSFLDRDMAGDSMDHVKLQELPLFSLESLTAATDGFDLSNKLGQGGFGPVYKGKLSDGKEIAVKRLSRASGQGLKEFMNEVEVISKLQHRNLVRLLGCCVEGEEKLLVYEYMPNKSLDAFLYDPLRKQLLDWKKRFNIIEGICRGLLYLHRDSRLRIIHRDLKASNILLDPELKPKISDFGAARIFGGDEDQANTIRVVGTYGYISPEYAMEGRFSEKSDVYSFGVLLLEIVSGRRNTSFYGNEQALSLLGFAWKLWNEGNISALVDPAISDPSSQVEIFRCIHVGLLCVQEFPEDRPTASTVVSMLNSEISYLATPKQPPFAERKYHFNEERPHQNEEKCSINYVTVTVVDAR

SEQ ID NO: 923 - DNA, 2451 bp, Vitis vinifera
  GSVIVT01006351001
atgagaaggccaagtaagaaagctgtgtctctcttacttacctgtttttggtttgtgttcggctgttctgccatagacaccattacatccacgcacttcatcaaagatcctgaaactatagtctccagtggaagggttttcaaactgggtttctttagcctcgatggttccagtaatcggtacgttggaatctggtacaacaccacttcactgctcactatcatatgggtagccaacaaggacagacccctcaatgattcttccggtgttctcaccatatctgaagatggtaatattcaagttttgaatggccggaaggagattctgtggtcatccaatgtttcaaaccccgcagctgtcaattcaagtgcccagcttcaggattctggaaatcttgttctgcgagataagaacggggtgagcgtatgggagagtttgcaaaacccttctcactcatttgtgccacagatgaaaattagcactaacacacgtacgcgtgtgagaaaagtactgacatcatggaaatcttcctcggatccatccatgggaagcttcactgctggagttgaacctctaaacatccctcaagttttcatctggaatggaagtcggccatattggcgtagtggtccatgggatggtcagatcttgacgggagtagacgtgaaatggattactcttgatgggcttaatattgttgatgataaagaaggtaccgtttatgtaacttttgctcacccagagtcaggtttcttctatgcctatgtcttgactcctgaaggaatactagtggaaacatccagggataaaaggaatgaggattgggaaagagtatggacgaccaaggagaatgagtgtgaaatttatggcaagtgcgggccatttggacactgcaactcgagggactcaccaatttgtagctgtttgaaagggtatgagccaaagcatacacaggaatggaatagagggaattggactggtggatgtgtgaggaagacgccattgcaatgtgagagaaccaaaaatggcagtgaagaggccaaagtagatgggtttctcaagttaacaaacatgaaagtgccagactttgcagagcagtcatatgctcttgaagatgattgcagacagcaatgcttgaggaattgttcctgtattgcttattcatattatacaggcatcgggtgtatgtggtggagtggagatttaatcgacatacaaaaactgtctagcacaggggcaaatcttttcatccgcgttgcacattcagaactaaaacaagatagaaagagagacgcgagagtaattgttattgttacagtgattatagggacaattgccattgccctctgcacttacttcttaaggaggtggattgccagacaaagaggtaatctgctcataggaaaattttctgatcccagtgtccctggagacggtgtgaatcaagtcaaacttgaagagctgccactcatcgattttaataagcttgcaactgcaacaaacaatttccatgaggccaataagctggggcagggtggttttggtcctgtatacagaggaaaattggcagaaggacaagacatagcagtgaaaagactttcaagagcatctacacaagggctagaagaatttatgaatgaggtggtggtgatttctaaactccaacacaggaatcttgttagactaattggctgctgcattgaaggagacgagaagatgttgatctacgagttcatgccgaataagagcttggatgcttctctctttgatcctgtcaagcgacagattttagattggaggacacggttcaagattattgaaggaattggccgaggccttctttaccttcacagagattctagattacgaattatccatagagacctcaaggcaagtaatattttattggatgaagacttgaatcctaaaatttcagattttggtatggccagaatatttggaagcaatcaagatcaagccaatactaaaagggttgttggaacatatggctatatgtctcccgagtatgcaatggaaggacgattttcagaaaaatcagatgtcttcagctttggagtacttttgttagagattgtgagtgggagaaagaatagtagtttttaccatgaggagtattttacccttttgggatatgcatggaaactgtggaaggaagacaacatgaaaacattaatagatggaagtatattagaagcatgcttccaagaggagatattgagatgcatacatgtgggactgttatgtgtacaagaattggctaaagacagaccatccgtttcaactgttgtgggaatgatttgtagtgaaatcgcacatcttccacccccaaagcaacctgcatttactgagatgcggagtggcatagatatagaatcctccgataaaaagtgttccctaaacaaagtcagcattaccatgattgagggtcgc

SEQ ID NO: 924 - protein, 817 aa, Vitis vinifera
  GSVIVT01006351001
MRRPSKKAVSLLLTCFWFVFGCSAIDTITSTHFIKDPETIVSSGRVFKLGFFSLDGSSNRYVGIWYNTTSLLTIIWVANKDRPLNDSSGVLTISEDGNIQVLNGRKEILWSSNVSNPAAVNSSAQLQDSGNLVLRDKNGVSVWESLQNPSHSFVPQMKISTNTRTRVRKVLTSWKSSSDPSMGSFTAGVEPLNIPQVFIWNGSRPYWRSGPWDGQILTGVDVKWITLDGLNIVDDKEGTVYVTFAHPESGFFYAYVLTPEGILVETSRDKRNEDWERVWTTKENECEIYGKCGPFGHCNSRDSPICSCLKGYEPKHTQEWNRGNWTGGCVRKTPLQCERTKNGSEEAKVDGFLKLTNMKVPDFAEQSYALEDDCRQQCLRNCSCIAYSYYTGIGCMWWSGDLIDIQKLSSTGANLFIRVAHSELKQDRKRDARVIVIVTVIIGTIAIALCTYFLRRWIARQRGNLLIGKFSDPSVPGDGVNQVKLEELPLIDFNKLATATNNFHEANKLGQGGFGPVYRGKLAEGQDIAVKRLSRASTQGLEEFMNEVVVISKLQHRNLVRLIGCCIEGDEKMLIYEFMPNKSLDASLFDPVKRQILDWRTRFKIIEGIGRGLLYLHRDSRLRIIHRDLKASNILLDEDLNPKISDFGMARIFGSNQDQANTKRVVGTYGYMSPEYAMEGRFSEKSDVFSFGVLLLEIVSGRKNSSFYHEEYFTLLGYAWKLWKEDNMKTLIDGSILEACFQEEILRCIHVGLLCVQELAKDRPSVSTVVGMICSEIAHLPPPKQPAFTEMRSGIDIESSDKKCSLNKVSITMIEGR

SEQ ID NO: 925 - DNA, 2463 bp, Solanum lycopersicum
  Solyc04g058110.2.1
atgagcaacagcagcagcagaagaaatttgcaatattttgttcatataattcttgttattcttcgttttgtcgatacaggattatgcagtgaagtggataacattactagcattcagtctctgagagatcctggaattttatcgtctccaggaggcgtattcaagttaggatttttcagtcctcaaaacagtagtaataggtatgttggtatttggtacaatttttctgtaacaacagtcatttgggtggctaatcgagacaaacctttaagagattcttctggagttgtgaagatatctcgtgatggaaatatcgttataacgaatggagaggaggagattctttggtcatcaaatgtttcaacttctcaggtgatcatcccaattggacttctccaagattctggcaactttgttctcgttgatcatcgggacatgagcacaatatggcagagttttgaacatccttctgattcaactattcctagaatgagaataagtgaaaacacaaggacaggggagatggtagaagcaacatcttggagaagtccttcggatcctaatatcggggacttttctttaagaatgaactctggagtcattcctcaggtgtatatatggaaaggaaggcgtccctattggcgtactggtcaatggaatggacagatctttataggagtgcagaatatgtattctgtggtgtctgatggatttaatgtagtggatgatcgcgaaggtactgtatattttactggacctactcgtgataattttttaaggatattagtcttggattggagagggaacttggttcaatcatattgggatgtgaatgagacaaaatggaagataatatggtcagctcccaataacgattgtgaagtttatggaacgtgtggtccatttgggagctgcaatcacttggagtcaccagtctgttcttgtctgaaaggttttgagccaaagcacatggaagaatgggaaaaggggaattggactagtggttgtgttaggaggagtgctttgcaatgtgaagttaagaataacaccacggattcaagtaaagaagacggatttctaaagatggagttaatgaaattgcctgattttgctgaaaggtcatctactacagaagacgtatgtagaagtcgatgcttggggaattgttcgtgcatagggtatgcatttgattcaagtatcggctgtatgtcgtggagtataatgattgacattcagcagttccaaagctcggggaaagatctctatattcatgtagcacattcagagcttgtgttttctgcagatcatcgtaaagagtacataaagaaaatcgtaattccagtaatcgttggttctcttacactctgtgtttgtctgttcctttgctatacaatgatggtcagacgtagaggagtgaaaagagaggaggttttacttggtaacaaaagtccagttaatatggaagaattaccagtcttcagcctcgatacgcttgtaaatgcaacatcccaattcaatgaggataataagcttggtcagggaggttttggtccagtttacaagggaatattggaagatgggaaagaaattgctgtcaagaggctctcaaaagcctcgaaacaaggactagaggagttcatgaatgaagtgttggtgatctcgaaagttcaacatagaaaccttgttagactctgtggatgttgtgtcgatgaagaggagaagatgctaatttacgaatatatgccaaagaaaagcttagatgtgtttctctttgatgaaggacatcgagacatattggattggacaaaacgttccattataatcgaaggagttggtcgaggactcctttatcttcacagagattcaagattgaagataatccatagagatctaaagccaagtaacatcttgctcgataataacttcaatccaaagatctcagattttggcatggctaggattttcggatctgatcaagatcaagcagacacaatgagagtagttggtacttatggatacatggcacccgaatatgcaatggaaggaagattctcagagaaatccgatgttttcagctttggagttctcgtcttagagatcataagtggtcgaaaaagtacaagttcttggactgagacatcctctttgagccttatgggatatgcatggaagttatggaaagaacaagatttatcaactttcatcgatccgtttatattgaacacgagctcggaaatggagatcagaaaatgcatacagattggtttattgtgtgttcaagaatttgctgaagacaggccaaatatttcatctgttcttgttatgcttactagtgaaacaacaagtcttccagcaccatcacaacctgcttttactgaaagaagacacttcagaatgtgcaatgaaaatagagaaactaagtttactttgaacaaaatgagtatcacaaaccttactggtaga

SEQ ID NO: 926 - protein, 821 aa, Solanum lycopersicum
  Solyc04g058110.2.1
MSNSSSRRNLQYFVHIILVILRFVDTGLCSEVDNITSIQSLRDPGILSSPGGVFKLGFFSPQNSSNRYVGIWYNFSVTTVIWVANRDKPLRDSSGVVKISRDGNIVITNGEEEILWSSNVSTSQVIIPIGLLQDSGNFVLVDHRDMSTIWQSFEHPSDSTIPRMRISENTRTGEMVEATSWRSPSDPNIGDFSLRMNSGVIPQVYIWKGRRPYWRTGQWNGQIFIGVQNMYSVVSDGFNVVDDREGTVYFTGPTRDNFLRILVLDWRGNLVQSYWDVNETKWKIIWSAPNNDCEVYGTCGPFGSCNHLESPVCSCLKGFEPKHMEEWEKGNWTSGCVRRSALQCEVKNNTTDSSKEDGFLKMELMKLPDFAERSSTTEDVCRSRCLGNCSCIGYAFDSSIGCMSWSIMIDIQQFQSSGKDLYIHVAHSELVFSADHRKEYIKKIVIPVIVGSLTLCVCLFLCYTMMVRRRGVKREEVLLGNKSPVNMEELPVFSLDTLVNATSQFNEDNKLGQGGFGPVYKGILEDGKEIAVKRLSKASKQGLEEFMNEVLVISKVQHRNLVRLCGCCVDEEEKMLIYEYMPKKSLDVFLFDEGHRDILDWTKRSIIIEGVGRGLLYLHRDSRLKIIHRDLKPSNILLDNNFNPKISDFGMARIFGSDQDQADTMRVVGTYGYMAPEYAMEGRFSEKSDVFSFGVLVLEIISGRKSTSSWTETSSLSLMGYAWKLWKEQDLSTFIDPFILNTSSEMEIRKCIQIGLLCVQEFAEDRPNISSVLVMLTSETTSLPAPSQPAFTERRHFRMCNENRETKFTLNKMSITNLTGR

SEQ ID NO: 927 - DNA, 2481 bp, Solanum lycopersicum
  Solyc02g079530.2.1
atgaaattaagcacaagagagatacttctgtttccagttgttcttgttctgtttctttctatatcaactgcttcaggtatcattagcaccaataaattcctgcgagattcagaaactttagtctccaatgacaaaagattcatattcgggttctttagtcttgaaaattcgacgaatcgttatgttggtgttatgtttaatgtccaaccaccaactgtagtatgggttgccaacagagagagacctttacaggattctagaggaagagtgacaatatctgatgatggaaatcttgtaatcttgaattcacagaataggagtatatggtcatcaaatatttcaccagctgtgagaaattctacagcgcagctcttggatactggaaacttaattttgaacgacagctccaatgggagggttctctgggaaagttttcgggatccttcagattgcttcttgcagaccatgaaaattggcgttgatgttagtactaacacgacaaatctgctgaaatcatggataagtccttcagatccatctgttgggagtttctcagctggtattcaacctgaaacagttccccagatttccatatggaagaatgggaaacctcattggcgtagcggtccatggaataaacaggttttcattggggtaccagacatgacttcgttctatctcaatggatttgatctagtaaatgacaacaagggcaccgtctaccttacctatttatatgcaaatcaggttgagctgatgtatttcaccttgaactcaacagggtttttgcagcagaaatatatggatcctagtaagaatgactgggaagtaacatgggaatttcctgcaactgagtgtgatttttatggaaaatgtggaccttttggaagctgtgatcctacaagctcaccaatctgttcttgtttagagggatttaaaccgacaaatgaagaggaatggcggaaaggaaactggactcgtggatgcaacagaaagtccatgttagagagcgaaaggaacagttctaaccttgagcaagggaagcaagattggtttctgaagctgcagtcaatgaaagtgccggattctgctatttgggtaccttttgtagatgaagattgtgttaacggttgcttgaggaatacttcctgcatagcttattcatactacacaggcataggatgtatgcattgggaaggaaacttacttgatgttcagaaattctccatgggtggggttgatttattccttcgcctttcatactctgagcgagatcaaaagagagaatataaagttatcattgccatcatagtcccagtaggctcgataattcttgccattttcggatacatttcctgcaaatatgtagctaagcgcagaggatggaagagaatgagtaagattttcttaagtgaatcatcgccaaactattacaaggaagacaagattacagaggacatcaatcaagctaaattggaagaactgcttgtatacaactttgatatcttagcaaatgcaactgagaattttcatctgtccagcaagcttggacagggaggttttggtccagtttacaaagggaaattgccagatggacaagagattgctgtgaaaaggctttcccaatcttctggtcagggtctacaggagttcatgaatgaggttgtggtgatttcaaaacttcaacatcgtaatcttgttagactttttggttgctgcatagaaagaggggaaaagatgctggtttatgaatacatgccaaaaagaagcttggatgcctatctctttgggtcacagcaacaagcagaagagttccttgattggagtaaacgtgtgatcatcattgagggaattggtcgaggccttctttaccttcacagggattcaagactaaggattattcatagggatttaaaggccagcaacattttgttggatgaatacctgaaccccaaaatttcagattttgggatggcaaagatttttgcaggcaaccaagatcaggccaacacaagcagagttgttggaacctatggttatatggcaccggaatatgcaatggaaggaagattctcagaaaaatcagatgtttatagctttggagtgttgttattggaaattataagtggaaggaggaacaccagctttcaccaagatgatggtgcattaagcctgctagcatgggcgtggaagtgttggattggaaacaagattgtggaattggttgatcccaagataactgaactgcaccttggaaaggaaattgtgagatgtgtacaagttggactattatgtgtacaagaatatgcagaagacagaccaaatgtctccacaattttgtctatgctcaccagcgaaattgataatttaccaagtcctaaacaacctgcatttacaacaagaccgagcttttccaagaaaggcacttctaaatctcaaggctccgttaacaatgttactgttactattatggaaggacga

SEQ ID NO: 928 - protein, 827 aa, Solanum lycopersicum
  Solyc02g079530.2.1
MKLSTREILLFPVVLVLFLSISTASGIISTNKFLRDSETLVSNDKRFIFGFFSLENSTNRYVGVMFNVQPPTVVWVANRERPLQDSRGRVTISDDGNLVILNSQNRSIWSSNISPAVRNSTAQLLDTGNLILNDSSNGRVLWESFRDPSDCFLQTMKIGVDVSTNTTNLLKSWISPSDPSVGSFSAGIQPETVPQISIWKNGKPHWRSGPWNKQVFIGVPDMTSFYLNGFDLVNDNKGTVYLTYLYANQVELMYFTLNSTGFLQQKYMDPSKNDWEVTWEFPATECDFYGKCGPFGSCDPTSSPICSCLEGFKPTNEEEWRKGNWTRGCNRKSMLESERNSSNLEQGKQDWFLKLQSMKVPDSAIWVPFVDEDCVNGCLRNTSCIAYSYYTGIGCMHWEGNLLDVQKFSMGGVDLFLRLSYSERDQKREYKVIIAIIVPVGSIILAIFGYISCKYVAKRRGWKRMSKIFLSESSPNYYKEDKITEDINQAKLEELLVYNFDILANATENFHLSSKLGQGGFGPVYKGKLPDGQEIAVKRLSQSSGQGLQEFMNEVVVISKLQHRNLVRLFGCCIERGEKMLVYEYMPKRSLDAYLFGSQQQAEEFLDWSKRVIIIEGIGRGLLYLHRDSRLRIIHRDLKASNILLDEYLNPKISDFGMAKIFAGNQDQANTSRVVGTYGYMAPEYAMEGRFSEKSDVYSFGVLLLEIISGRRNTSFHQDDGALSLLAWAWKCWIGNKIVELVDPKITELHLGKEIVRCVQVGLLCVQEYAEDRPNVSTILSMLTSEIDNLPSPKQPAFTTRPSFSKKGTSKSQGSVNNVTVTIMEGR

SEQ ID NO: 929 - DNA, 2493 bp, Solanum lycopersicum
  Solyc02g079540.1.1
atgaagctgagcttaagctgtaagaatatacttctttgttgtgcttttcttgttctgttttttcttataacaaatgcttcatcagactccattagtattaatgagtttctgcaagattcagaaactttagtctctaataacaaaacattcaaattggtttttttttgtcctgagaattcggcgaatcgttatgttggtatcatgtttaatatgaaatcacaatctgttatatgggtagccaacagagaccagcctttacaagattctagtggaagagtaacaatatcagaagatggcaatcttgtaatcttgaatggacagggaaagagtgtatggtcatcaaatatttcacctgctgtgaggaattctacagcccagctcttggatactggaaacttagttttgaaggacaactcaagtgagagagttctatgggaaagttttagtgatctttcagattcctacttgcagaacatgaaacttggcactgataagagtactaacaccacaaatctgttgaaatcatggagaagtcctgtagatccatctgatgggagtttctcagctggtattcagactgaaacaattcctcagattttcatatggaagaatggcttacctcattggcgtagcggtccatgggataaacaggtttttattggagtaccaaacatgacttctttctatttcagtggatttgagctagtaaatgacaacatgggcaccacctacttctactattcatattatcaaggtgatgacattttatacttagttttgaactcaacaggatttctgcaacaaaaatatttatatgctaggaagaatgagtgggaagtcacatgggcaactccatcaaatgagtgtgatttttatagaaagtgtggaccttttggaagctgtgattctgaaagttcaccaatttgcagttgtttgcaagggtttaaaccaaaaaatcaagaggagtgggtgaaaggaaactggacaaatggatgcatcagaaagacagtgttagagaaagaaagaaacaactctaacattgagcagggtaagcaagattggtttttgaagttgcagtcgatgaaagtgccagattatcctatttgggtaccttcagccaaagaagactgtgaaagtgattgcttcagaaatttctcctgcatagcttattcatactacagaggcatagggtgtatgcattgggaagggagcttaattgattctcagaaattctccaagggtggggctgatttattcattcgccttgcatatactgaacaagaaaaaaagaagagcaataaagtagccatcaggatcatagttccaataatttgcacaatagtcattgccatcttgggatacatttccagcaaactgttggctaaacatagaggaaggaagagaaagcgtgagctcttatcaaaaaaatcatttccaagctattacaagctaagtttggctagagatgacattaacagagttaaatttgaagatcttccgatatacagctttgacatgctagcaaatgcaactgacaattttcatctgtctagcaagcttgggcagggtggttttggttcagtttataaaggaaaacttccagagggacaagaaattgctgtgaaaaggctttcacagtcttctggtcaggggcaagaggagttcatgaatgaggttgtggtgatttccaaacttcagcatcgtaatcttgttagactcctcggctgctgcatagaaagaggggagaagatgttggtttatgaatacatgccaaaaagaagcttggatgcctatctctttggtgtacacattgaagaggaatacttccttgattggagcaaacgtgtgatcatcattgagggaatcggccgaggcctcctataccttcacagggattcaagactaaggattatccacagggatttaaaggcaagcaacattttgttggatgaatatctgaaccctaaaatttcagattttggtatggcaagaattattgcaggcaaccaagatcaagccaatacaattagggttgttggaacctatggttatatggcacctgaatatgcaatgacaggaagattctcagaaaaatcagatgtctacagctttggcgtattgttactggaaattattagcggaaggaggaacactagcttttaccaagaggatggtgcattaagccttctagcatgggcatggaagttgtggaatgaaaataagattgtcgaattggttgactccaagataattgaactacagctcaaaaaggagattcatagatgtgtacatgttggactattatgtgtacaagaatatgcagaagacaggccaaatgtctccacagttttgtctatgctcacccgggaaattgatgatttaccaagtcctaaacaacctgcatttacaacaagaccgaccccttccaagaaaggctcctctagaattcaagtctccgtgaacgatgttagcattactattatggaagcacga

SEQ ID NO: 930 - protein, 831 aa, Solanum lycopersicum
  Solyc02g079540.1.1
MKLSLSCKNILLCCAFLVLFFLITNASSDSISINEFLQDSETLVSNNKTFKLVFFCPENSANRYVGIMFNMKSQSVIWVANRDQPLQDSSGRVTISEDGNLVILNGQGKSVWSSNISPAVRNSTAQLLDTGNLVLKDNSSERVLWESFSDLSDSYLQNMKLGTDKSTNTTNLLKSWRSPVDPSDGSFSAGIQTETIPQIFIWKNGLPHWRSGPWDKQVFIGVPNMTSFYFSGFELVNDNMGTTYFYYSYYQGDDILYLVLNSTGFLQQKYLYARKNEWEVTWATPSNECDFYRKCGPFGSCDSESSPICSCLQGFKPKNQEEWVKGNWTNGCIRKTVLEKERNNSNIEQGKQDWFLKLQSMKVPDYPIWVPSAKEDCESDCFRNFSCIAYSYYRGIGCMHWEGSLIDSQKFSKGGADLFIRLAYTEQEKKKSNKVAIRIIVPIICTIVIAILGYISSKLLAKHRGRKRKRELLSKKSFPSYYKLSLARDDINRVKFEDLPIYSFDMLANATDNFHLSSKLGQGGFGSVYKGKLPEGQEIAVKRLSQSSGQGQEEFMNEVVVISKLQHRNLVRLLGCCIERGEKMLVYEYMPKRSLDAYLFGVHIEEEYFLDWSKRVIIIEGIGRGLLYLHRDSRLRIIHRDLKASNILLDEYLNPKISDFGMARIIAGNQDQANTIRVVGTYGYMAPEYAMTGRFSEKSDVYSFGVLLLEIISGRRNTSFYQEDGALSLLAWAWKLWNENKIVELVDSKIIELQLKKEIHRCVHVGLLCVQEYAEDRPNVSTVLSMLTREIDDLPSPKQPAFTTRPTPSKKGSSRIQVSVNDVSITIMEAR

SEQ ID NO: 931 - DNA, 2511 bp, Eucalyptus grandis
  Eucgr.E03659.1
aattcgttatcacaagggcagttggtccgagatggcgagactctggtttctcgttctgggaacttcgagctggggttctttagaactgagaattcgtctcttagatatgttggtatttggtaccgcaagataagttttaaaacatacgtgtgggtcgcgaacagagatagccctgtttctgatgaatctggagttctgacaatttcaagtgatggaaatttgatggttttagatggggatcatcgcttagtttggtctagcggcattaattctacctctgtgcccaccaactcaacagctgttttgacggatgctggaaatcttgttcttctggccaaggcagatgctgacactgctagtgctgatggtcatgtcagcaatgcatactggcaaagctttgaacacccgacagacacgtttttgcctggcatgagagtgagggtgaattctgcggctggagagaaccatgcctttaggtcatggacatcgttgaaagacccttcccctgggaactactctatgggcgttgatccccggttgccgccacagatagtgatctggggccagtcaggccaggaatggaggagcgggcattggaatgggctgtctttcaccggcatgccaaatgtgactggcaatattcaatatgggttcaggctttcgacccccgaggaggatggaagcatgtattttacatacacaccatcgaataggtccaatctcttgatgttccgtatactttggaatggaacgggggaagagttagtttgggatgagactaataatgagtggactgtgctgcaagaacagcctgctaaggaatgtgacctatataacaagtgtggagattttgcaatgtgcaatgacatgggctctcccaaatgtagttgcatggaagggttcattccaaaatcaccggatcaatggaagaggggtaactggtccatgggttgtgctcggaagacccaattacagtgtcgggataacagcagcatttcagtgggagatggcagcagggtggatggcttcttgaaattggatggcgtgaagttgccagattttgcggattctgtttcagccactatcagggatgagtgtgaggcgaagtgtctggagaattgttcgtgcaaagcttttgcatttgatttaggcatccggtgcatgatgtggagcaagaatttgattgatgtggagcatttcgctgagggtggaatgaccctccaaattcgtcttgccaattctgaaccaggaacaaagagcaaaatatccaacctacgcatgatagttactgccttcgttggagtgtttgtttccggtataacagtatttttgttgtggaggttcaaggacaatttaaaaggattcttgtttgatgatattgttaagagcgaagagctatgtcttgatttgtccggaccagatggccttgctagtgatgctaggcaagtaggaggacctgatataccagtgttcgacttcagttccatagaagctgcaacgaatgtcttttctgaagaaaacaagctcggactcggaggattcggtcctgtttacaagggaaagcttctaggaggacaagaaatagccgttaagaggctttcgaggaagtcaagccaaggggttgaggaatttaagaacgaggttatggtaattgcgagattacaacatagaaacctcgtgagactccttggattctgcgttcaaggtgaagataagatgcttgtttatgagtacatgccaaacaggagcttggattattttatttttgatccagcgaagcgagcacaactgaactggaagaaacgtttggagattattgaagggatagcacgaggcatcctctatcttcatcgagactctagattaaggattattcatcgtgacctaaaagccagtaatattttgttggacgaagagatgaacccaaaaatatcagactttggcatggcgagaattttcggtgggaatgaaaatgaagcgagtaccaatcgagtggttggcacgtatggttacatgtctcctgagtatgcgatggaaggtatattttcgttcaaatctgatgtgtacagcttcggggtattattactggagatcattagcggcaagaaaaacattggctttcgcacgctggaacattctaatcttatcagccacgcttggcatcactggaatgatgggaagacgatggaactaatcgatccttgtatcagggacatgtgctctgcggatgaggcattacgatgcatacaagtcggactattctgtgtgcaagactctgccagagatagaccgctcatgtcttccgttgtgctactattagaaagtgaaacagcaggtcttcccctcccgaagccacccaggttaacctcgattgggggcttcttaggttcttattctttgggtgaaacgacgggtctttcaataccgatacaacccagcttaacctcaatcacgggctccatagatacgtattcttcgtttgaaagccaagaaattgaatcatggaactcg

SEQ ID NO: 932 - protein, 837 aa, Eucalyptus grandis
  Eucgr.E03659.1
NSLSQGQLVRDGETLVSRSGNFELGFFRTENSSLRYVGIWYRKISFKTYVWVANRDSPVSDESGVLTISSDGNLMVLDGDHRLVWSSGINSTSVPTNSTAVLTDAGNLVLLAKADADTASADGHVSNAYWQSFEHPTDTFLPGMRVRVNSAAGENHAFRSWTSLKDPSPGNYSMGVDPRLPPQIVIWGQSGQEWRSGHWNGLSFTGMPNVTGNIQYGFRLSTPEEDGSMYFTYTPSNRSNLLMFRILWNGTGEELVWDETNNEWTVLQEQPAKECDLYNKCGDFAMCNDMGSPKCSCMEGFIPKSPDQWKRGNWSMGCARKTQLQCRDNSSISVGDGSRVDGFLKLDGVKLPDFADSVSATIRDECEAKCLENCSCKAFAFDLGIRCMMWSKNLIDVEHFAEGGMTLQIRLANSEPGTKSKISNLRMIVTAFVGVFVSGITVFLLWRFKDNLKGFLFDDIVKSEELCLDLSGPDGLASDARQVGGPDIPVFDFSSIEAATNVFSEENKLGLGGFGPVYKGKLLGGQEIAVKRLSRKSSQGVEEFKNEVMVIARLQHRNLVRLLGFCVQGEDKMLVYEYMPNRSLDYFIFDPAKRAQLNWKKRLEIIEGIARGILYLHRDSRLRIIHRDLKASNILLDEEMNPKISDFGMARIFGGNENEASTNRVVGTYGYMSPEYAMEGIFSFKSDVYSFGVLLLEIISGKKNIGFRTLEHSNLISHAWHHWNDGKTMELIDPCIRDMCSADEALRCIQVGLFCVQDSARDRPLMSSVVLLLESETAGLPLPKPPRLTSIGGFLGSYSLGETTGLSIPIQPSLTSITGSIDTYSSFESQEIESWNS

SEQ ID NO: 933 - DNA, 2547 bp, Eucalyptus grandis
  Eucgr.E03662.1
atgtggtcgtctctgttttcatattcttgtacagcgaattcgttatcccaagggcagttggtccgagatggcgagactctggtttctcgttctgggaacttcgagctggggttctttagaactgagaattcgtctcttagatatgttggtatttggtaccgcaagataagttttaaaacatacgtgtgggtcgcgaacagagatagccctgtttctgatgaatctggagttctgacaatttcaagtgatggaaatttgatggttttagatggggatcatcgcttagtttggtctagcggcattaattctacctctgtgcccaccaactcaacagctgttttgacggatgctggaaatcttgttcttctggccaaggcagatgctgacactgctagtgctgatggtcatgtcagcaatgcatactggcaaagctttgaacacccgacagacacgtttttgcctggcatgagagtgagggtgaattctgcggctggagagaaccatgcctttaggtcatggagatcgttgaacgacccttcccctgggaactactctatgggcgtcgatccccagttgccgccacagatagtaatctggggtcagtcaggccgggaatggaggagcgggcattggaatgggctgcttttcaccggcatgccaaatatgactgaaaatattcgatatgggttcaggctttcggcccctgaggaggatggaagcatgtattttacatacacaccgttgaataggtccgatctcttgatgttccgtatactttggaatggaatgggggaagagttaggttgggatgagacaaataatgagtcgactgtgctgcaaaaacagcctgctaaggaatgtgacctatataacaagtgtggagattttgcaatatgcaatgacatgggctctcccaaatgtagttgcatggaagggttcattccaaaatcaccggatcaatggaagaggggtaactggtccatgggttgtacttggaagactcgattacagtgtgggaacaacagcagcatttcagtgggaaatggtggcaggatggaccactttttgaaattggttggggtgaagttgccggattttgcagattatttttcagccactagcggggatgagtgtgaggtgaagtgtctagagaattgttcgtgtaaagcttatgcatttgttagaagcattgggtgcatgatgtggaacaagaatttgatcgatgtgcagcatttcgctgagggcggaatgaccctccaaattcgtctcgccaattctgaaccaggaacaaagagcaaaatatccaacctacgcatgatagttactgcttttgttggagcgtttgtttccggtataacagtatttttgttgtggaggttcaaggacaatttaaaaggattcttgtttgatgatattgttaagagcgaagagcaatatcttgatttgtccagaccagatggtcttgctagtgatgctaagcaagtaggaggacctcgtataccagtgtttgacttcagttccatagaagctgcaacgaatgtcttttctgaagaaaacaagcttggactgggaggattcggtcctgtttacaagggaaagcttcttggaggacaagaaatagccgttaagaggctttcgaggaagtcaagccaaggggttgaggaatttaagaatgaggttatggtaatcgcgagattacaacatagaaacctcgtgagactcctcggattctgcattcaaggcgaagataagatgctcgtttatgagtacatgccaaacaggagcttggattattttatttttgatccagcgaagcgagcacaactgaactggaagaaacgtttggagattattgaagggatagcacgaggcatcctctatcttcatcgagattctagattaaggattattcatcgtgacctaaaagtcagtaatattttgttggatgaagagatgaacccaaaaatatcagactttggcatggcgagaattttcggtgggaatgaaaatgaagcgagtaccaatcgagtggttggcacatatggttacatgtctccagagtatgcgatggaaggtctattttcgttcaaatctgatgtgtacagctttggggtattattactggagatcattagcggcgagaaaaacattggctttcgcacgccggaacattctaatcttatcagccatgcttggcatcactggaatgaagggaaggcgatggaactaatcgatccttgtatcagggacatgtgctatgtggatgaggcattacgatgcatacaagtcggactattgtgtgtgcaagactctgccagagatagaccgctcatgtcttccgttgtgctactattagaaagtgaaacagcaggtcttcccctcccgaagccacccaggttaacctcgattgggggcttcttaggttcttattctttgggtgaaacgacgggtctttcaataccgatacaacccagcttaacctcaatcacgggctccatagatacgtattcttcgtttgaaagccaagaaattgaatcatggaactcg

SEQ ID NO: 934 - protein, 849 aa, Eucalyptus grandis
  Eucgr.E03662.1
MWSSLFSYSCTANSLSQGQLVRDGETLVSRSGNFELGFFRTENSSLRYVGIWYRKISFKTYVWVANRDSPVSDESGVLTISSDGNLMVLDGDHRLVWSSGINSTSVPTNSTAVLTDAGNLVLLAKADADTASADGHVSNAYWQSFEHPTDTFLPGMRVRVNSAAGENHAFRSWRSLNDPSPGNYSMGVDPQLPPQIVIWGQSGREWRSGHWNGLLFTGMPNMTENIRYGFRLSAPEEDGSMYFTYTPLNRSDLLMFRILWNGMGEELGWDETNNESTVLQKQPAKECDLYNKCGDFAICNDMGSPKCSCMEGFIPKSPDQWKRGNWSMGCTWKTRLQCGNNSSISVGNGGRMDHFLKLVGVKLPDFADYFSATSGDECEVKCLENCSCKAYAFVRSIGCMMWNKNLIDVQHFAEGGMTLQIRLANSEPGTKSKISNLRMIVTAFVGAFVSGITVFLLWRFKDNLKGFLFDDIVKSEEQYLDLSRPDGLASDAKQVGGPRIPVFDFSSIEAATNVFSEENKLGLGGFGPVYKGKLLGGQEIAVKRLSRKSSQGVEEFKNEVMVIARLQHRNLVRLLGFCIQGEDKMLVYEYMPNRSLDYFIFDPAKRAQLNWKKRLEIIEGIARGILYLHRDSRLRIIHRDLKVSNILLDEEMNPKISDFGMARIFGGNENEASTNRVVGTYGYMSPEYAMEGLFSFKSDVYSFGVLLLEIISGEKNIGFRTPEHSNLISHAWHHWNEGKAMELIDPCIRDMCYVDEALRCIQVGLLCVQDSARDRPLMSSVVLLLESETAGLPLPKPPRLTSIGGFLGSYSLGETTGLSIPIQPSLTSITGSIDTYSSFESQEIESWNS

SEQ ID NO: 935 - DNA, 2577 bp, Eucalyptus grandis
  Eucgr.E03669.1
atgcttggggcatttgtcaatggtggaatgcccttcaccggcaaaaacagagcaagtttcttccttttctccttgttttttgtgtcgttgtctctgctttcgtattctcatgcagcaaattcgatctcgcgcgggcagtctgtcagagacggcgagactctgatttcttcttctgggaaattcgaactggggttctttagccctgcgaattcatctcttagatatgttggtatttggtaccactttagtgttaaaaccgtcgtctgggttgcaaacagggagagcccagtttctggtgaatctggagttttcacagtttcaagtgatggaaatttgatggttttagacgggaataatcgcacagtttggtccagtggcagtaattcctccgctgtggccaccaacttaacagctgttctgaaggattctggaaatcttgttcttttggccggaacagatgccgactctgccagtgctgatggtgatatcagcaattcctattggcaaagcttcaaacacccgacagacacgtacttgcccggcatgagagtgagagtgaactctgtggctggagagaaccgtgccttcatgtcatggaagtcatcaaatgacccttcccctgggaactattccatgggcgtcgattcacagattccaccacagatagtgatctggggccagtcaggccgggaatggaggagcgggcattggattgggcagattttcaccggcgtgccaaatatgattggcgatattcgatatgggttcagtctcacaaccactgaggcggatggaagcatgtattttacgtacacaccatcaaataggtccaaactcttgatgttccgcatactttggaatgggacggaggagcaattaggctgggatgagactagtaatgagtggactgtgctgcaatcgcagcctgctaaggaatgtgacctctataataggtgtggagattttgcaatatgtaatgaaatggaccatcccaaatgtagttgcatgaaagggttcagtccaaagtcaccagatcaatggaacagtggtaactggtctgcgggttgtgctcggaagacccaattgcagtgtcgggacaacagcagctttacagcaggagatggtggtgggatggatggctttttggaattgcatggcgtgaagttaccggattttgcagagaatgtttcagcctcaaacagggatgagtgtgaggtaaagtgtcgggaaaattgttcgtgcaacgcttatgcttttggaagacgaatcgggtgcatgctgtggagcgagaatttgatagatgtacagcattttgcccagtgcggaatgaccgtccaaattcgtctcgccaagactgaattagaaacgaagagcaaaatatcgaacctgttcaaaataattactttcttggttggagcgttagttctcggtgtactggtatatttgttatggaggttcaaggacaatttgaaaggattctcgattttcaattggaaaaacaagagacttcccctgtctgatgatcttgttaggaacgacgagctatccgctgaattatccggaccagatggtcttgctagagatgccaagcaagtagggggagctgacataccggtgttcaaattcagttccatcgaagctgcgacgaacttcttttcggaagaaaacaagctcggactaggaggatttggtcctgtatacaagggaaagctttttggaggacaagaaatagccgttaagaggctttcaaggaagtcaagccaggggatcgaggaatttaagaatgaggttatgttaattgcaaagttacaacacagaaatcttgtgagactatttgggttctgcattaagggggaagataagatgcttatttatgagtacatgcccaacaggagcttggatcgttttattttcgatccagtgaagcgagtgcaattgaattggaagacacgttttgagattattgaagggatagcacgaggcctcctctatctccatcgtgactctagactaaggattatccaccgtgacctgaaagccagtaacattttattggatgaagaaatgaacccgaaaatatcagactttggcatggcgagaatttttggtacaaatgagaatgaagcgagtaccaatcgagtggttggcacatatggttacatgtctccagagtacgcgatggaaggtctattttcggtcaaatccgatgtctacagcttcggaatattattgctggagatcattactagcaagaaaaactttggctttcgcacactagaacattctagtctcatcgtctatgcttggcaccatttgaaagaagggaaggggatggagcttattgatccctgtatcagggacacgtgctctacggatgaggttttgcgatgcatacaagttggactgctgtgcgtgcaggactccgccccaaatagaccgaccatgccttccgttatgctgctattaaaaagcgaaacagtggatcttcccttcccgaaactacccaggtcaacctcgatcacgggctccacgggtacatgttctttgtttgaaagccaagaaattgagtcattgaat

SEQ ID NO: 936 - protein, 860 aa, Eucalyptus grandis
  Eucgr.E03669.1
MLGAFVNGGMPFTGKNRASFFLFSLFFVSLSLLSYSHAANSISRGQSVRDGETLISSSGKFELGFFSPANSSLRYVGIWYHFSVKTVVWVANRESPVSGESGVFTVSSDGNLMVLDGNNRTVWSSGSNSSAVATNLTAVLKDSGNLVLLAGTDADSASADGDISNSYWQSFKHPTDTYLPGMRVRVNSVAGENRAFMSWKSSNDPSPGNYSMGVDSQIPPQIVIWGQSGREWRSGHWIGQIFTGVPNMIGDIRYGFSLTTTEADGSMYFTYTPSNRSKLLMFRILWNGTEEQLGWDETSNEWTVLQSQPAKECDLYNRCGDFAICNEMDHPKCSCMKGFSPKSPDQWNSGNWSAGCARKTQLQCRDNSSFTAGDGGGMDGFLELHGVKLPDFAENVSASNRDECEVKCRENCSCNAYAFGRRIGCMLWSENLIDVQHFAQCGMTVQIRLAKTELETKSKISNLFKIITFLVGALVLGVLVYLLWRFKDNLKGFSIFNWKNKRLPLSDDLVRNDELSAELSGPDGLARDAKQVGGADIPVFKFSSIEAATNFFSEENKLGLGGFGPVYKGKLFGGQEIAVKRLSRKSSQGIEEFKNEVMLIAKLQHRNLVRLFGFCIKGEDKMLIYEYMPNRSLDRFIFDPVKRVQLNWKTRFEIIEGIARGLLYLHRDSRLRIIHRDLKASNILLDEEMNPKISDFGMARIFGTNENEASTNRVVGTYGYMSPEYAMEGLFSVKSDVYSFGILLLEIITSKKNFGFRTLEHSSLIVYAWHHLKEGKGMELIDPCIRDTCSTDEVLRCIQVGLLCVQDSAPNRPTMPSVMLLLKSETVDLPFPKLPRSTSITGSTGTCSLFESQEIESLNG

SEQ ID NO: 937 - DNA, 2577 bp, Eucalyptus grandis
  Eucgr.E03670.1
atgcttggggcatttgtcaatggtggaatgcccttcaccggcaaaaacagagcaagtttcttccttttctccttgttttttgtgtcgttgtctctgctttcgtattctcatgcagcaaattcgatctcgcgcgggcagtctgtcagagacggcgagactctgatttcttcttctgggaaattcgaactggggttctttagccctgcgaattcatctcttagatatgttggtatttggtaccactttagtgttaaaaccgtcgtctgggttgcaaacagggagagcccagtttctggtgaatctggagttttcacagtttcaagtgatggaaatttgatggttttagacgggaataatcgcacagtttggtccagtggcaataattcctccgctgtggccaccaacttaacagctgttctgaaggattctggaaatcttgttcttttggccggaacagatgccgactctgctagtgctgatggtgatatcagcaattcctattggcaaagcttcaaacacccgacagacacgtacttgcccggcatgagagtgagagtgaactctgtggctggagagaaccgtgccttcatgtcatggaagtcatcaaatgacccttcccctgggaactattctctgggcgtagatccccggaatccaccacagatagtgatctggggccagtcaggccgggaatggaggagcgggcattggattgggcagattttcaccggcgtgccaaatatgattggcgatattcgatatgggttcagtctcacaaccactgaggcggatggaagcatgtattttacgtacacaccatcaaataggtccaaactcttgatgttccgcatactttggaatgggacggaggagcaattaggctgggatgagactagtaatgagtggactgtgctgcaatcgcagcctgctaaggaatgtgacctctataataggtgtggagattttgcaatatgtaatgaaatggaccatcccaaatgtagttgcatgaaagggttcagtccaaagtcaccagatcaatggaacagtggtaactggtctgcgggttgtgctcggaagacccaattgcagtgtcgggacaacagcagcattacagcgggagatggtggtgggatggacggctttttgaaattgggttgcgtgaagttgccggattttgcagagtatgtttcagcctcaagcagggatgagtgtgaggtaaagtgtcagaaaaattgttcgtgcaacgcttatgcttttgcaggaggaaccagttgcatgctgtggagtgagaatttgatagacgtacagcattttgcccagagcagaatgaccgtccgaattcgtctcgccaagtctgaattagaaacgaagagcaaaatatcgaacctgttcaaaataattactttcttggttggagcgttagttctcggtgtactggtatatttgttatggaggttcaaggacaatttgaaaggattctcgattttcaattggaaaaacaagagacttcccctgtctgatgatcttgttaggaacgacgagctatccgctgaattatccggaccagatggtcttgctagagatgccaagcaagtagggggaactgacataccggtgttcaaattcagttccatcgaagctgcgacgaacttcttttctgaagaaaacaagctcggactaggaggatttggttctgtatacaagggaaacctttttggaggacaagaaatagccgttaagaggctttcaaggaagtcaagccaggggatcgaggaatttaagaatgaggttatgttaattgcgaagttacaacacagaaatcttgtgagactatttgggttctgcattaagggggaagataagatgcttatttatgagtacatgcccaacaggagcttggatcgttttattttcgatccagtgaagcgaatgcaattgaattggaagacacgttttgagattattgaagggatagcacgaggcctcctctatctccatcgtgactctagactaaggattatccaccgtgacctgaaagccagtaacattttattggatgaagaaatgaacccgaaaatatcagactttggcatggcgagaatttttggtacaaatgagaacgaagcgagtaccaatcgagtggttggcacatatggttacatgtctccagagtacgcgatggaaggtctattttcggtcaaatctgatgtctacagcttcggaatattattgctggagatcattactagcaagaaaaactttggctttcgcacactagaacattctagtctcatcgtctatgcttggcaccatttgaaagaagggaaggggatggagcttattgatccctgtatgagggacacgtgctctacggatgaggttttgcgatgcatacaggttggactgctgtgcgtgcaggactccgccccaaatagaccggccatgccttccgttatgctactattaaaaagcgaaacagtggatcttcccttcccgaaactacccaggtcaacctcgatcacgggctccacgggtacatgttctttgtttgaaagccaagaaattgagtcattgaat

SEQ ID NO: 938 - protein, 860 aa, Eucalyptus grandis
  Eucgr.E03670.1
MLGAFVNGGMPFTGKNRASFFLFSLFFVSLSLLSYSHAANSISRGQSVRDGETLISSSGKFELGFFSPANSSLRYVGIWYHFSVKTVVWVANRESPVSGESGVFTVSSDGNLMVLDGNNRTVWSSGNNSSAVATNLTAVLKDSGNLVLLAGTDADSASADGDISNSYWQSFKHPTDTYLPGMRVRVNSVAGENRAFMSWKSSNDPSPGNYSLGVDPRNPPQIVIWGQSGREWRSGHWIGQIFTGVPNMIGDIRYGFSLTTTEADGSMYFTYTPSNRSKLLMFRILWNGTEEQLGWDETSNEWTVLQSQPAKECDLYNRCGDFAICNEMDHPKCSCMKGFSPKSPDQWNSGNWSAGCARKTQLQCRDNSSITAGDGGGMDGFLKLGCVKLPDFAEYVSASSRDECEVKCQKNCSCNAYAFAGGTSCMLWSENLIDVQHFAQSRMTVRIRLAKSELETKSKISNLFKIITFLVGALVLGVLVYLLWRFKDNLKGFSIFNWKNKRLPLSDDLVRNDELSAELSGPDGLARDAKQVGGTDIPVFKFSSIEAATNFFSEENKLGLGGFGSVYKGNLFGGQEIAVKRLSRKSSQGIEEFKNEVMLIAKLQHRNLVRLFGFCIKGEDKMLIYEYMPNRSLDRFIFDPVKRMQLNWKTRFEIIEGIARGLLYLHRDSRLRIIHRDLKASNILLDEEMNPKISDFGMARIFGTNENEASTNRVVGTYGYMSPEYAMEGLFSVKSDVYSFGILLLEIITSKKNFGFRTLEHSSLIVYAWHHLKEGKGMELIDPCMRDTCSTDEVLRCIQVGLLCVQDSAPNRPAMPSVMLLLKSETVDLPFPKLPRSTSITGSTGTCSLFESQEIESLNG

SEQ ID NO: 939 - DNA, 2484 bp, Citrus clementina
  clementine0.9_002449m
atggacattatcagcaacagcaagcaccctgttagtgttattcttctttcattctttcttattgtatgttcacttgctcattttggccgtgcagtcaatacaattacaaaaggccagtcgatcaaagatggtgaaagcttgatttccaacggcaaaatctttgagctggggtttttcagccctgaaaattctagtctaaggtatgtgggtatatggtatcacaagattgatgaaaaagctgttgtttgggttgcaaacagaaacaggccaatttctgatgaaaggggaactctgacaattggtaatgatggcaatttgatggttttagatgggaatagcattgcggtttggtcatctaatgcttcagttgtgtcaaacaacacggcagcactactcgaggatgatggaaatcttatacttaccaacagcgaggacattggtaatcttggtaaggcctactggcagagttttaatcatccaacggatacgcatcttccaggcatgagagttggggtaaattccgcattgggagagaaccgtgttttcacttcctggaaatctgccagtgatccttctcccggaaacttcacaatgggtgttgatccccagggttcgccgcagattgtgatttgggagcagctaaaaaggcggtggagaagcggccaatggaattcagtcatattcaccggagttccaaccatggctactctaactagttttttatttggcttcaagctatctcccagggaatcagatggaagcatgtattttacatatgtcccagcaaatgcatcttatttgttgaggttcagaattggctgggatgggaatgaggagcagctaaggtgggatggtagtgcaaagaagtggtctgtgatgcaaaagcagcctgcagatgattgcgagctttataatttctgtgggaattttgggatctgtaatgcattgggttctaccaaatgcacttgtatggaaggatttgtaccaaaacattttgagcaatggacgatgggaaattggtcagctgggtgtgttaggaggactcaattgcagtgccagaggaatcgtagtgaagcaggggaaagtggaggagaagatgggtttaaagtgtttaagaatgtcaagttgccggattttgcagacgtagtgtcagtgggccaggaaacttgcaaagacaagtgtctgcagaattgttcttgtaatgcatacgccgacattcctgggattgggtgcatgttatggagaggggaattgattgatgttaagagttttgagaaaggtggcaatttactgcatgttcgtcttccagattctgagttaggtggcaggagtaaaatatccaatgctgtgatagctataattgtcgtgataggagcactcttactaggcgcatctgtatggctcttgtggaggttcagagcattgtgcaaagattcaacaatttcatgttgcaagaacaatgatactcaattaatagacatgggcaagagccaagaaatctcaacagatttttctggaccatctgacatggttgtggatggaagtcaaataaatggaacagacctaccaatgttcaattttaatactttagcagtcgcgacaaactacttttcagaaggaaacaaacttgggcgggggggatttggtcctgtccacaaggggaagcttcccgagggacaagatatagctgtaaagaggctttcaagaaaatctggccaaggtttagaggagtttaaaaacgagattatactgattgctaaactacaacaccgaaatcttgttagactactgggctgctgcattcaaggcgaagaaaagatgctgatttatgaatacatgccaaacaaaagtttggatttgtttatctttgacccggcaaagcaagcactactagactggacaaaacgcttcgcaattatcgaagggattgcaaggggtctactttatctacatcgagattcaagacttagaataattcatcgagatctaaaggccagcaacattctgctggatgaagatatgaatccgaagatttcagactttgggatggcccgaatatttggctttaaccaaaatgaagcaaatacaaatagagttgttggcacatatggctatatggctcctgaatatgcaatggaaggcctattctcagtaaagtcagatgtatatagctttggggcatggaatctttggaatgaaggcaaagcaatggaccttgttgatccaaatatccgggattcaagttctcaaaatcaggtgttgagatgcatacatgtgggaatgctatgcgtgcaagattctgcaatgtatagaccaacaatggcatccgtggtgctaatgcttgagagtgaaactccaacacttccggtgcccagacaaccaacatttacttcaatgagaagctctgtagatggtgatcattttatggaagctcatgatactgtatcctcaaatgatttgacagtaactatggtagtggggaga

SEQ ID NO: 940 - protein, 828 aa, Citrus clementina
  clementine0.9_002449m
MDIISNSKHPVSVILLSFFLIVCSLAHFGRAVNTITKGQSIKDGESLISNGKIFELGFFSPENSSLRYVGIWYHKIDEKAVVWVANRNRPISDERGTLTIGNDGNLMVLDGNSIAVWSSNASVVSNNTAALLEDDGNLILTNSEDIGNLGKAYWQSFNHPTDTHLPGMRVGVNSALGENRVFTSWKSASDPSPGNFTMGVDPQGSPQIVIWEQLKRRWRSGQWNSVIFTGVPTMATLTSFLFGFKLSPRESDGSMYFTYVPANASYLLRFRIGWDGNEEQLRWDGSAKKWSVMQKQPADDCELYNFCGNFGICNALGSTKCTCMEGFVPKHFEQWTMGNWSAGCVRRTQLQCQRNRSEAGESGGEDGFKVFKNVKLPDFADVVSVGQETCKDKCLQNCSCNAYADIPGIGCMLWRGELIDVKSFEKGGNLLHVRLPDSELGGRSKISNAVIAIIVVIGALLLGASVWLLWRFRALCKDSTISCCKNNDTQLIDMGKSQEISTDFSGPSDMVVDGSQINGTDLPMFNFNTLAVATNYFSEGNKLGRGGFGPVHKGKLPEGQDIAVKRLSRKSGQGLEEFKNEIILIAKLQHRNLVRLLGCCIQGEEKMLIYEYMPNKSLDLFIFDPAKQALLDWTKRFAIIEGIARGLLYLHRDSRLRIIHRDLKASNILLDEDMNPKISDFGMARIFGFNQNEANTNRVVGTYGYMAPEYAMEGLFSVKSDVYSFGAWNLWNEGKAMDLVDPNIRDSSSQNQVLRCIHVGMLCVQDSAMYRPTMASVVLMLESETPTLPVPRQPTFTSMRSSVDGDHFMEAHDTVSSNDLTVTMVVGR

SEQ ID NO: 941 - DNA, 2538 bp, Populus trichocarpa
  POPTR_0004s02690.1
atgatcagcaagagcataaacccagttcttgtttttctcttgtcggtctcttattccttgttgttcctagctcccttttgccatgctgcgaataatacactcacaataggccaatcactaaaagatggtgagtccttgatatcagttgatgagaactttgaactgggattctttagccctggaaactctagtttaagatattgtggtataaggtattacaagattcgggatcaggctgccatctgggtggctaatagagaaaaaccaatctccggtagcaatggagtcttgaggataggtgaagatgggaatttgttggttacagatggaaatggaagtccagtttggtcaagtaatacttcagtagtgtctaataacacagcagcgatgcttgatacaacaggtaatctaattctctcgagcaatgatagtattggtgagacagataaagcctattggcaaagcttcaataatccaaccgacacctatttgccacacatgaaagttcttataagttctgcagagattcatgccttcacttcatggaaatctgcaaatgatccttcaccaggaaacttcaccatgggagttgatcctcgcggagcaccacagatagtgatttgggagcgatcgaggagaaggtggagaagtgggcactggaatggactaatattctcaggtgttccatatatgacagctttaaccacttaccgatatggatttaaggtcactcgtgaaagcgatggaaatttttatttaacatacaatccatcagatagttctgaattgatgaggtttcagataacatggaatggatttgaagagcagaaaaggtggaatgaaagtgcaaagacgtggcaagtaatgcaatcacagccttctgaagaatgtgagaattacaattattgtggcaattttggagtctgtacttcatcaggatctccaaaatgcagatgtatggaagggtttgagccaaggcatccagatcagtggagactaggaaattggtcaggcggatgtggaagaaggtctcctttacagtgccagaggaacactagtagtggtggagaggatgggttcaaaacattaaggggctcgaagttgcctgattttgcagatgtggagtcgatctccttggatgcttgcagagaaatgtgtctaaataactgttcatgtaaggcatatgcgcacgtcagtcagattcaatgcatgatatggaatggggacttgattgatgtccagcattttgtcgaaggtgggaacactctgtatgtacgtctcgcagattctgaattaggtcgcaacaggatgcctacgtatgtgataatactaatagttttggctggactggccttcctagctatatctatatggcttctgtggatgctcaaaaaaagactcaaagcggctacctcagcttgcacgtcgtcaaaatgtgaattgccagtttatgatctgagtaaaagtaaagagtactcaaccgatgcttctggatctgctgaccttcttaaagaagggagccaagtaaatggttcagatttgccaatgttcaatttcaactgtttagcagctgcaacagacaatttttctgaagaaaacaagcttgggcagggaggatttggcctcgtctacaagggaacgcttcctggaggagaggaaatagctgtaaagaggctttcaaagatctctggccaaggtttacaggagttcaagaatgaaattattctgattgccaaattgcagcacaggaatcttgttcgattgttaggatgcagcattcagggtgatgagaagatgctcatttatgaatatatgccaaataaaagcctggattacttcctttttgatcccgagaagcaagctctattagactggagtaaacgtttcgcaattattgaggggattgccagaggtcttctttatctccatagggattcaagactaagaatcattcatcgggacctaaaggctagtaacattttgttggatgaagaaatgaacccaaagatttccgacttcggcatggccagaatatttgggggaaaccaaagtgaaataaacacaaaccgagttgtaggaacatatggttatatggcacctgaatatgcaatggaaggcctattttcagtgaagtctgatgtttatagctttggagtactactcctagagattgtgagtggccgaaggaatactagcttccgtcaaacagaacgcatgatcctcattgcttatgcatgggatctttggaatgaaggtaaagcaatggacatagttgatctttccatccgagattcatgtgatgaaaaggaagttctgagatgcatacaaatcggcatgttgtgtgtgcaagattctgcacttcatagaccaaacatggcatcagttgtggtaatgctggagagcagcacaacaagcattccattgcctaggcaacccactttcacttctgtcagagcctctatagaccctgaaatctctctggaagtgcaagaagtagcatcgtcaagcgacttgacagtgaaagtggtagcaggcaga

SEQ ID NO: 942 - protein, 846 aa, Populus trichocarpa
  POPTR_0004s02690.1
MISKSINPVLVFLLSVSYSLLFLAPFCHAANNTLTIGQSLKDGESLISVDENFELGFFSPGNSSLRYCGIRYYKIRDQAAIWVANREKPISGSNGVLRIGEDGNLLVTDGNGSPVWSSNTSVVSNNTAAMLDTTGNLILSSNDSIGETDKAYWQSFNNPTDTYLPHMKVLISSAEIHAFTSWKSANDPSPGNFTMGVDPRGAPQIVIWERSRRRWRSGHWNGLIFSGVPYMTALTTYRYGFKVTRESDGNFYLTYNPSDSSELMRFQITWNGFEEQKRWNESAKTWQVMQSQPSEECENYNYCGNFGVCTSSGSPKCRCMEGFEPRHPDQWRLGNWSGGCGRRSPLQCQRNTSSGGEDGFKTLRGSKLPDFADVESISLDACREMCLNNCSCKAYAHVSQIQCMIWNGDLIDVQHFVEGGNTLYVRLADSELGRNRMPTYVIILIVLAGLAFLAISIWLLWMLKKRLKAATSACTSSKCELPVYDLSKSKEYSTDASGSADLLKEGSQVNGSDLPMFNFNCLAAATDNFSEENKLGQGGFGLVYKGTLPGGEEIAVKRLSKISGQGLQEFKNEIILIAKLQHRNLVRLLGCSIQGDEKMLIYEYMPNKSLDYFLFDPEKQALLDWSKRFAIIEGIARGLLYLHRDSRLRIIHRDLKASNILLDEEMNPKISDFGMARIFGGNQSEINTNRVVGTYGYMAPEYAMEGLFSVKSDVYSFGVLLLEIVSGRRNTSFRQTERMILIAYAWDLWNEGKAMDIVDLSIRDSCDEKEVLRCIQIGMLCVQDSALHRPNMASVVVMLESSTTSIPLPRQPTFTSVRASIDPEISLEVQEVASSSDLTVKVVAGR

SEQ ID NO: 943 - DNA, 2508 bp, Populus trichocarpa
  POPTR_0004s02700.1
atggtcagcatgagcatgatcccagttcttgtttttctcttgtcggtctcttattccctgttgtttctagctcccttttgccatgctgccaataatacactcacaataggccaatcactaaaagatggtgagaccttgatatcagttgatgagaactttgaactgggattctttagccctggaaattctagtttaagatatgtcggtataaggtattacaagattcaggatcaggctgtcatctgggttgctaatagagaaaaaccaatctccggtagcaatggagtcttgaggataggtgaagatgggaatttgttggttacagatggaaatggaagtccagtttggtcgagcaatgcttcagtagtttctagtaacacagcagcgatgcttgatgttacaggtaatcttattctctcgagcaatgatagtattggtgagacagataaagcctattggcaaagcttcaataatccaaccgatacctatttgccacacatgaaagttcttgtaagtactgcagagattcatgtcttcacttcatggaaatctgcaaatgatccttcaccaggaaatttcaccatgggagttgatcctcgcggaacaccgcagatagttgtttgggagggatcgaggagaaggtggagaagtgggcactggaatggaataatattctcaggtgttccgtatatgaaagcttttaccacttaccaatatggatttaagttttctcctgaaagcgatggaaacttttatgttacatacaatccatcagataattctgaattcttgaggtttcagataacttggaatggatttgaagagacgaaaaagtggaatgaaagtgcaaagacgtggcaagtaattcaagcacaaccttctgaagagtgtgagaattacaattactgtggcaattttggagtctgtactccatcaggatctcccaaatgcagatgcatggaagggtttgagccaaggcatccagatcagtggagactaggaaattggtcaggcggatgtggaagaaggtctcctttacagtgccagaggaacactagtagtggtggagaagatgggttcaaaacagtaaggtgcatgaagttgcctgattttgcagatgtgaagtcgatctccttggatgcttgcagagaaatgtgtctaaataactgttcatgtaaggcatatgcgcacgtcagtgagattcaatgcatgatatggaatggagacttgattgatgttcagcattctgtcgaaggtggggacaccctgtacttgcgtctcgcagattctgaattagatcgcagcaggatgtctatgtatgtgataatactaatagttttggctggactggccttcctagccatatctatatggcttctgtggatgctcaaaaaaagactcaaagcggctacctcagcttgcacgtcgtcaaaatgtgaattgccagtttatgatctgagtaaaagtaaagagtactcaaccgatgcttctggatctgctgaccttcttaaagaagggagccaagtaaatggttcagatttgccaatgttcaatttcaactgtttagcagctgcaacagacaatttttctgaagaaaacaagcttggacagggaggatttggcctcgtctacaagggaaagcttcctggaggagaggaaatagctgtaaagaggctttcaaatatctctggccaaggcttactggaattcaagaatgaaattattctgattgccaaattgcagcacagaaatcttgttcgattattaggatgcagcattcagggtgatgagaagatgctcatttatgaatatatgccaaataaaagcctggattacttcctttttgatcccgagaagcaagctctattagactggagtaaacgtttcgcaattattgaggggattgccagaggtcttctttatctccatagggattcaagactaagaatcattcatcgggacctaaaggctagtaacattttgttggatgaagaaatgaacccaaagatttccgacttcggcatggccagaatatttgggggaaaccaaagtgaaataaacacaaaccgagttgtaggaacatatggttatatggcacctgaatatgcaatggaaggcctattttcagtgaagtctgatgtttatagctttggagtactactcctagagattgtgagtggccgaaggaatactagcttccgtcaaacagaacgcatgatcctcattgcttatgcatgggatctttggaatgaaggtaagacaatggagatagttgatccttccatccgagattcatgtgatgaaaacgaagtgctgagatgcatacaaatcggcatgttgtgtgtgcaagattctgcacttcatagaccaagcatggcatcagttgtggtaatgctggagagctgcacaacaaacattccattgcctagacaaccaaatttcacttctgtcagggcctctatagaccctgaaatttctctggaagtgcatgaagtagcattgtcaagc

SEQ ID NO: 944 - protein, 836 aa, Populus trichocarpa
  POPTR_0004s02700.1
MVSMSMIPVLVFLLSVSYSLLFLAPFCHAANNTLTIGQSLKDGETLISVDENFELGFFSPGNSSLRYVGIRYYKIQDQAVIWVANREKPISGSNGVLRIGEDGNLLVTDGNGSPVWSSNASVVSSNTAAMLDVTGNLILSSNDSIGETDKAYWQSFNNPTDTYLPHMKVLVSTAEIHVFTSWKSANDPSPGNFTMGVDPRGTPQIVVWEGSRRRWRSGHWNGIIFSGVPYMKAFTTYQYGFKFSPESDGNFYVTYNPSDNSEFLRFQITWNGFEETKKWNESAKTWQVIQAQPSEECENYNYCGNFGVCTPSGSPKCRCMEGFEPRHPDQWRLGNWSGGCGRRSPLQCQRNTSSGGEDGFKTVRCMKLPDFADVKSISLDACREMCLNNCSCKAYAHVSEIQCMIWNGDLIDVQHSVEGGDTLYLRLADSELDRSRMSMYVIILIVLAGLAFLAISIWLLWMLKKRLKAATSACTSSKCELPVYDLSKSKEYSTDASGSADLLKEGSQVNGSDLPMFNFNCLAAATDNFSEENKLGQGGFGLVYKGKLPGGEEIAVKRLSNISGQGLLEFKNEIILIAKLQHRNLVRLLGCSIQGDEKMLIYEYMPNKSLDYFLFDPEKQALLDWSKRFAIIEGIARGLLYLHRDSRLRIIHRDLKASNILLDEEMNPKISDFGMARIFGGNQSEINTNRVVGTYGYMAPEYAMEGLFSVKSDVYSFGVLLLEIVSGRRNTSFRQTERMILIAYAWDLWNEGKTMEIVDPSIRDSCDENEVLRCIQIGMLCVQDSALHRPSMASVVVMLESCTTNIPLPRQPNFTSVRASIDPEISLEVHEVALSS

SEQ ID NO: 945 - DNA, 2415 bp, Populus trichocarpa
  POPTR_0011s03790.1
atgatcaccatgagcaggagccctgttattgtttttttcttctccttgttgtttctagctccctcttgccatgctgcgactaatacgctaaccaaaggccaatcgattaaagatggtgaaaccttgatatctgttgatgaaaactttgagttgggattctttagccctggaaattccacttcaagatatgttggtgttaggtattccaagattcaggaccaggctgtcatctgggttgctaatagagacaaaccaatatctggtactgatggagtcttgaggataggtgaagatgggaatttgatggttgtagatggaaatggaagttcagtttggtcaagcaatgcttcatttgtgtctagtaacacaacattaatgcttgacactacaggcaatcttattctctcaagcaatgatagtattggtgacacagataaggcctattggcaaagcttcaataatcctacggatacgtatctgccaaacatgaaagttcttataggttctgcagagattcatgccttcacttcatggaaatctacaagcgatccttcaccaggaaacttcaccatgggagttgatcctcgcggagcaccacaaatagtggtttgggagcaatcgagaagaaggtggagaagtgggcattggaattcgcaaatattctcaggtgtgccatctatggcagcttctaccacttaccgatatggatttaaggtcactcctggaaacgatggaaagttttatttaacatacaatccatcagatccttctgaattgatgaagtttcaaataacttggaatgggtttgaagagcagaaaaggtggaatgaaagtacaaaggcgtggcaagtaatgcaatcacagccttctgaagagtgtgagaaatacaatcactgtggaaattttggagtctgtactccatcgggatctcccaactgcagatgtctagaagggtttcagccaaggcatccagatcagtggagactaggaaatttgtcaggaggatgtgagagaaggtctcctttacagtgccagaggaacactagtaatggtggagaagatgggttcaaagcagtaaggtgcacgaagttgcctgattttgcagatgtgtatcaattgtcctctgatgattgcaaaaaatggtgtcaaaataactgttcgtgtaaggcgtatgcgcacgtcactgggattcaatgcatgatatggaatggggacttgactgatgtccagaatcatatgcaaagtgggaacaccctgtacatgcgtctcgcgtattctgaattagctacctcagcttcaatgtcgacaaatcatgaattacaagtttatgatttgagcagaagtaaagagtatacaacagatctttctggacctggtgaccttgttttagaagggagccaagttaatggtccagatttgccaatgttcaacttcaactttgttgcagctgcaacaaacaatttttctgaagaaaataagcttgggcaggggggatttggccatgtttacaagggcaagcttcctggaggagaggaaatagcagtaaagaggctttcaaaaatctctggccaaggcttacaggagttcaagaatgaaattattctgattgccaaattgcagcatagaaatcttgttcgattattgggatgcagcattcagggtgatgagaagatgctgatttatgaatatatgccaaataaaagcctggattacttcctttttgaccctgagaagcaagggctattagagtggaataaacgtttcgaaataattgaagggatcgccagaggccttctttatctccatagagattcaagactacgaatcattcaccgggacctgaaggctagtaacattttgttggacgagggaatgaacccaaagatttcagacttcggcatggccagaatatttggggctaaccaaaatgaaataaacacaaacagagttgttggcacatacggttacatggcacccgaatacgccatggaaggcctattctcagtgaagtctgatgtttatagctttggagtattactgctagagattgtcagtggccgaaggaatactagcttccgtatgacagatcacgttatccttattgcttatgcatgggatctttggagtgaaggtaaagcaatggagatggttgatccttccatccgagattcatgtaacgaaaacgaagtgttgagatgcatacaactcggcatgttgtgtgtgcaagattctgcacttcatagaccaaacatggcatcagttgtactcatgctggagagcagcacaacaagcattccattgcctagggaacccacttttacttctgtcagagcctctatagatacagaaacttttatggaagcacaagaaatcacttcgtcgaatgacttgacagtttcaatggtagcaggcaga

SEQ ID NO: 946 - protein, 805 aa, Populus trichocarpa
  POPTR_0011s03790.1
MITMSRSPVIVFFFSLLFLAPSCHAATNTLTKGQSIKDGETLISVDENFELGFFSPGNSTSRYVGVRYSKIQDQAVIWVANRDKPISGTDGVLRIGEDGNLMVVDGNGSSVWSSNASFVSSNTTLMLDTTGNLILSSNDSIGDTDKAYWQSFNNPTDTYLPNMKVLIGSAEIHAFTSWKSTSDPSPGNFTMGVDPRGAPQIVVWEQSRRRWRSGHWNSQIFSGVPSMAASTTYRYGFKVTPGNDGKFYLTYNPSDPSELMKFQITWNGFEEQKRWNESTKAWQVMQSQPSEECEKYNHCGNFGVCTPSGSPNCRCLEGFQPRHPDQWRLGNLSGGCERRSPLQCQRNTSNGGEDGFKAVRCTKLPDFADVYQLSSDDCKKWCQNNCSCKAYAHVTGIQCMIWNGDLTDVQNHMQSGNTLYMRLAYSELATSASMSTNHELQVYDLSRSKEYTTDLSGPGDLVLEGSQVNGPDLPMFNFNFVAAATNNFSEENKLGQGGFGHVYKGKLPGGEEIAVKRLSKISGQGLQEFKNEIILIAKLQHRNLVRLLGCSIQGDEKMLIYEYMPNKSLDYFLFDPEKQGLLEWNKRFEIIEGIARGLLYLHRDSRLRIIHRDLKASNILLDEGMNPKISDFGMARIFGANQNEINTNRVVGTYGYMAPEYAMEGLFSVKSDVYSFGVLLLEIVSGRRNTSFRMTDHVILIAYAWDLWSEGKAMEMVDPSIRDSCNENEVLRCIQLGMLCVQDSALHRPNMASVVLMLESSTTSIPLPREPTFTSVRASIDTETFMEAQEITSSNDLTVSMVAGR

SEQ ID NO: 947 - DNA, 2526 bp, Solanum lycopersicum
  Solyc02g079570.2.1
atggccactggatttaccttcccccccttttggttcctgtttcttttcattctttcttgtttctcctcattctgtttaggtggtgacagagttacactaggagagatttataaagatggtgataaccttacttctaaaggaggggattttgtgttggggttctttagtcctgcaggtactagtaaaaggtatcttggtatatggtatgttgatataccagtaaagacatatatatgggttgccaacaggaacaagcttgttcatgataaaaatggtaccttttcaattgatacaattgggaatttggttgttaaagatggaaatggagatttactatggtcgtctaatgtttctgttcaaaccagaaattctacggcttgtctgagagacgacggcaatcttgtcatccttaataatgacagggatgctgcgaggttaaattctgaattatgggagagcttctcggatcctacagatacatatgtgcctggaatggaagttctcatagaaagacaaggcgagcaaaaagttttccgttcttggacaaatgagagtgacccttcacctgggaggtactcaatgggagttgatcctcgtggaacacctcagattattatttgggatggaccgaatagacgatggaggagtggacattttgatggagcggaattcattggtgttccagatgtgatcagaacaaattttttctctggtttcagaattctaaacgaaggagataataaattgttactcacttacagtgcctcaaatacatcttcttttctgaggtttcagcttactgtgactggaaatgagctgcaacagaggtggaacgaagacgagggtgaatggaacacgttacaatctaggccagtaggtggttgtgacttgtacaacttttgtgggaatttttcagaatgtaataaagaagtatgtcaatgtctagaaggatttgtaccaagtgttcaggaggagtggcatgctgggaaccgaactggaggatgtgttaggaagacagaattggaatgcaggaaaaatagcagtgtttcaaggaatgatagttcaaaagatgatggattctcgactattcggagagttaaattacctgaccatgctgatgttgcagaaataagcacagaagagtgcaaaatcaagtgcctgaatgattgttcctgcaatggttatgctcatgtcagaggaatcaattgtatggtatggcgtgatgatttagttgatatagagcattttgaggaaggtgggaacactctttatgttcgtcttcatccttctgatatcggtaaaaaaaagaagactatcataattgttgtaatatcaattctagcagctctggcgttggttgttatggtagccatttggctagtgtgcaagtacagggccagaaaacgagaatccaagaggaccagtgaaattcccaaaaaccatttagttaggagtggagagttctccatggaatattctggaccaggtgacatcagtgctgaagggcatcaaggaaatggttcagaattagcatttttcagcttcagcatggtggcgacagctactgacgacttctctcttgcaaacaagcttgggcaagggggattcggccccgtttacaagggaaagctaccttgtggtcaagaggttgctgtaaaaaggctttcacaaaagtctggacaaggtgatgaggagttcaagaacgagatcactctaatagcaaaattgcaacacagaaatcttgttagacttttaggttgctgtgttgaaggagaagaaaaaatgctgatttatgagtacatgcccaacaaaagcttagatacatttctatttgatactgctaggaaatccctgttagactggagaaaacgcttcaacattatcgaaggaattgcccgaggattactgtatctccatagagattcaaggcttagaataatccatagggatctaaaggctagtaacattctgttggatgaagaaatgaccccaaaaatttcagactttggcatggccagaatatttggaggaaaccaaaatgaagcaaatacaaatagggttgtaggaacatatggatatatggctcctgagtatgctatggaaggcctgttctctggcaagtctgatgtctacagctttggcataatattgcttgaaattatatgtggacggagaaatacaagctttcggacagatgagcattcaggcatcattggatatgcatgggagaagtgggatgaaggtagaccaatggacctggtggatcgttcaatttgggatggttgtcaacacaatgaagcattgagatgtatacacttggcattgctttgtgttcaagatttggcggctcacagaccaaacatgtcttctgtggttctgatgctggaaactgacaatgtaaggttgcccttgcctaggcaacctacctatacttcaatgagaagatctgtggatgaagatatatggcatgggaatcaggatttaacatcttccaacaatgtcacagttagtgtactaataggtaga

SEQ ID NO: 948 - protein, 842 aa, Solanum lycopersicum
  Solyc02g079570.2.1
MATGFTFPPFWFLFLFILSCFSSFCLGGDRVTLGEIYKDGDNLTSKGGDFVLGFFSPAGTSKRYLGIWYVDIPVKTYIWVANRNKLVHDKNGTFSIDTIGNLVVKDGNGDLLWSSNVSVQTRNSTACLRDDGNLVILNNDRDAARLNSELWESFSDPTDTYVPGMEVLIERQGEQKVFRSWTNESDPSPGRYSMGVDPRGTPQIIIWDGPNRRWRSGHFDGAEFIGVPDVIRTNFFSGFRILNEGDNKLLLTYSASNTSSFLRFQLTVTGNELQQRWNEDEGEWNTLQSRPVGGCDLYNFCGNFSECNKEVCQCLEGFVPSVQEEWHAGNRTGGCVRKTELECRKNSSVSRNDSSKDDGFSTIRRVKLPDHADVAEISTEECKIKCLNDCSCNGYAHVRGINCMVWRDDLVDIEHFEEGGNTLYVRLHPSDIGKKKKTIIIVVISILAALALVVMVAIWLVCKYRARKRESKRTSEIPKNHLVRSGEFSMEYSGPGDISAEGHQGNGSELAFFSFSMVATATDDFSLANKLGQGGFGPVYKGKLPCGQEVAVKRLSQKSGQGDEEFKNEITLIAKLQHRNLVRLLGCCVEGEEKMLIYEYMPNKSLDTFLFDTARKSLLDWRKRFNIIEGIARGLLYLHRDSRLRIIHRDLKASNILLDEEMTPKISDFGMARIFGGNQNEANTNRVVGTYGYMAPEYAMEGLFSGKSDVYSFGIILLEIICGRRNTSFRTDEHSGIIGYAWEKWDEGRPMDLVDRSIWDGCQHNEALRCIHLALLCVQDLAAHRPNMSSVVLMLETDNVRLPLPRQPTYTSMRRSVDEDIWHGNQDLTSSNNVTVSVLIGR

SEQ ID NO: 949 - DNA, 2502 bp, Solanum lycopersicum
  Solyc10g005440.1.1
atggctagttgtatgattatttccaactggtacattttcttgtttagtgttttttatatgaacttattatgttgtgcttgtgcatctagtaaaattatacaaggtgaaattttaagagatggtgaaatgttaatttctccaaaaaggaaatttattttgggattttttagtccaaatgttactaataatcaaaggtttgttggtatatggtatgttgatggtccagaaaattcatttgtttgggttgcaaacagagataaaccaatttttgataaaaatggtgtttttactattgagaaaaatggtaatttggtggtgaaaaatggtcatggcgatataatgtggacgagtaatgttgaagctattagtaataattgtacagcacttctttctgattatggtaatcttgtgttgtttaatagcaataacaaggtgttgtggcagagttttcagcatcctacagatacatttttaccagaaatgaaattttatacagatgaagttttgaggtcatggaccagtgaaagtgatccttcaactggaaggtactcattaggagtaacttctcacggatcaccacaaattgtgatctgggatggaggtaacaaacgttggcggagtggatactgggatggacgcatattcacaggtgttatcgatatgaagcccgagtttctacatggtttcaagcttaacaatgaaggagacaatctatacttcacttacactgtatcaaatacttctgatttggtgaggttccatattagtccaacgggatatgaggtggagcaaaggtgggataaagataacaacaagtggagtatagtacagtctcatccatcgggtgattgtgacttgtataacttatgtgggaatttcgcgatgtgtgatgtcacatattttgaaaaatgcatttgtttaggtggatttgtaccgaaagatttggggcagtggaatgcggggaactggtcagaagggtgtgttaggaggaaagaagtggaatgcagaggaaataacagtgtgttgaagagtggtagtgaaaagaaggacagattctatggggttgagaaaatcaagttgcctgattttgctgatactgcagatgtactaaatatcgatgagtgtcgaagcatgtgccttgaaaattgttcatgtactgcttatgcttttgttagcggaattgattgcatgatgtggagtggagatttagtcgatatgcagcagtttcaggaaggcggatacactctctatgttcgccttgatagttctgaatttgatggaagcaacagggcagttaaaattgtggtaatatctgttatggtagtcggggcttttcttgtttgtatggtagtttttctactatgcaggcacaaagccaaaacgcgagcgtccaataggatcaaccaaatggagacagtcgatccaactaggagcggagagttttctatggacacatcagtagcaggagacatgactattgaagggcatcaaggaagtggttcagaacttattttcttcagtttcagcggtgtagcagcagctaccgataacttttctaacgaaaacaagctaggacaaggtggatttggccctgtctacaagggaaaactactatgtggcgtagaaattgcagtgaagagactttcaagaaaatcaggacaaggtgtggaggaattcaagaatgagatcagactaatcgccaaattacaacatagaaatcttgttagacttttgggatgctgcattgaaggagaagaaaagatgcttctttacgagtacatggccaacagaagcttagattcgtttctatttgatactgttaagcaagttcaattagactggaggaaacgcttcaacattattgaagggattgcacgagggctattgtatctccatagagattcgcgactcagaataatccatagggatttaaaggctagtaacattttgctagatgaagagatgaacccgaaaatatcagattttggtatggctagaatatttggtggaaatgaaaatgaagcaaatacaattagagtagttgggacatacggatatatggctcctgaatatgcaatggaaggcttgttctccggaaaatctgatgtttatagctttggtgtactattgctggagatcatctgtggacggaggaacacaagctttcgttcagatgaacactctggcattattggttatgcatggcagaagtgggatgaaggtacgccaatggacttaatagaccgttctatttgggacgagtgtcaacatgatgaagcattgagatgtatacagttagcactaatttgtgtacaagacatggcagttcacagaccgagcatatcatccatcgtgttaatgttggagacggacaatataccattgcccttgcctaggcaacctacgtatacctcaatgcgaaaacatgaagatgcagaaacatggaatgagaagcaggatttttctgcaaacaatgttacaattagtgttatagctggtaga

SEQ ID NO: 950 - protein, 834 aa, Solanum lycopersicum
  Solyc10g005440.1.1
MASCMIISNWYIFLFSVFYMNLLCCACASSKIIQGEILRDGEMLISPKRKFILGFFSPNVTNNQRFVGIWYVDGPENSFVWVANRDKPIFDKNGVFTIEKNGNLVVKNGHGDIMWTSNVEAISNNCTALLSDYGNLVLFNSNNKVLWQSFQHPTDTFLPEMKFYTDEVLRSWTSESDPSTGRYSLGVTSHGSPQIVIWDGGNKRWRSGYWDGRIFTGVIDMKPEFLHGFKLNNEGDNLYFTYTVSNTSDLVRFHISPTGYEVEQRWDKDNNKWSIVQSHPSGDCDLYNLCGNFAMCDVTYFEKCICLGGFVPKDLGQWNAGNWSEGCVRRKEVECRGNNSVLKSGSEKKDRFYGVEKIKLPDFADTADVLNIDECRSMCLENCSCTAYAFVSGIDCMMWSGDLVDMQQFQEGGYTLYVRLDSSEFDGSNRAVKIVVISVMVVGAFLVCMVVFLLCRHKAKTRASNRINQMETVDPTRSGEFSMDTSVAGDMTIEGHQGSGSELIFFSFSGVAAATDNFSNENKLGQGGFGPVYKGKLLCGVEIAVKRLSRKSGQGVEEFKNEIRLIAKLQHRNLVRLLGCCIEGEEKMLLYEYMANRSLDSFLFDTVKQVQLDWRKRFNIIEGIARGLLYLHRDSRLRIIHRDLKASNILLDEEMNPKISDFGMARIFGGNENEANTIRVVGTYGYMAPEYAMEGLFSGKSDVYSFGVLLLEIICGRRNTSFRSDEHSGIIGYAWQKWDEGTPMDLIDRSIWDECQHDEALRCIQLALICVQDMAVHRPSISSIVLMLETDNIPLPLPRQPTYTSMRKHEDAETWNEKQDFSANNVTISVIAGR

SEQ ID NO: 951 - DNA, 1998 bp, Arabidopsis thaliana
  AT4G11470.1
atgtgtttgaacactctctgtgcaatcctctgttttgtccttaccgttagtttcggcttcgtctctgcccaaaaatgcggggagtctgtgtttttcagacctaacggtaactatgacactaaccgtcgtctcgttctatcaacgttagcttccaacgtcagttctcaaaacaaccgcttctacaacgtttcggtcggtgaaggagctggaagaatctatgccttaggtctctgtatcccagggtctgatccaagggtgtgttccgattgtatccaactcgcgtctcaaggtttattacaaacctgtccgaaccagaccgactcattctactggacaggcgacaacgccgacaagacgctctgtttcgttcgttactctaacaactcgtttttcaacaagatggctctagagccaactcacgcagtttacaatactatgaggttccaagggaacctcacagcttatacaagaacatgggacgcgttcatgaactttatgttcacccgagtcggtcaaactcgatacctggctgatatatcccctcggataaatcaggaacctttgtctcctgatcttatatacgcgctgatgcagtgtattccggggatatcttctgaagactgtgaaacctgtcttggaaaatgtgtcgatgactaccagagttgctgcaatgggttcataggtggagtcgttaacaagccggtctgctatttccggtgggatggttataaatattatggtgccttcggtgatgaagcgccatctcaaccccccacgccgcttcctcttcctcctcctcctcctcgtgatccagatggaaaaaagatctctacaggagttattgtggctattgttgtttccgcagttatcttcgtggtgctagtcgctttaggattagttatttggaagcgaagacaatcatacaaaacactgaaatatcatactgatgatgatatgacaagtccacagtctctgcaatttgattttacaacaattgaagtggcaacagataatttttcgaggaacaacaagctaggtcaaggcggattcggtgaagtttacaagggaatgttacctaatgaaacagaaattgcggtaaagcgtctatcgagtaattcaggacaaggcacacaagagttcaagaacgaggttgtgattgtggccaaacttcaacacaagaatcttgttaggcttcttgggttttgcatagaaagagatgaacagatacttgtctacgagtttgtttccaacaagagccttgattatttcctctttgatccaaaaatgaaaagtcaactagattggaaaagacggtacaacatcataggaggggttacgcgaggacttctctatcttcatcaagactcaaggctaacaatcatacaccgtgacatcaaagcaagtaacatacttttagatgctgatatgaaccctaaaatagctgattttggaatggcaaggaattttagagtggaccaaactgaagaccagacaggaagagttgttggaaccttcggttacatgcctccagagtatgtgacacatggccaattctctaccaaatctgatgtatatagctttggtgtattgatcttggagattgtttgtggcaagaagaacagcagcttctttcagatggatgattctgggggaaatttagtgacacatgtttggaggctttggaacaatgattcacccttagatctcatcgaccctgcgattaaggaaagctacgataatgatgaagtcattagatgtatccatatcggaattttatgtgttcaagaaactccggcagatcgtccagagatgtctacaatctttcaaatgcttaccaatagctccattactctgcctgtgcctcgaccacctggatttttcttcaggaacagacccaatttagaccccttaacctatggatccgagcaggggcaatccagcagcatgtctgttcctttttctatagatagtgcgtcaatcactagagccactcctcgg

SEQ ID NO: 952 - protein, 666 aa, Arabidopsis thaliana
  AT4G11470.1
MCLNTLCAILCFVLTVSFGFVSAQKCGESVFFRPNGNYDTNRRLVLSTLASNVSSQNNRFYNVSVGEGAGRIYALGLCIPGSDPRVCSDCIQLASQGLLQTCPNQTDSFYWTGDNADKTLCFVRYSNNSFFNKMALEPTHAVYNTMRFQGNLTAYTRTWDAFMNFMFTRVGQTRYLADISPRINQEPLSPDLIYALMQCIPGISSEDCETCLGKCVDDYQSCCNGFIGGVVNKPVCYFRWDGYKYYGAFGDEAPSQPPTPLPLPPPPPRDPDGKKISTGVIVAIVVSAVIFVVLVALGLVIWKRRQSYKTLKYHTDDDMTSPQSLQFDFTTIEVATDNFSRNNKLGQGGFGEVYKGMLPNETEIAVKRLSSNSGQGTQEFKNEVVIVAKLQHKNLVRLLGFCIERDEQILVYEFVSNKSLDYFLFDPKMKSQLDWKRRYNIIGGVTRGLLYLHQDSRLTIIHRDIKASNILLDADMNPKIADFGMARNFRVDQTEDQTGRVVGTFGYMPPEYVTHGQFSTKSDVYSFGVLILEIVCGKKNSSFFQMDDSGGNLVTHVWRLWNNDSPLDLIDPAIKESYDNDEVIRCIHIGILCVQETPADRPEMSTIFQMLTNSSITLPVPRPPGFFFRNRPNLDPLTYGSEQGQSSSMSVPFSIDSASITRATPR

SEQ ID NO: 953 - DNA, 1968 bp, Arabidopsis thaliana
  AT4G11480.1
atgtgtctgcaaaatctcttgtcaatcctctgttttgtcctcgccattagcttcggctacgtgtctgcacaaaaatgcgtggattcaatgtttttcagacccaacggtacttatgacacaaaccgtcatctcattctctcaaaccttgcttccaacgtgagttctcgagacggctactacaacggttctgtcggtgaaggccctgatagaatctatgcgttaggtctctgtatcccagggactgatccaaaggtctgtgatgattgtatgcaaatcgcatctacgggtatattacaaaactgcccgaaccagaccgactcatacgactggagatcccagaaaacactctgtttcgttcgttactccaacagctcgtttttcaacaaaatggatctagagccgacaatggttataggagatctaaatagtggactattccaaggggaccttgcagcttatacaagaacatgggaggagttcatgaactctatgatcaccagagtcggtcgaactcgttacctggccgatatatcccctcggataggttctgctcgtatatatgcgctgatgcaatgtattcgagggatatcctctatggaatgtgaaacttgtattcgagataatgtgcgtatgtaccagagttgctgcaatgggttcataggaggaactattcgcaagccggtctgctttttcaggtgggatggttctgaatatcttggtgcctttggtgacacgccatcgctacctccaccatctccagatgggaaaacaatatctacgggagctattgttgcagttgttgtctccgtggttatatttgtagtgctgctcgctttagtattggtcatacggaagagaagacaatcgtacaaaacactaaaacctaaaactgatgatgacatgacaagtccacagtctctgcaatttgattttatgaccctcgaagcggcaactgataaattttcgaggaataacaagctaggtaaaggtgggtttggtgaagtttacaagggaatgttaccaaacgaaacagaagttgcggtgaagcggctatcgagtaattcaggacaaggcacacaagagttcaagaacgaggttgtaattgtggctaagcttcaacataagaatcttgttaggcttcttgggttttgcttagaaagagatgaacagatacttgtctacgagtttgttcccaacaagagccttaattatttcctctttggtaataaacaaaaacacttacttgatccaaccaagaagagtcagctagattggaaaagacggtacaacatcataggagggattacgcgagggcttctctatcttcatcaagactcgcggctaaccatcatacaccgtgacatcaaagcaagtaacattcttttagatgctgatatgaaccctaaaatagcggattttggaatggcaaggaattttagagtggaccaaactgaagacaatacaagaagagttgttggaactttcggttacatgcctccagagtatgtgacgcatggccagttctctaccaaatctgatgtttatagctttggagtattgattctggagattgtttgtggcaagaagaacagcagcttctataagatagatgattctggtggcaatttggtgacacatgtttggcggctttggaacaatgactcacctttagatctcatcgaccctgcgattgaggaaagctgcgataatgataaagtcataagatgtatccatatcggacttttatgtgttcaagaaactcctgtagatcggccagagatgtctacaatatttcaaatgcttactaatagctccattactctgcctgtgcctcgaccacctggatttttcttcaggaacagatccaatttagaccctttaacttatggatccgagctggggcaatcgagcagcaaatctattccttatactatagatagtgcgtcaatcactagagtcactcctcgg

SEQ ID NO: 954 - protein, 656 aa, Arabidopsis thaliana
  AT4G11480.1
MCLQNLLSILCFVLAISFGYVSAQKCVDSMFFRPNGTYDTNRHLILSNLASNVSSRDGYYNGSVGEGPDRIYALGLCIPGTDPKVCDDCMQIASTGILQNCPNQTDSYDWRSQKTLCFVRYSNSSFFNKMDLEPTMVIGDLNSGLFQGDLAAYTRTWEEFMNSMITRVGRTRYLADISPRIGSARIYALMQCIRGISSMECETCIRDNVRMYQSCCNGFIGGTIRKPVCFFRWDGSEYLGAFGDTPSLPPPSPDGKTISTGAIVAVVVSVVIFVVLLALVLVIRKRRQSYKTLKPKTDDDMTSPQSLQFDFMTLEAATDKFSRNNKLGKGGFGEVYKGMLPNETEVAVKRLSSNSGQGTQEFKNEVVIVAKLQHKNLVRLLGFCLERDEQILVYEFVPNKSLNYFLFGNKQKHLLDPTKKSQLDWKRRYNIIGGITRGLLYLHQDSRLTIIHRDIKASNILLDADMNPKIADFGMARNFRVDQTEDNTRRVVGTFGYMPPEYVTHGQFSTKSDVYSFGVLILEIVCGKKNSSFYKIDDSGGNLVTHVWRLWNNDSPLDLIDPAIEESCDNDKVIRCIHIGLLCVQETPVDRPEMSTIFQMLTNSSITLPVPRPPGFFFRNRSNLDPLTYGSELGQSSSKSIPYTIDSASITRVTPR

SEQ ID NO: 955 - DNA, 2100 bp, Arabidopsis thaliana
  AT4G11460.1
atgcgtcaaaataatctcttctcattgatcttctggcttgtccctgtgagcttaattattgttgtctctgcacagttatgctcggagaagtttggaacttttacaccaggtggtacatttgacaagaaccgccgaatcattctctcatctcttccatctgaagtcacagctcaagatggcttctacaacgcttcgattggaacagatcctgaccaactctacgcaatggggatgtgcatcccaggtgctaaacaaaagctttgtagggattgtatcatggacgtcacaagacagttaatacagacatgtcccaaccagacagcagcaattcactggtcaggtggagggaaaactgtatgtatggcacgttactataaccagccgtcttctagaccattggatttggaatcagtttctattggttataacgttggaaatctcagcacaaacttaacagattttgatagattatgggagcgattgatagctcatatggtgactaaagcttcatcagcatcaataaaatatttatcatttgataacagtagattctatgcagctgatgaaacaaacttgacaaattctcaaatggtctacgctttgatgcaatgcacgccagacgtctctccttccaactgtaacacttgtttaaaacaaagtgttgatgactatgttggttgttgtcatgggaagcaaggcggctatgtgtatcggcctagttgcattttccggtgggatctataccctttcaatggcgcctttgatcttcttacgctagcgcctccaccctcatctcagctgcaatccccacctccagtgaccaacaaagatgaaaaaacgattcatacaggaactatcattgggattgtcattgtcgttgcaatggtcataatcatggctctgcttgctctaggggtttctgtttgcaggagtagaaaaaaatatcaagcttttgcctcagaaactgccgatgatattacaacagttggatatctccagtttgatattaaagacattgaagctgcaacaagtaactttttggcgagtaacaagattggtcaaggtggtttcggcgaagtttacaagggtacgttatcaaatggaactgaagttgcagtcaagaggctgtcaagaacttcagatcaaggtgaattggagttcaagaacgaggtgcttcttgtagcaaaacttcagcaccggaatctcgttaggcttctcggttttgctctgcaaggagaagaaaagatactcgtctttgagtttgttcccaacaagagcctcgattatttcctcttcggtagtactaacccaacaaaaaagggtcagctggactggacaagacggtacaacatcattggagggattacacgagggcttctctatcttcatcaagactctaggctcaccatcatacaccgtgacatcaaagcgagtaacattcttttagatgctgatatgaacccgaaaatagcggatttcgggatggctaggaatttcagagatcatcaaactgaagacagtacaggaagagtcgttggaaccttcggttacatgcctccagaatatgttgcgcatggccaattctctaccaaatccgatgtctatagcttcggagtattgattctagagattgttagtggcaggaagaatagcagcttctatcagatggatggttctgtttgcaacttggtcacatatgtttggagactttggaacactgattcatctttagagctcgtagatccggcgattagcggaagctatgagaaagatgaagtcactagatgcatccatatcggacttttatgcgttcaagaaaatcctgtgaatcgaccagcattgtctacaatattccaaatgctcactaatagctccattactctaaatgtccctcaaccacctggatttttcttcaggaacagacctgagtcagacacattacgccgtggattggagccagaccaatataacaatgaatctgttacttgttctatcgacaatgcaacaatcactacactcctcggtaaaactcttgcttctgcactctgttgtattacctcaactctattttcaaagtcaatgtatagaaacactgaggat

SEQ ID NO: 956 - protein, 700 aa, Arabidopsis thaliana
  AT4G11460.1
MRQNNLFSLIFWLVPVSLIIVVSAQLCSEKFGTFTPGGTFDKNRRIILSSLPSEVTAQDGFYNASIGTDPDQLYAMGMCIPGAKQKLCRDCIMDVTRQLIQTCPNQTAAIHWSGGGKTVCMARYYNQPSSRPLDLESVSIGYNVGNLSTNLTDFDRLWERLIAHMVTKASSASIKYLSFDNSRFYAADETNLTNSQMVYALMQCTPDVSPSNCNTCLKQSVDDYVGCCHGKQGGYVYRPSCIFRWDLYPFNGAFDLLTLAPPPSSQLQSPPPVTNKDEKTIHTGTIIGIVIVVAMVIIMALLALGVSVCRSRKKYQAFASETADDITTVGYLQFDIKDIEAATSNFLASNKIGQGGFGEVYKGTLSNGTEVAVKRLSRTSDQGELEFKNEVLLVAKLQHRNLVRLLGFALQGEEKILVFEFVPNKSLDYFLFGSTNPTKKGQLDWTRRYNIIGGITRGLLYLHQDSRLTIIHRDIKASNILLDADMNPKIADFGMARNFRDHQTEDSTGRVVGTFGYMPPEYVAHGQFSTKSDVYSFGVLILEIVSGRKNSSFYQMDGSVCNLVTYVWRLWNTDSSLELVDPAISGSYEKDEVTRCIHIGLLCVQENPVNRPALSTIFQMLTNSSITLNVPQPPGFFFRNRPESDTLRRGLEPDQYNNESVTCSIDNATITTLLGKTLASALCCITSTLFSKSMYRNTED

SEQ ID NO: 957 - DNA, 2070 bp, Arabidopsis thaliana
  AT4G23290.2
atgcaaaagaacaaaatggtcgacttgcgagcaatcttctggtttgtggtcataagctcttgtgctgtcgctgcaccaacctgcattcagagatctgattttttcaaagccaatggtccttacgacataaacctccgagccatgctctcgtctcttccttctcgtgtcaaggataatgaaggcttctacaagactccgttcaagcccggtccaaacatagcacatggtctggggatgtgtagccgaggtactacaacacaggattgttcggattgtatcacgagtgtatctcataccttgctacacacatgtcctaatcaggcagaagctatagactggagttctggagactcgctttgtttggtacgctactcaaaccacttgattaatggatcgctcgacgaagacataatatgggcagagtatattgagtacaaatataacacatcgttcggccaaaccaacttgacggagtttaaatctacatggcaggctttgatggatcgtgtgataaacaaagttgatggttcattgtacgccaacagcatacaagagctcgggtcgttcccgttcaggagcatttatgccatcgcgcaatgcaataaagacctaaccaagttgaactgcgagaaatgtttacaacatcttaggatagataataggtcatgctgccgggggatacaagtaggctatattgcaaggaccagctgtttcatgcgatgggatctacagccattcttgggactattcataaatgggatgttaccaactcccccttctgaattagataatggtcactctaacacaaccaagaaagatggcaaaaatatatctacaggatctattgtggcaattgcggttgtttccgtcgtcgtgagcactgtactgcttgctcttggatacgctgtttctaggaggagaaaagcttaccaatcatttgcaagtgaaaatgggtatttctctgtttcaagaagacctaggaggccttatggtactgcatcaccagatgatgctacggatgatcttacagcgtcctcaggttcgcttcgattcgattttagagcaataaaagctgcaacaagtaattttcataagagtaacaagcttggtcatggtggatttggtgcagtttacaagggtatgtttccgaatggaacagaagttgctgccaagagactatctaaaccatcagatcaaggtgagccagagttcaagaacgaggtgcttcttgtagcaagacttcagcataaaaatcttgttggacttctcgggttttcggttgaaggagaagagaagatactagtttacgagtttgttcccaacaaaagtctcgatcatttcctttttgacccgataaaaagggttcaactggattggccaagacgacacaacattatcgagggaatcactcgaggaattctctatcttcatcaagattcacggctcacaatcatacaccgtgacctcaaagccagcaacattctcttagatgccgagatgaatccaaaaatagctgattttggtctggctaggaatttcagagttaatcaaaccgaagcaaatacaggaagagtagttggcacattcggttacatgccacctgagtatgtggcaaatggacagttctcaacgaaatctgatgtgtatagctttggagtattaattctggagattattggtggcaagaagaatagtagcttccatcagatagatggttcagtaagcaacttggtcacacatgtttggaggcttaggaataatggatcgttgttggaacttgtagatccagccattggggagaattatgataaagatgaagtcattagatgcattcacattgggttattatgcgttcaagaaaatcctgacgatcgtccaagcatgtccacaatatttcgaatgctaactaatgtttcaattactctgcctgtgcctcaaccacctggatttttcttcagggaaagatccgagccgaacccattagccgagagattactgcctggtccgtctactagcatgtcttttacttgttcggtagatgatgcatcgatcacgagtgttagacctcgt

SEQ ID NO: 958 - protein, 690 aa, Arabidopsis thaliana
  AT4G23290.2
MQKNKMVDLRAIFWFVVISSCAVAAPTCIQRSDFFKANGPYDINLRAMLSSLPSRVKDNEGFYKTPFKPGPNIAHGLGMCSRGTTTQDCSDCITSVSHTLLHTCPNQAEAIDWSSGDSLCLVRYSNHLINGSLDEDIIWAEYIEYKYNTSFGQTNLTEFKSTWQALMDRVINKVDGSLYANSIQELGSFPFRSIYAIAQCNKDLTKLNCEKCLQHLRIDNRSCCRGIQVGYIARTSCFMRWDLQPFLGLFINGMLPTPPSELDNGHSNTTKKDGKNISTGSIVAIAVVSVVVSTVLLALGYAVSRRRKAYQSFASENGYFSVSRRPRRPYGTASPDDATDDLTASSGSLRFDFRAIKAATSNFHKSNKLGHGGFGAVYKGMFPNGTEVAAKRLSKPSDQGEPEFKNEVLLVARLQHKNLVGLLGFSVEGEEKILVYEFVPNKSLDHFLFDPIKRVQLDWPRRHNIIEGITRGILYLHQDSRLTIIHRDLKASNILLDAEMNPKIADFGLARNFRVNQTEANTGRVVGTFGYMPPEYVANGQFSTKSDVYSFGVLILEIIGGKKNSSFHQIDGSVSNLVTHVWRLRNNGSLLELVDPAIGENYDKDEVIRCIHIGLLCVQENPDDRPSMSTIFRMLTNVSITLPVPQPPGFFFRERSEPNPLAERLLPGPSTSMSFTCSVDDASITSVRPR

SEQ ID NO: 959 - DNA, 3105 bp, Arabidopsis thaliana
  AT4G23250.1
atggcaaagacgagttgtgaaataatcctctgtttcttcttcttcattttaagcttcagggtcatttctgtttctgcacaacaaacttgtgacaacactgctggtagtttcaaacccaatagtacttatgacaacaaccgtcgtctcctcctctctaccttcgcctctaacgtcacggctcagaacggctacttcaatggttcgttcgggcttggtacagacagagtctacgccatggggatgtgcgctccaggtgctgaacctgatgtttgctccaactgtattaagaacacagcagagggtttactacagatctgtctaaaccagacggacggtttctcatggtctggtgaagaaaccctttgccttgttcgttactctaacaaatccttctccgggctacttggcttggagccgtctaatgatttcttcaatgtaaacgaaataagaaaagaagaccagaaggaatttgatagtgtgtttgatgagttaatgtttcgtacaatccaaggagcatcttcatcggtgagaaacaattctaattcgttatcattgtctggtaaatattatgcaaaggatgtagctcctgaaccggtttacgggaacatatcggtggtgatgcaatgcactccagatgtttcttcaaaggattgtaatctttgtcttgagagaagtcttgatttctataagaaatggtacaatgggaagagaggcaccattatattgcggccaagttgctttttccggtgggaattgtatactttctttggtgcttttgatagtattaatgctagacacccaccgcctcctccacgcccgctttcaccgccccctttaaagacgccttctgtaaccaaccaaaccaatattaccaagaagaatgatagtagaatctcaggaggaactatcgcggcgatagtcgttgtagttgttgttacaataatattgattgttgtaggcttggttatatgcaagagaagaaagcaaaagcaagaaattgaacttccaacggaatctgttcagtttgatttaaagacaattgaagcagcaacgggcaacttttctgagcataacaagcttggtgcaggtggatttggtgaagtttacaagggtatgcttttgaatgggactgaaattgcggtaaaaagattgtcaaaaacatcaggacaaggtgaaatagagttcaagaacgaggtggttgttgttgcaaagcttcaacacataaatcttgttagacttctcgggttttcgctccaaggagaagagaagttactcgtctatgaatttgttccaaacaaaagtctcgattatttcctttttgaccctaacaagagaaatcagttggactggacagtgagacgcaacatcatcggtgggattactcgaggaattctatatcttcatcaagattcacggctcaaaatcatacatcgtgacctcaaagcgagtaacattctcttagatgcggatatgaacccgaaaattgctgatttcggaatggcaaggatctttggagtggaccaaactgtagccaataccgcaagagtagttggaacctttggttacatgtctcctgagtatgtgacacatggccaattctcaatgaaatcagacgtctatagttttggagtattgattcttgagatcattagtggcaaaaagaatagcagcttctatcagatggatggcttagttaacaatttagtcacatatgtctggaaactttgggagaacaaaacaatgcatgagctcatagatccctttattaaagaagattgtaaaagcgatgaagtcattagatacgttcatattgggctgttatgtgttcaagaaaatcctgcagatcgaccaacaatgtctacgattcaccaagtgctcacaaccagctcaattactctacctgtgcctcagccacctggatttttcttcaggaacggaccaggatcgaacccatcaagccagggaatggtgcctggtcaatcgagcagcaagtcttttactagttctgtagatgaagcaacaatcacccaacggaggagaaaatcgtaccgagaaattgatattcaatatagtccccacttgtcgtcaaacaatcttatgctcactagcaatatcctgaatttacacgttcctcaaccatcaagaacagatggcctcgacttctctatttcatctgcacaaaaatgcggaaaaactggtttatttaaacccaacgataagtatgatataaaccgtcacctcctcctttcttctctagcttctaatgtctcagctcgaggcggcttctacaatgcttcgattggacaaggacctgatcggttgtatgcttctgggacgtgtatccaaggttctgaaccagagctttgctcagcttgtatcgactctgcttttattagggtgataaagaaatgtcacaaccaaacagaagccctcgactggtcctcctttaacgaggagtatccttgtatgatacgttactccaaccgttctttttttggattacttgagatgacaccatttttcaagaattacaatgctacagatttccaagtcaacttgacagagttttatcaaaaatgggaggctttgatgcttggtgtgatagctgatgctatctcgtcgccaaacccaaaattctatggtgccggcactggaaaaattgggattcaaaccgtttacgctttcgtgctatgcagtaaggatatatctccatggaactgttccagatgtttaagagggaatgtggataactataagttgtcctgcagtgggaaacctcgtggccatagtttcagcccgagctgttatatgcgatgggatctctatcaattctatggatttattgagtatagggcttctcccacgcttcctcgtgaaaaaggtagaatctcagaactatctgacgatggcggaaagatttctacaagaaatatcctcggaatcactgttgctcttgccttttttatcacggtactgcttgttctagggtatgctctttctaggaggagaaaagcctaccaagagtttgcaactgaaaggaggtcaatgaccacttatggtactgcaccgccagatgatggtaagagactatacagctatttgcat

SEQ ID NO: 960 - protein, 1035 aa, Arabidopsis thaliana
  AT4G23250.1
MAKTSCEIILCFFFFILSFRVISVSAQQTCDNTAGSFKPNSTYDNNRRLLLSTFASNVTAQNGYFNGSFGLGTDRVYAMGMCAPGAEPDVCSNCIKNTAEGLLQICLNQTDGFSWSGEETLCLVRYSNKSFSGLLGLEPSNDFFNVNEIRKEDQKEFDSVFDELMFRTIQGASSSVRNNSNSLSLSGKYYAKDVAPEPVYGNISVVMQCTPDVSSKDCNLCLERSLDFYKKWYNGKRGTIILRPSCFFRWELYTFFGAFDSINARHPPPPPRPLSPPPLKTPSVTNQTNITKKNDSRISGGTIAAIVVVVVVTIILIVVGLVICKRRKQKQEIELPTESVQFDLKTIEAATGNFSEHNKLGAGGFGEVYKGMLLNGTEIAVKRLSKTSGQGEIEFKNEVVVVAKLQHINLVRLLGFSLQGEEKLLVYEFVPNKSLDYFLFDPNKRNQLDWTVRRNIIGGITRGILYLHQDSRLKIIHRDLKASNILLDADMNPKIADFGMARIFGVDQTVANTARVVGTFGYMSPEYVTHGQFSMKSDVYSFGVLILEIISGKKNSSFYQMDGLVNNLVTYVWKLWENKTMHELIDPFIKEDCKSDEVIRYVHIGLLCVQENPADRPTMSTIHQVLTTSSITLPVPQPPGFFFRNGPGSNPSSQGMVPGQSSSKSFTSSVDEATITQRRRKSYREIDIQYSPHLSSNNLMLTSNILNLHVPQPSRTDGLDFSISSAQKCGKTGLFKPNDKYDINRHLLLSSLASNVSARGGFYNASIGQGPDRLYASGTCIQGSEPELCSACIDSAFIRVIKKCHNQTEALDWSSFNEEYPCMIRYSNRSFFGLLEMTPFFKNYNATDFQVNLTEFYQKWEALMLGVIADAISSPNPKFYGAGTGKIGIQTVYAFVLCSKDISPWNCSRCLRGNVDNYKLSCSGKPRGHSFSPSCYMRWDLYQFYGFIEYRASPTLPREKGRISELSDDGGKISTRNILGITVALAFFITVLLVLGYALSRRRKAYQEFATERRSMTTYGTAPPDDGKRLYSYLH

SEQ ID NO: 961 - DNA, 1977 bp, Arabidopsis thaliana
  AT4G23260.1
atggcaacgaagagttgtgaattagtcctctgtttcttcgtctttttcgtcataagcttcagtgcaatttctgtttctgcacaaacttgtgacaatactactgggactttcatacccaatagtccttatgataagaaccgccgactcatcctctctactctagcttctaacgtcacggctcaggagggctacttcatcggttcgattgggattgctcctgaccaagtctttgccaccgggatgtgcgctccaggttctgagcgtgatgtttgctctctctgtatcaggtccacatcagagagtttactacaaagctgtctggaccaggcagatgctttcttctggtcaggtgaagaaaccctttgccttgttcgctacgctaaccgccccttctctggattgctcgtcatggatccactaggagcgatattcaacacaggagaactcaatacgaatcagactgtgtttgatatcgagtggaataatttaacttctagtatgatcgccggaataacttcttcttcatcaggggggaacaattcgtctaagtactactcagacgatatagctcttgtgccggattttaagaacatatcagcgttgatgcaatgcacaccagacgtttcgtcagaggattgtaacacttgcttacggcaaaacgttgtcgactatgataattgttgccgtgggcaccaaggcggcgttatgtcaaggccaaactgctttttccgatgggaagtgtatcccttctctggtgctattgatcagattaatttaccaaagtcaccgccgccttcagttacatccccgtctcctatagccaacataaccaagaatggaaatagaatatcaggaggaaaaatcgcagcaatagttgttgttactgttgttacaataatattggttgttttaggctttgttatttccaatagaagaaagcaaaagcaagaaatggatcttccaacggaatctgttcaatttgatttaaagacaattgaatcggcgacaagcaacttttccgaacgtaacaagcttggtaaaggtggattcggtgaagtttacaagggtatgctcatgaatggcactgaaattgcggtgaagagattgtcgaaaacatcaggacaaggtgaagtagagttcaagaacgaggttgttgttgttgcaaagcttcaacacataaatcttgttagacttctcgggttttcgctacaaggagaagagaagttactcgtctatgagtttgtttcaaacaaaagcctcgattatttcctctttgatcctacgaagagaaatcagttggactggacaatgcgacgcaatatcatcggtggcattactcgagggattttatatcttcatcaagattcgcggctgaagatcatacatcgtgacctcaaagcgagtaacattctcttagatgcggatatgaatccaaaaatcgctgatttcggaatggcaaggatctttggagtggaccaaactgttgccaatacaggaagagtggttggaacctttggttacatgtctcctgagtatgtgacacatggccaattctcaatgaaatcagacgtctatagttttggagtattgattcttgagatcattagtggcaaaaagaatagcagcttctaccaaatggatggcttagttaacaatttagtcacatatgtctggaaactttgggagaacaaatcattgcatgagctcttagatccctttatcaaccaagatttcacaagcgaggaagtcattagatacattcatattggactgttatgtgttcaagaaaatcctgcagatcgaccaacaatgtctacgattcaccaaatgctcacaaacagctcaatcactctgcctgtgcctctgcctcctggatttttctttaggaacggaccaggatcgaacccgggtcagtcgaacagcaagtcttttgcttgttctgtagatgaagcaacaatcacggacgttaatcctcgt

SEQ ID NO: 962 - protein, 659 aa, Arabidopsis thaliana
  AT4G23260.1
MATKSCELVLCFFVFFVISFSAISVSAQTCDNTTGTFIPNSPYDKNRRLILSTLASNVTAQEGYFIGSIGIAPDQVFATGMCAPGSERDVCSLCIRSTSESLLQSCLDQADAFFWSGEETLCLVRYANRPFSGLLVMDPLGAIFNTGELNTNQTVFDIEWNNLTSSMIAGITSSSSGGNNSSKYYSDDIALVPDFKNISALMQCTPDVSSEDCNTCLRQNVVDYDNCCRGHQGGVMSRPNCFFRWEVYPFSGAIDQINLPKSPPPSVTSPSPIANITKNGNRISGGKIAAIVVVTVVTIILVVLGFVISNRRKQKQEMDLPTESVQFDLKTIESATSNFSERNKLGKGGFGEVYKGMLMNGTEIAVKRLSKTSGQGEVEFKNEVVVVAKLQHINLVRLLGFSLQGEEKLLVYEFVSNKSLDYFLFDPTKRNQLDWTMRRNIIGGITRGILYLHQDSRLKIIHRDLKASNILLDADMNPKIADFGMARIFGVDQTVANTGRVVGTFGYMSPEYVTHGQFSMKSDVYSFGVLILEIISGKKNSSFYQMDGLVNNLVTYVWKLWENKSLHELLDPFINQDFTSEEVIRYIHIGLLCVQENPADRPTMSTIHQMLTNSSITLPVPLPPGFFFRNGPGSNPGQSNSKSFACSVDEATITDVNPR

SEQ ID NO: 963 - DNA, 1908 bp, Arabidopsis thaliana
  AT4G11490.1
atgagaaagaccaagaagatttcctttttgatcttctgggttgttctcataagcataattggtgctatttcttcgcaacaatgcaacgaaactgggtattttgaaccttggaaaacttacgacaccaaccgtaggcagatccttacatctcttgcttccaaagtggtggatcactacggcttctacaattcttccatcggcaaagttcctgacgaagtgcacgtaatggggatgtgcatcgacgggaccgaacctacggtttgctccgattgtctcaaggtcgcggccgaccaattacaagagaattgtcctaaccaaactgaagcgtatacatggacacctcataagacgctctgttttgctcgttactctaacagttcattcttcaagagggttggattgcacccactttacatggagcatagtaatgtggatatcaaatcaaatttgacatatttaaatacgatatgggaggctctaacggatcgtttgatgtctgacgcatcctcggattataatgcatcattatctagtcgtagatattatgcagctaatgtaacaaatctgacaaatttccagaatatatatgcattaatgctatgcactcctgatctagaaaaaggtgcttgtcacaactgtctggaaaaagctgtttctgaatatggcaaccttaggatgcaaagaggaattgttgcatggccaagctgctgttttcggtgggatctgtatcccttcatcggagcttttaatttgacactttcacccccgccaggtagcaaaaggaatatctcagttggattctttgtggccattgttgttgccaccggagttgtcatctctgtgctatctactttagtagtagtacttgtttgcagaaagagaaaaactgatcctccagaggaatcacctaaatattcactgcagtatgatcttaagacaattgaagctgcaacatgtaccttttcaaagtgcaacatgcttggtcaaggtggatttggagaagttttcaagggtgtgcttcaagacggatcagaaattgcagtgaagaggctgtcaaaagaatcagctcaaggtgtacaagagttccagaatgagactagtctcgtggcaaagcttcagcacagaaatttggttggagttctcgggttttgtatggaaggagaagaaaagatactcgtatacgaatttgttcccaacaaaagcctcgaccagttcttgtttgaacctacaaagaaaggccaactggattgggcgaaacggtacaagattattgttggaactgctagaggaattctatatcttcatcatgactcacccctcaaaatcatacaccgtgacctcaaagctagtaacatcctcttagatgctgaaatggaacccaaagtcgcagattttggaatggcaagaatttttagggtggatcaatctcgagcggatacaagaagggtagttggaacccatggctacatatctccagagtatttgatgcatggccagttctcggtgaaatctgatgtctatagttttggagtcttggttcttgagattataagtggaaaaagaaacagcaacttccatgaaactgatgaatccggaaagaatttggtcacatatgcttggaggcattggagaaacggatcaccattagagcttgtggattcagaactcgaaaagaattatcagagtaatgaagtcttcagatgcatccatatcgcgctattatgtgttcaaaatgatccagaacaacgtccgaatttatctactatcatcatgatgctcacaagtaactccatcactttaccggtgcctcagtcaccggtatatgagggaatggacatgtttctaccttctatcaaatctcttcctggttctgtcaacgattcattgattgatgacttagttcctcgc

SEQ ID NO: 964 - protein, 636 aa, Arabidopsis thaliana
  AT4G11490.1
MRKTKKISFLIFWVVLISIIGAISSQQCNETGYFEPWKTYDTNRRQILTSLASKVVDHYGFYNSSIGKVPDEVHVMGMCIDGTEPTVCSDCLKVAADQLQENCPNQTEAYTWTPHKTLCFARYSNSSFFKRVGLHPLYMEHSNVDIKSNLTYLNTIWEALTDRLMSDASSDYNASLSSRRYYAANVTNLTNFQNIYALMLCTPDLEKGACHNCLEKAVSEYGNLRMQRGIVAWPSCCFRWDLYPFIGAFNLTLSPPPGSKRNISVGFFVAIVVATGVVISVLSTLVVVLVCRKRKTDPPEESPKYSLQYDLKTIEAATCTFSKCNMLGQGGFGEVFKGVLQDGSEIAVKRLSKESAQGVQEFQNETSLVAKLQHRNLVGVLGFCMEGEEKILVYEFVPNKSLDQFLFEPTKKGQLDWAKRYKIIVGTARGILYLHHDSPLKIIHRDLKASNILLDAEMEPKVADFGMARIFRVDQSRADTRRVVGTHGYISPEYLMHGQFSVKSDVYSFGVLVLEIISGKRNSNFHETDESGKNLVTYAWRHWRNGSPLELVDSELEKNYQSNEVFRCIHIALLCVQNDPEQRPNLSTIIMMLTSNSITLPVPQSPVYEGMDMFLPSIKSLPGSVNDSLIDDLVPR

SEQ ID NO: 965 - DNA, 1944 bp, Arabidopsis thaliana
  AT4G23200.1
atgcctttactattcctctggtttttcctcacgagcactagtcttgtctctgcacttcaaactcttccatgcataaacacaacctactttatacctaattcgacttacgacacaaaccgtcgcgttattctctcattgcttccttctaatgtcacatcacactttggcttcttcaacggttcaataggtcaagctcctaacagagtatatgccgtaggcatgtgtcttccaggtactgaagaagagagttgcataggttgtctcttgtctgcttccaatacattattagaaacctgcctcaccgaagaaaatgctcttatctggatcgcaaacagaactatttgtatgatccgatactccgatacttcctttgttggttcgttcgagttagagccgcatcgtgaattcctcagtattcatggttacaaaacgaatgaaacagaattcaatacagtatggagtagattaactcaacgtatggtacaagaagcttcctcaagcacagatgcaacatggtctggtgctaagtactatacagctgatgtagccgccttgcctgattcgcagactctctatgcaatgatgcaatgcactcctgatttgtctccggctgagtgtaatctctgtttaacagaaagcgttgttaactatcagagttgttgccttggacgtcaaggcggctctatcgttaggctaagttgcgctttccgggcagagttatatccatttggtggagcttttactgttatgacagcaagacctttgtcacaacctccaccgtcattaatcaagaaaggtgaattctttgcaaaatttatgagtaattcacaagaacctcggaaagttttcaacggaaactattgctgcaattgttgttcccattatagtggtcgctatcatcttcttgctggtattacgactctacacttccaacaactcgattttaagacaattgaagttgcaactgaaaattttgcaaagactaacaagctaggtcaaggtggatttggagaagtttacaagggcacgttagttaatggaacagaagttgcagtgaagaggctatcgaaaacatccgaacaaggtgcacaagagttcaagaacgaggttgttcttgtcgccaaacttcagcataggaatcttgttaagcttcttgggtactgtctggaaccagaggagaaaatacttgtttacgagtttgtccccaacaagagcctagactacttcctttttgatcctacaaagcaagggcagttagactggacaaaacgatacaacattatcggaggaatcactcgaggaattctatatcttcatcaagattcacgactaacaatcatacaccgtgatctcaaagccagcaacattcttctagatgccgatatgatcccgaaaatcgctgattttggaatggcgaggatatctggaatagaccaaagtgtagctaacacaaaaaggatagctggaactttcggttacatgcctccagaatacgtgatccatggccagttctcgatgaaatctgatgtctatagcttcggtgttttgattcttgagattatatgtggcaagaagaatagaagcttttaccaagcagatactaaagctgaaaatttggtcacctatgtttggaggttgtggacaaacggatcaccattagagctcgtggatctaaccatatcagagaattgtcaaacagaagaagttataagatgcatccacatcgcactcctatgtgttcaagaagatcctaaagatcgtcccaacttgtcaacaatcatgatgatgctcactaacagttccctcattttatctgttcctcaaccacctggattctttgttccgcaaaacaaagaacgtgatagctttttgtcgagccaatttacaatgggatgtacttctcagactaaaaatgatgtaaccattacaaatctagatcctcgt

SEQ ID NO: 966 - protein, 648 aa, Arabidopsis thaliana
  AT4G23200.1
MPLLFLWFFLTSTSLVSALQTLPCINTTYFIPNSTYDTNRRVILSLLPSNVTSHFGFFNGSIGQAPNRVYAVGMCLPGTEEESCIGCLLSASNTLLETCLTEENALIWIANRTICMIRYSDTSFVGSFELEPHREFLSIHGYKTNETEFNTVWSRLTQRMVQEASSSTDATWSGAKYYTADVAALPDSQTLYAMMQCTPDLSPAECNLCLTESVVNYQSCCLGRQGGSIVRLSCAFRAELYPFGGAFTVMTARPLSQPPPSLIKKGEFFAKFMSNSQEPRKVFNGNYCCNCCSHYSGRYHLLAGITTLHFQQLDFKTIEVATENFAKTNKLGQGGFGEVYKGTLVNGTEVAVKRLSKTSEQGAQEFKNEVVLVAKLQHRNLVKLLGYCLEPEEKILVYEFVPNKSLDYFLFDPTKQGQLDWTKRYNIIGGITRGILYLHQDSRLTIIHRDLKASNILLDADMIPKIADFGMARISGIDQSVANTKRIAGTFGYMPPEYVIHGQFSMKSDVYSFGVLILEIICGKKNRSFYQADTKAENLVTYVWRLWTNGSPLELVDLTISENCQTEEVIRCIHIALLCVQEDPKDRPNLSTIMMMLTNSSLILSVPQPPGFFVPQNKERDSFLSSQFTMGCTSQTKNDVTITNLDPR

SEQ ID NO: 967 - DNA, 2184 bp, Arabidopsis thaliana
  AT4G23220.1
atgttcgaatttgtctatgacgtgttgcttgactccaccgaaatagtaaatgagtcaacggagatattgatttgtctactgatggtccacactccacataactttttttttttttttttttttgataaaggtgatagacagaaaaaagtatgcatattattcatacttacttgctgtcctaacgtaaatatcatctgtactatcttgaaaatggaattgaagaatctctttccaatcttctggtttgtcctcgtaggctttgctgtggtgtctgcacaagaatgcggcaaaacagggttttttgtaccacaaagtaggtatgaaacaaaccggggccttctcctctcttctcttccttccaatgtttcagctcgaggaggattctacaattcttcgattggccaaggccctgatcgagtgtatgctctggggatgtgcattgaaggtgctgaaccagatgtttgctccgactgtattgaatatgcttctaatctgttattagacacgtgtctcaaccagacagaaggcctggcctggccggagaaacggattttgtgtatggtacgatactccaatagttctttttttggatcactcaaggcagaaccgcatttctatatccacaacgtggatgatattacatccaatttaacagagtttgatcaagtgtgggaagagttagcacgtcgtatgatagctagtactacttctccatcatctaaacgcaagtactacgcagcagacgtagcagccttgacagctttccagataatatatgcactaatgcaatgcactccggacttatctttggaggattgccatatctgtttaagacaaagtgttggtgactatgaaacatgctgcaatggaaagcaaggtggcattgtgtaccgagccagctgtgttttccggtgggagctttttcccttctctgaggcttttagtcgtatttcgttggcacctccgcctcaatccccagcatttcccacgcttccggcagtaaccaatacagcgaccaagaaaggtagcataacaatctcgataggaattgtctgggcaatcattattcctactgtcattgttgtcttcttggtactgcttgcgctaggatttgttgtttataggaggaggaaatcataccaaggatccagcactgatatcaccattacacactcactgcaattcgatttcaaagcgattgaagatgcaacaaataaattctcggagagcaacataattggtcgcggtggatttggagaagttttcatgggtgtccttaacggtactgaagttgcaattaagaggctgtcaaaagcatcgagacaaggtgcacgagaattcaaaaatgaggttgttgttgttgcaaaactccatcataggaatcttgttaagcttctcgggttttgtctagaaggagaagagaaaatacttgtttacgagtttgtccccaacaagagcctcgactacttcctctttgaccctacaaagcaagggcagttagactggactaaacgatacaacattatccggggaatcactcgaggaattctgtatcttcatcaagactcacggctcacgatcatacatcgtgacctcaaagccagcaacattctcctagatgcagatatgaacccaaaaattgctgattttggaatggcgagaatttttgggatcgatcaaagtggagctaatacaaaaaaaatagctgggacacgcggttacatgcctccagaatatgtgaggcaaggtcagttctcaacaagatcagatgtttatagtttcggagtcttagttcttgagattatatgtggtcgaaataacagattcatccaccagtcagacactacagttgagaatttggtcacatacgcttggaggttgtggagaaacgattcaccattagaactcgtggatccaaccatttcggagaattgtgaaaccgaagaagtgacaagatgcatccacattgcgttgctgtgtgttcaacacaatcccacagatcgccccagcttgtcgacaatcaacatgatgctcataaacaattcgtatgttttacctgatcctcaacaacctggattcttctttccaataataagcaaccaagaacgagatggcctcgactctatgaacaggtccaatccacaaactatcaatgatgtaaccattacagattttgaacctcgt

SEQ ID NO: 968 - protein, 728 aa, Arabidopsis thaliana
  AT4G23220.1
MFEFVYDVLLDSTEIVNESTEILICLLMVHTPHNFFFFFFFDKGDRQKKVCILFILTCCPNVNIICTILKMELKNLFPIFWFVLVGFAVVSAQECGKTGFFVPQSRYETNRGLLLSSLPSNVSARGGFYNSSIGQGPDRVYALGMCIEGAEPDVCSDCIEYASNLLLDTCLNQTEGLAWPEKRILCMVRYSNSSFFGSLKAEPHFYIHNVDDITSNLTEFDQVWEELARRMIASTTSPSSKRKYYAADVAALTAFQIIYALMQCTPDLSLEDCHICLRQSVGDYETCCNGKQGGIVYRASCVFRWELFPFSEAFSRISLAPPPQSPAFPTLPAVTNTATKKGSITISIGIVWAIIIPTVIVVFLVLLALGFVVYRRRKSYQGSSTDITITHSLQFDFKAIEDATNKFSESNIIGRGGFGEVFMGVLNGTEVAIKRLSKASRQGAREFKNEVVVVAKLHHRNLVKLLGFCLEGEEKILVYEFVPNKSLDYFLFDPTKQGQLDWTKRYNIIRGITRGILYLHQDSRLTIIHRDLKASNILLDADMNPKIADFGMARIFGIDQSGANTKKIAGTRGYMPPEYVRQGQFSTRSDVYSFGVLVLEIICGRNNRFIHQSDTTVENLVTYAWRLWRNDSPLELVDPTISENCETEEVTRCIHIALLCVQHNPTDRPSLSTINMMLINNSYVLPDPQQPGFFFPIISNQERDGLDSMNRSNPQTINDVTITDFEPR

SEQ ID NO: 969 - DNA, 2007 bp, Arabidopsis thaliana
  AT4G11530.1
atgaagctaaagatttcgtttttaccaaccttcttgatttttctcataagcttagattctgttactgctcaagaaatctgtttcagtggattctttaaacccaatagtacatacgatttaaaccgtcgtcaaatcctctctactctttcttctaatgtcacaagtcacaacggctttttcaactccaagtttggtcaagctcccaatagagtcttcatcaatggcatgtgcatccctgggactaaaccagagacttgttcagattgtattaaaggtgcatcagacaagatatcagagagttgtcctaacaaaacagatgcttatacatggcctgattgttgtatggtacgttattccaacgtttctttctctggttcactcgttatggaaccttctgaaactctctatcatacgggagatatcgaagatacaggcactaatttaacagtgtttgatagaatttgggaagagttaatgctccgtacaataactgcagcttcattgagtagtagtaatggatcatcatttggacaaaagtactttgcagctgaggttgcttcattgactactttccaaaccatgtatgcgatgatgcaatgtacgccggatgtttcttcgaaagattgtgagttttgtttgaagacaagtgttggtgattatgagtcatgttgccgtggtaaacaaggtggtgcggtgataagaccaagttgctttgtccggtgggatttgtatccttatgctggagcttttgaaaatgttacatttccaccgcctccaccgcagtctttacctcagccaccggtttctttgattcctcctccagttagcgatagggcaaatacaaccatcaaagggattattgtggctattgttgttcctatcattgttatcttggtttcacttgttgtactactcgtggtttgcagaagaaagaagtcatataaaacaactgaggttcaagctactgatgagatcacaacaacacactcactgcagtttagttttaagacaattgaagctgcaactgacaagttttcggacagtaacatgatcgggcgaggtggatttggtgaagtttacaggggaaagctttcaagtggacctgaagtagcagtgaagagactgtcgaaaacatcaggacaaggcgcggaagagttcaagaatgaggctgttcttgtgtcgaagcttcaacataagaatctggtcaggcttcttggattttgtttggaaggagaagaaaagatactcgtctatgagtttgtacccaacaaaagccttgactattttctctttgaccctgcaaaacaaggtgaactagattggacaagacggtacaatatcattggggggattgctcgaggaattctatatcttcatcaagattcacggcttacaatcatacaccgtgatctcaaagcgagtaacattctcttagatgctgatatgaaccccaaaattgcagattttggcatggcgaggatttttggagttgatcaaagtcaagccaacacaagaagaatcgccggaacatttggttatatgtctccagaatatgcaatgcgtggccatttctccatgaagtctgatgtctatagctttggagtattggtactagagattataagtggcaaaaagaatagcagtttctacaacattgatgattctggtagcaatttggtaacacacgcttggagactttggagaaatgggtcaccgttagaactggtggatccaaccataggagaaagttatcagagtagcgaggctactagatgcatccatatcgcactattatgtgttcaagaagatcctgcagatcgtccattgttaccagcgatcatcatgatgcttactagtagcacaaccactttacatgtgcctcgagcgcccggattttgcctaagcgggcgtgatctggaacaggatggtgtagagtataccgaatccacaagcaggtctattcctggttctatcaatgatgcatcgattacagagttctatcctcgt

SEQ ID NO: 970 - protein, 669 aa, Arabidopsis thaliana
  AT4G11530.1
MKLKISFLPTFLIFLISLDSVTAQEICFSGFFKPNSTYDLNRRQILSTLSSNVTSHNGFFNSKFGQAPNRVFINGMCIPGTKPETCSDCIKGASDKISESCPNKTDAYTWPDCCMVRYSNVSFSGSLVMEPSETLYHTGDIEDTGTNLTVFDRIWEELMLRTITAASLSSSNGSSFGQKYFAAEVASLTTFQTMYAMMQCTPDVSSKDCEFCLKTSVGDYESCCRGKQGGAVIRPSCFVRWDLYPYAGAFENVTFPPPPPQSLPQPPVSLIPPPVSDRANTTIKGIIVAIVVPIIVILVSLVVLLVVCRRKKSYKTTEVQATDEITTTHSLQFSFKTIEAATDKFSDSNMIGRGGFGEVYRGKLSSGPEVAVKRLSKTSGQGAEEFKNEAVLVSKLQHKNLVRLLGFCLEGEEKILVYEFVPNKSLDYFLFDPAKQGELDWTRRYNIIGGIARGILYLHQDSRLTIIHRDLKASNILLDADMNPKIADFGMARIFGVDQSQANTRRIAGTFGYMSPEYAMRGHFSMKSDVYSFGVLVLEIISGKKNSSFYNIDDSGSNLVTHAWRLWRNGSPLELVDPTIGESYQSSEATRCIHIALLCVQEDPADRPLLPAIIMMLTSSTTTLHVPRAPGFCLSGRDLEQDGVEYTESTSRSIPGSINDASITEFYPR

SEQ ID NO: 971 - DNA, 2001 bp, Arabidopsis thaliana
  AT4G23190.1
atgaagcagaggagtttgttttcagtcctctgttttttcttcataagttttggtgttgcttcagtttcagcacaaacatgcacgacggacaaggggactttcagacccaacggtacttacgacgtaaatcgccgtctcatcctctcttctcttccttcaaatgtcacggaccaagacggcttatactacaacggttccataggacaacaaccgaaccgtgtctacgcaatagggatgtgcatcccaggatcaacttcagaagactgttctgattgtatcaagaaagagtctgaattttttttaaagaattgtcctaaccaaacagaggcgtattcatggccaggtgagccaacgctttgctatgtgcgctactccaacacttctttctcaggatctgctgatctgaacccgcgaaattggctcaccaacactggagacctagactcaaatctaacagagtttacgaaaatatgggaaggattaatgggtcgtatgatttctgcagcttccacagcaaaaagcacaccttcttcaagtgataaccattactcagctgattcagcagtcttgacacctctcctgaatatatatgcattgatgcaatgcacgccggatctttcctccggtgattgtgaaaactgtctgcgacaaagcgcaattgactatcagtcgtgctgtagccagaagcgaggaggtgttgttatgcggccaagctgctttttgcggtgggatttgtatacatattctaacgcttttgataatcttacggtggcttctcctcctccagaacctcctgtgactgtgccacaacctgcaggtgatcaggacaacccgaccaacaatgatagcaaaggaatctcagctggagttgttgtggcgatcaccgttcccactgttattgccatcttgatactgctggttttaggatttgttcttttccggagaagaaaatcctaccaaagaactaagactgaatctgaaagtgatatttcaactacagattcattggtatacgattttaagacaattgaagccgcaactaacaagttttcaacaagtaataagcttggtgaaggtggattcggtgcggtttacaagggtaagctttctaacggaactgatgtagctgtgaagcgactgtcgaaaaagtcaggacaaggcacaagggagttcaggaacgaggctgttcttgtgacaaaacttcaacataggaatctggttagacttcttggattctgtttggaaagagaggaacagattctgatctatgaatttgtccacaacaaaagccttgactactttcttttcgacccggaaaagcaaagtcagctagactggacccggcgatacaagatcattggaggaattgctcgagggattctatatcttcatcaagattcacggctcaaaatcatacatcgtgacctcaaagccagcaacattctcttagatgcagacatgaacccaaaaattgcagattttggattggcaactatttttggagtggagcaaactcaaggaaacacgaacagaattgctggaacctacgcttacatgtctcccgagtatgcgatgcatggtcaatactccatgaaatctgacatttatagctttggagtcttagttcttgagattataagcggcaagaaaaacagcggcgtctaccagatggatgaaactagtactgcaggaaacttggtcacttatgcttcgaggctttggagaaacaagtcaccattagagctggtggatccaacttttggaaggaattatcagagtaatgaagtcactaggtgcatccatatcgcgctgttatgtgttcaagaaaatccagaagaccgtccaatgttatcaacaatcatcttaatgctgactagtaacacaattactctaccagtgcctcgcctaccgggatttttcccacgaagcaggcaactgaaactggtatctgaaggatcagagtctgatcagtatacaagcaagtcttcctcatttagttcg

SEQ ID NO: 972 - protein, 667 aa, Arabidopsis thaliana
  AT4G23190.1
MKQRSLFSVLCFFFISFGVASVSAQTCTTDKGTFRPNGTYDVNRRLILSSLPSNVTDQDGLYYNGSIGQQPNRVYAIGMCIPGSTSEDCSDCIKKESEFFLKNCPNQTEAYSWPGEPTLCYVRYSNTSFSGSADLNPRNWLTNTGDLDSNLTEFTKIWEGLMGRMISAASTAKSTPSSSDNHYSADSAVLTPLLNIYALMQCTPDLSSGDCENCLRQSAIDYQSCCSQKRGGVVMRPSCFLRWDLYTYSNAFDNLTVASPPPEPPVTVPQPAGDQDNPTNNDSKGISAGVVVAITVPTVIAILILLVLGFVLFRRRKSYQRTKTESESDISTTDSLVYDFKTIEAATNKFSTSNKLGEGGFGAVYKGKLSNGTDVAVKRLSKKSGQGTREFRNEAVLVTKLQHRNLVRLLGFCLEREEQILIYEFVHNKSLDYFLFDPEKQSQLDWTRRYKIIGGIARGILYLHQDSRLKIIHRDLKASNILLDADMNPKIADFGLATIFGVEQTQGNTNRIAGTYAYMSPEYAMHGQYSMKSDIYSFGVLVLEIISGKKNSGVYQMDETSTAGNLVTYASRLWRNKSPLELVDPTFGRNYQSNEVTRCIHIALLCVQENPEDRPMLSTIILMLTSNTITLPVPRLPGFFPRSRQLKLVSEGSESDQYTSKSSSFSS

SEQ ID NO: 973 - DNA, 2019 bp, Arabidopsis thaliana
  AT4G23210.3
atgaagcagaggagtttattatcaatcctctgttttatccttctagcctctggtgttgcttctgtttcagcacaaacatgcatagagaaccgtaaatatttcacacccaacggtacatacgattcaaatcgtcgtcttatcctctcttctcttcctaacaataccgcgtctcgagatggtttctactacggttccattggagaagagcaagatcgagtctacgcattagggatgtgcatcccgaaatcaactccaagtgattgttctaactgtatcaagggcgcggcaggctggttgatacaggattgtgtcaaccagacagacgcgtactattgggcacttgatccaacgctgtgccttgtccgctactccaacatttctttctcaggatctgcagctttttgggagattgagccgcagtatttggtgttgaacactgcaactatcgcctcaaatctaacagagttcaagacaatatgggaagacttaacatctcgtacgattactgcagcctccgcagcaagaagcacaccatcgtccagtgataaccattacagagttgattttgcgaacttgacaaaattccagaatatctacgcattgatgcaatgcacgccagatatttcttctgacgaatgtaacaactgtctccaacgaggcgtacttgagtaccagtcatgctgtggaaataatactggaggctatgttatgcggccaatctgctttttccggtggcagctttttacattctctaaggcttttcataacattaccttggctactactcctcctctttctcctcctccactgcaacgtcctgtggttgcgtcacaaccaccttctgcagacaaccgggacaagaagagagacaatagtagcggaaaaatctcaatgaaaactattctagcaattgttgtggttggtatagtcatcctcatcatcatctcgggaattcttgctcgccggtttgctcggaaggaaaaaccatatcaagaagttgaacttaatcaaactggtattacatctgtacgctccctgcaatacaaatttaagacgatcgaaactgcaacaaataatttttcagagagacttggtcatggtggatctggacatgttttcaagggaaggttgcctgacggaaaggaaattgcagtgaagagattgtcagaaaaaacagaacaaagtaagaaagagttcaagaacgaggttgttcttgtcgcgaaacttcagcatagaaatcttgttagacttctcggtttttctgtcaaaggagaagaaaagatcatagtctacgagtatttgcccaacagaagtctcgactacatcctctttgaccctacaaagcaaggagagttagactggaaaaagcggtacaagatcattggaggaactgctagagggattctatatcttcatcaagattcacaacccacaatcatacatcgtgacctcaaagcgggtaatatcctcttggacgctcatatgaacccgaaagttgcagattttgggacggcaaggatctttgggatggaccaaagtgtagctattacagcgaatgcagccggaactcccggttacatggccccagaatatatggaactaggcgaattctcgatgaaatctgacgtgtatagctatggggtcttagttcttgagattatatgcggcaagaggaacacgagcttctcatctccggttcagaattttgtcacatatgtctggaggttatggaaaagcgggacaccattaaacctcgttgacgcaacaattgcagagaattataagagtgaagaagtgataagatgtatccacattgcgctcctatgtgttcaagaagaacctacagatcgtcctgacttttcgataatcatgtcgatgctcactagcaattccctcatcttacctgttcctaaaccacctccatccttcattccaggtagaccaaaccaatctacgacgaggcccagttcccaaaatatcaatgatggaaggtggtccttgttgaaaatgatgttccat

SEQ ID NO: 974 - protein, 673 aa, Arabidopsis thaliana
  AT4G23210.3
MKQRSLLSILCFILLASGVASVSAQTCIENRKYFTPNGTYDSNRRLILSSLPNNTASRDGFYYGSIGEEQDRVYALGMCIPKSTPSDCSNCIKGAAGWLIQDCVNQTDAYYWALDPTLCLVRYSNISFSGSAAFWEIEPQYLVLNTATIASNLTEFKTIWEDLTSRTITAASAARSTPSSSDNHYRVDFANLTKFQNIYALMQCTPDISSDECNNCLQRGVLEYQSCCGNNTGGYVMRPICFFRWQLFTFSKAFHNITLATTPPLSPPPLQRPVVASQPPSADNRDKKRDNSSGKISMKTILAIVVVGIVILIIISGILARRFARKEKPYQEVELNQTGITSVRSLQYKFKTIETATNNFSERLGHGGSGHVFKGRLPDGKEIAVKRLSEKTEQSKKEFKNEVVLVAKLQHRNLVRLLGFSVKGEEKIIVYEYLPNRSLDYILFDPTKQGELDWKKRYKIIGGTARGILYLHQDSQPTIIHRDLKAGNILLDAHMNPKVADFGTARIFGMDQSVAITANAAGTPGYMAPEYMELGEFSMKSDVYSYGVLVLEIICGKRNTSFSSPVQNFVTYVWRLWKSGTPLNLVDATIAENYKSEEVIRCIHIALLCVQEEPTDRPDFSIIMSMLTSNSLILPVPKPPPSFIPGRPNQSTTRPSSQNINDGRWSLLKMMFH

SEQ ID NO: 975 - DNA, 1980 bp, Arabidopsis thaliana
  AT4G23300.1
atgaagcagaggagtttcttatcaatcctctgttttattcttctagcctttggtgttgcttctgtttcagcacaaacatgcatagagaaccgtaaatatttcacacccaacggtacatacgattcaaatcgtcgtcttatcctctcttctcttcctaacaataccgcctctcaagatggtttctactacggttcgattggagaagagcaagatcgagtctacgcattagggatgtgcatcccaagatcaactccaagtgactgttttaattgtataaagggtgcggcaggctggttgatacaggactgtgttaaccagacagacgcgtattattgggcacttgatccaacgctgtgccttgtccgctactccaacatttctttctcaggatctgcagctttttgggagattgagcctcagtatttggtcttgaacactgcaactatcgcctcagatctaacggatttcaagaacatatgggaagacttaacatctcgtacgattactgcagcctccgcagcaagaagcacaccatcgtccagtgataaccattacagagttgattttgcgaacttgacaaaattccagaatatctacgcattgatgcaatgcacgccagatatttcttctgacgaatgtaacaactgtctccaacgaggcgtacttgagtaccagtcatgctgtggaaataatactggaggctatgttatgcggccaatctgctttttccggtggcagctttttacattctctaaggcttttcataacattaccttggctactcctccgaaacctccaatgaatgtaccgcgaccaccttctgtaggtcacggggcgaacactacagataatgatagcaggggagtctcagctggaattgtagtggtgattaccgttccagcagttgtcatcgtcttgatactagttgttctaggattttttatttgctggaggagaaagtctttgcaaagaactgaatttgaatctgatagtgatgtttctactacaaattcattgcaatacgagtttaagacaattgaagctgcaacgaataagttttcgaagagcaataagctcggcgaaggtcgatttggggaagtttacaagggtaagttttcaaatggaactgaagttgccgtgaagaggctctcgaaagtatcaggacaagacacaaaaaagttcaggaacgaggctgttcttgtatcaaaaattcagcataggaatctggctaggcttcttgggttctgtttgcaaggagatggaaagtttttgatctatgagtttgttctcaacaaaagccttgactattttctattcgatcctgaaaagcaaggtgagctagactggactcggcgatacaagatcattggagggattgctcaagggatactacatcttcatcaagatccacagctcacaatcatatatcgtgacttcaaagccagcaacattctcttagatgccgatatgaacccaaaaatttcagattttggaatggccacagtttttggaatggaggaaagtcgaggcaatacgaactggatagctgaaaccttcgtttacatgtctcccgagtatgcggtgcatggcaaattctccatgaaatctgacgtctacagctttggaatcttgattcttgaaattattagcggcaagaagaatagcagcctctaccagaacgatgaaactactactgctggcaacttggttacctatgcttggaggctttggagaaacggctcgcaactaaagctgctggattcgtccataggaaggaactatcagagtaatgaagtcactagatgcatccatattgctcttttatgtgttcaagagaatccagaagaccgtccaaagttgtcaaccattgtctcaatgcttaccagtaacacaatcagtgtgccagcgcctggcataccgggatttttcccccaaagcaggcgtgaactggacccattatctgagggattagagtcgggt

SEQ ID NO: 976 - protein, 660 aa, Arabidopsis thaliana
  AT4G23300.1
MKQRSFLSILCFILLAFGVASVSAQTCIENRKYFTPNGTYDSNRRLILSSLPNNTASQDGFYYGSIGEEQDRVYALGMCIPRSTPSDCFNCIKGAAGWLIQDCVNQTDAYYWALDPTLCLVRYSNISFSGSAAFWEIEPQYLVLNTATIASDLTDFKNIWEDLTSRTITAASAARSTPSSSDNHYRVDFANLTKFQNIYALMQCTPDISSDECNNCLQRGVLEYQSCCGNNTGGYVMRPICFFRWQLFTFSKAFHNITLATPPKPPMNVPRPPSVGHGANTTDNDSRGVSAGIVVVITVPAVVIVLILVVLGFFICWRRKSLQRTEFESDSDVSTTNSLQYEFKTIEAATNKFSKSNKLGEGRFGEVYKGKFSNGTEVAVKRLSKVSGQDTKKFRNEAVLVSKIQHRNLARLLGFCLQGDGKFLIYEFVLNKSLDYFLFDPEKQGELDWTRRYKIIGGIAQGILHLHQDPQLTIIYRDFKASNILLDADMNPKISDFGMATVFGMEESRGNTNWIAETFVYMSPEYAVHGKFSMKSDVYSFGILILEIISGKKNSSLYQNDETTTAGNLVTYAWRLWRNGSQLKLLDSSIGRNYQSNEVTRCIHIALLCVQENPEDRPKLSTIVSMLTSNTISVPAPGIPGFFPQSRRELDPLSEGLESG

SEQ ID NO: 977 - DNA, 2040 bp, Arabidopsis thaliana
  AT4G23140.2
atgtcttctcttatatctttcaacttccttttccttttctcattcctcactagctccttcacagcttctgctcaagatcctttttacttaaatcattattgtccaaatacgacaacttactcaagtaacagcacttactccaccaatctcagaacccttttgtcctctctatcttcacgtaacgcctcttactccaccggattccaaaacgccactgcaggaaaagcccccgacagagtcaccggacttttcctttgccgcggagacgtctcaccggaagtttgccgtaactgcgtagccttttctgtcaatcaaaccttaaatctttgtcccaaggtaagagaagccgtgttttactacgagcaatgtatactcagatattctcacaagaatattctatcgacggccattacaaacgaaggagaatttatcttgagtaacaccaacactatttctcctaatcaaaaacaaatagacgggttcacaagttttgtttcctccacgatgagtgaagctgccggtaaagcagccaacagttctagaaaattatatacggtgaataccgaattgaccgcataccagaatttgtacgggctgcttcagtgcactcctgatcttacaagagcagactgcttgagttgtttgcaaagttccatcaatggaatggctctttccagaataggagcaagactttactggccgagttgtactgcaaggtacgagctttacccgttctacaatgaaagcgccattgaaacaccaccactaccaccaccaccaccaccaccaccaccgagggagtcgttggtgtctactcctccgatatcatcttcttcattacctgggaaaagtgggaactcaacagtgttagtggtagccgttgttgtgctggctgttctgcttttcatagctttagttggttattgtttccttgcaaaaaagaaaaagaagacttttgacacagcatctgcatcggaggtaggagatgatatggcaaccgcagactcactacagctcgactatagaacaatccaaactgcaacaaatgattttgcagagagtaataagattggtcgaggtggttttggtgaggtttacaagggtacattttcaaatgggaaagaagttgcggtgaagagattgtcgaaaaattcaagacaaggcgaagcggagttcaagaccgaggttgttgtagttgccaagcttcaacacagaaatttggttaggcttcttggattttcattacaaggagaggaaagaattttggtctacgagtatatgcctaacaaaagccttgattgcttactatttgaccctacaaagcaaattcagctggactggatgcagcgatacaatatcattggaggaattgctcgggggattctatatcttcatcaagattcacggctcacaatcatacaccgtgaccttaaagcaagtaacattctcctagatgcggatataaatccgaaaattgcagattttggaatggctaggatctttggattggaccaaacccaagataacacaagcagaatagttggtacctattttgttgtggattccagcggttacatggctcctgaatatgcgatgcatggccaattctcaatgaaatctgatgtctatagcttcggagtgttagttcttgagattataagtggtaggaagaatagcagcttcggcgagtcagacggtgcacaagacttgctcacacatgcttggaggctttggactaacaaaaaagcattagacctcgtggatccacttatagcagagaattgccagaatagtgaagtggttcgatgcatccatatcggtcttttatgtgttcaagaagatcctgcaaagcgtccggcaatatcaaccgttttcatgatgctcactagtaatactgtgaccttaccagtgcctcggcaaccagggtttttcattcaatgtagagccgtaaaggacccgcttgattcagatcagtctaccacgaccaagtcttttccagcgtctattgatgatgaatcgatcacagatttatatccgcgc

SEQ ID NO: 978 - protein, 680 aa, Arabidopsis thaliana
  AT4G23140.2
MSSLISFNFLFLFSFLTSSFTASAQDPFYLNHYCPNTTTYSSNSTYSTNLRTLLSSLSSRNASYSTGFQNATAGKAPDRVTGLFLCRGDVSPEVCRNCVAFSVNQTLNLCPKVREAVFYYEQCILRYSHKNILSTAITNEGEFILSNTNTISPNQKQIDGFTSFVSSTMSEAAGKAANSSRKLYTVNTELTAYQNLYGLLQCTPDLTRADCLSCLQSSINGMALSRIGARLYWPSCTARYELYPFYNESAIETPPLPPPPPPPPPRESLVSTPPISSSSLPGKSGNSTVLVVAVVVLAVLLFIALVGYCFLAKKKKKTFDTASASEVGDDMATADSLQLDYRTIQTATNDFAESNKIGRGGFGEVYKGTFSNGKEVAVKRLSKNSRQGEAEFKTEVVVVAKLQHRNLVRLLGFSLQGEERILVYEYMPNKSLDCLLFDPTKQIQLDWMQRYNIIGGIARGILYLHQDSRLTIIHRDLKASNILLDADINPKIADFGMARIFGLDQTQDNTSRIVGTYFVVDSSGYMAPEYAMHGQFSMKSDVYSFGVLVLEIISGRKNSSFGESDGAQDLLTHAWRLWTNKKALDLVDPLIAENCQNSEVVRCIHIGLLCVQEDPAKRPAISTVFMMLTSNTVTLPVPRQPGFFIQCRAVKDPLDSDQSTTTKSFPASIDDESITDLYPR

SEQ ID NO: 979 - DNA, 3786 bp, Arabidopsis thaliana
  AT4G23160.1
atggtatctgatgcagatgcttccacatcttcatcttccattgatattatgccttctgctaatattcaaaatgatgtccctgaaccttctgttcacacatcgcataggagaacacgaaagcctgcttatcttcaagattactactgtcattcagtagcttctttaaccattcatgatatttcccagtttctctcttatgaaaaagtttctccactttaccattctttcttggtttgtattgccaaagctaaagaaccctcaacctacaatgaagcgaaagaatttcttgtgtggtgtggtgctatggatgatgaaattggtgcaatggagactactcacacttgggaaatctgtactctacctcccaataagaagcctattggttgcaaatgggtgtataagataaaatacaactcggatggcaccattgaacgttataaggcacggttggttgccaagggttacacacagcaggaaggtatcgattttattgagactttctctccagtctgcaaactcacatctgtcaagctcattcttgcgatctctgccatctataattttactcttcatcaactggacatttccaatgcgttccttaatggtgatttggatgaagagatctatatgaagcttcctcctggatatgctgctagacagggggactctctccctcccaatgctgtgtgttacctcaagaagtccatttatgggcttaaacaagcctccagacaatggtttttaaagttttctgttacactcattggttttggttttgtgcagtcccattctgaccatacctacttcttgaagatcactgctacacttttcttatgtgtcttagtgtatgttgacgacatcatcatttgcagtaacaatgatgcagctgttgatgagttgaagtcccagctgaaaagttgttttaaactcagggatcttggccctttgaaatactttcttggcttagaaattgctagatccgctgctggcattaacatttgtcaaagaaagtatgcattggatcttttggatgaaacaggtctcttgggttgtaagccgtctagtgttcctatggatcccagcgtcactttctctgctcattcaggtggtgactttgtggatgctaaagcttacagacgtctcattggtcgcctcatgtatcttcagattactcgtcttgacatcagctttgcagtcaacaagctcagtcaattctctgaagctcctcgccttgcacatcaacaggctgtcatgaagattctgcattacattaaaggcactgttggtcaaggtctgttttattcttctcaagctgaaatgcaacttcaagttttctctgatgcttcatttcagtcatgcaaggacactagacgctctacaaatggttattgtatgtttttgggaacttctctcatttcctggaaatccaagaagcagcaggtggtctccaagtcttctgctgaagctgagtatcgtgctctctcttttgctacagatgagatgatgtggttagctcaattcttcagggaactccagcttcctctctccaagcctacacttctcttctgtgacaacactgcagcaattcacatcgccaccaatgcagttttccacgagcgcaccaaacacatcgaaagtgactgccacagcgttcgtgagagatccgtttaccaagccactctatcctactcctttcaagcttatgatgagcaagatgggtttacagagtatctttctcccatcttgagggggactattatgtatatagtttcaatgtttggtttagctggtttagaggctctgatctgtttcattttccttttccttttctcattcctcactagcttcaaagcttctgctcaaaatcctttttacctaaatcatgattgtccaaataggacaacttactcaagtaacagcacttactccaccaatctcaaaacccttttgtcctcttttgcttcccgcaacgcctcttactccaccggattccaaaacatcagggcgggacaaacccccgacagggtcaccggacttttcctttgtcgcggagacctatccccggaagtttgcagtaactgcgttgccttctccgttaacgaatcgttaactcggtgtccaaatcagagagaagctgtgttctattacgaagagtgcatactcagatactctcacaagaattttctatcgacagttacatacgaaggagaacttatcatgaggaaccccaataatatttcttctattcaaaatcaaagagaccagtttatagatttggttcaatctaatatgaaccaagctgccaatgaagcagccaacagttctagaaaattctctacgataaagaccgaattgacctcactccagactttgtatgggcttgttcaatgcactcctgatctcgcaagacaagattgctttagctgtctgacaagttccatcaatagaatgatgccactttttagaattggagcaagacagttttggccaagttgtaattcaaggtacgagctttacgcgttctacaacgaaaccgccattggaacaccatcaccaccaccactgtttccggggtctacgcctccgttgacatccccttcaatacctgggaaaagtgggaattcaacagtgttagtggtagccattgttgtgctggctgttctgcttttcatagctttagttggttattgtttccttgcacagagaacaaagaagacttttgacacagcatctgcatcggaggtaggagatgatatggcaaccgcagactcactacagctcgactatagaacaatccaaactgcaacaaatgattttgcagagagtaataagattggtcgaggtggttttggtgaggtttacaagggtacattttcaaatgggaaagaagttgcggtgaagagattgtcgaaaaattcaagacaaggcgaagcggagttcaagaccgaggttgttgtagttgccaagcttcaacacagaaatttggttaggcttcttggattttcattacaaggagaggaaagaattttggtctacgagtatatgcctaacaaaagccttgattgcttactatttgaccctacaaagcaaactcagctggactggatgcagcgatacaatatcattggaggaattgctcgggggattctatatcttcatcaagattcacggctcacaatcatacaccgtgaccttaaagcaagtaacattctcctagatgcggatataaatccgaaaattgcagattttggaatggctaggatcttcggattggaccaaacccaggataacacaagccgaatagttggtacctacggttacatggctcccgagtatgcgatgcatggccaattctcaatgaaatctgatgtctatagcttcggagtgttagttcttgagattataagtggtaggaagaatagtagcttcgacgagtcagacggcgcacaagacttgctcacacatacttggaggctttggactaacagaacagcattagacctcgtggatccacttatagcaaataactgccagaatagcgaagtggttcgatgcatccatatcggtcttttatgtgttcaagaagatcctgcaaagcgtccgacaatatcaaccgttttcatgatgctcactagtaatactgtgaccttaccagtgcctcggcaaccagggtttttcattcaaagtagtcccgtaaaggacccgactgattcagatcagtctaccacgaccaagtctactccagcatctattgacgatgaattgatcactgatttatatccgcgc

SEQ ID NO: 980 - protein, 1262 aa, Arabidopsis thaliana
  AT4G23160.1
MVSDADASTSSSSIDIMPSANIQNDVPEPSVHTSHRRTRKPAYLQDYYCHSVASLTIHDISQFLSYEKVSPLYHSFLVCIAKAKEPSTYNEAKEFLVWCGAMDDEIGAMETTHTWEICTLPPNKKPIGCKWVYKIKYNSDGTIERYKARLVAKGYTQQEGIDFIETFSPVCKLTSVKLILAISAIYNFTLHQLDISNAFLNGDLDEEIYMKLPPGYAARQGDSLPPNAVCYLKKSIYGLKQASRQWFLKFSVTLIGFGFVQSHSDHTYFLKITATLFLCVLVYVDDIIICSNNDAAVDELKSQLKSCFKLRDLGPLKYFLGLEIARSAAGINICQRKYALDLLDETGLLGCKPSSVPMDPSVTFSAHSGGDFVDAKAYRRLIGRLMYLQITRLDISFAVNKLSQFSEAPRLAHQQAVMKILHYIKGTVGQGLFYSSQAEMQLQVFSDASFQSCKDTRRSTNGYCMFLGTSLISWKSKKQQVVSKSSAEAEYRALSFATDEMMWLAQFFRELQLPLSKPTLLFCDNTAAIHIATNAVFHERTKHIESDCHSVRERSVYQATLSYSFQAYDEQDGFTEYLSPILRGTIMYIVSMFGLAGLEALICFIFLFLFSFLTSFKASAQNPFYLNHDCPNRTTYSSNSTYSTNLKTLLSSFASRNASYSTGFQNIRAGQTPDRVTGLFLCRGDLSPEVCSNCVAFSVNESLTRCPNQREAVFYYEECILRYSHKNFLSTVTYEGELIMRNPNNISSIQNQRDQFIDLVQSNMNQAANEAANSSRKFSTIKTELTSLQTLYGLVQCTPDLARQDCFSCLTSSINRMMPLFRIGARQFWPSCNSRYELYAFYNETAIGTPSPPPLFPGSTPPLTSPSIPGKSGNSTVLVVAIVVLAVLLFIALVGYCFLAQRTKKTFDTASASEVGDDMATADSLQLDYRTIQTATNDFAESNKIGRGGFGEVYKGTFSNGKEVAVKRLSKNSRQGEAEFKTEVVVVAKLQHRNLVRLLGFSLQGEERILVYEYMPNKSLDCLLFDPTKQTQLDWMQRYNIIGGIARGILYLHQDSRLTIIHRDLKASNILLDADINPKIADFGMARIFGLDQTQDNTSRIVGTYGYMAPEYAMHGQFSMKSDVYSFGVLVLEIISGRKNSSFDESDGAQDLLTHTWRLWTNRTALDLVDPLIANNCQNSEVVRCIHIGLLCVQEDPAKRPTISTVFMMLTSNTVTLPVPRQPGFFIQSSPVKDPTDSDQSTTTKSTPASIDDELITDLYPR

SEQ ID NO: 981 - DNA, 1977 bp, Arabidopsis thaliana
  AT4G23150.1
atgtcttctctcttccctttcatattccttttccttttctcattcctcactagcttcagagcttctgctcaagatcctcgtttcctagcctattattgtccaaatgcaacaacttactcaagtaacagcacttacttgaccaatcttaaaacccttttgtcctctctctcttcccgcaacgcctcttactccaccggattccaaaacgccacggtgggacaagcccttgacagggtcaccggacttttcctttgccggggagacgtctcgccggaagtttgccgtaactgcgtcacctttgccgtcaacaacacctttagtaggtgtccgaatcagagagaagctgtgttctattacgaggagtgcatactcagatactctcacaagaatattctatcgacggccattacaaacgaaggagaatttatcttgaggaaccccaatcatatttctcctattcaaaatcaaataaaccagtttactaatttggtgttatctaatatgaaccaaattgccatcgaagcagccgacaatcctagaaaattctctacgataaagaccgaattgaccgcactccagactttctacgggcttgttcaatgcactcctgatctttcaagacaaaactgcatgaactgtctgacaagttccatcaatagaatgccattttctagaattggagcaagacagttttggccaagttgtaattcaaggtacgagctttacgatttctacaacgaaaccgccattggtacaccaccaccgccgctgcctccgttggcatctccttcactatctgataaaagtgggaattcaaatgtggtcgtggtagccgttgttgtgcctatcatagtcgctgttctgattttcatagctggttattgtttctttgcaaagagggcaaagaagacttatggcacaacacctgctttagatgaagatgataaaacaaccatagagtcgctgcaacttgattatagagcaattcaagctgcaacaaatgatttttcagagaataataaaattggtcgaggaggttttggtgacgtttacaagggtacattttcaaatggaaccgaagttgcagtgaagagactgtcgaaaacatcagaacaaggtgacacagaattcaagaacgaggttgtagttgttgcaaatcttcggcacaaaaatcttgttaggattctcggattttctatagaacgagaagaaaggatattggtctacgagtatgtagaaaataaaagccttgataacttcctatttgatcctgcaaagaaaggtcagttgtactggacacagcgataccatatcattggtgggattgctagagggatcctatatcttcatcaagattcacgactcacaatcatacaccgtgaccttaaagcgagtaacattctcctggatgctgatatgaatcctaaaattgctgattttggaatggcaaggatctttggaatggatcaaacccagcagaacacaagcagaatagttggtacctacggttacatgtctcctgaatatgcgatgcgtggccagttctcaatgaaatctgatgtctatagtttcggagtgttagttcttgagattataagcggtaggaagaacaacagctttatcgagacagatgacgcacaggacttggtgacacatgcttggaggctttggagaaacggaacagcgttagacctcgtggatccattcattgcagatagttgccggaagagtgaagtggttcgatgcacccatatcggtcttttatgtgttcaagaagatcctgtaaaacgtccagccatgtcaaccatttccgtgatgctcactagtaatacaatggctttaccagcgcctcagcaaccagggttttttgttaggagtagacctggaacaaaccggcttgattcagatcaatcaacgaccaacaagtctgttacagtatctattgacgataagtcaatgtctgatttagatcctcgt

SEQ ID NO: 982 - protein, 659 aa, Arabidopsis thaliana
  AT4G23150.1
MSSLFPFIFLFLFSFLTSFRASAQDPRFLAYYCPNATTYSSNSTYLTNLKTLLSSLSSRNASYSTGFQNATVGQALDRVTGLFLCRGDVSPEVCRNCVTFAVNNTFSRCPNQREAVFYYEECILRYSHKNILSTAITNEGEFILRNPNHISPIQNQINQFTNLVLSNMNQIAIEAADNPRKFSTIKTELTALQTFYGLVQCTPDLSRQNCMNCLTSSINRMPFSRIGARQFWPSCNSRYELYDFYNETAIGTPPPPLPPLASPSLSDKSGNSNVVVVAVVVPIIVAVLIFIAGYCFFAKRAKKTYGTTPALDEDDKTTIESLQLDYRAIQAATNDFSENNKIGRGGFGDVYKGTFSNGTEVAVKRLSKTSEQGDTEFKNEVVVVANLRHKNLVRILGFSIEREERILVYEYVENKSLDNFLFDPAKKGQLYWTQRYHIIGGIARGILYLHQDSRLTIIHRDLKASNILLDADMNPKIADFGMARIFGMDQTQQNTSRIVGTYGYMSPEYAMRGQFSMKSDVYSFGVLVLEIISGRKNNSFIETDDAQDLVTHAWRLWRNGTALDLVDPFIADSCRKSEVVRCTHIGLLCVQEDPVKRPAMSTISVMLTSNTMALPAPQQPGFFVRSRPGTNRLDSDQSTTNKSVTVSIDDKSMSDLDPR

SEQ ID NO: 983 - DNA, 2007 bp, Arabidopsis thaliana
  AT4G23180.1
atgagaagaaacacagatcaagaaagcccaattatgtcttattactcctctttcttcttccttttcctcttctcctttctcacgagtttcagagtttctgctcaagatcccacttacgtataccacacctgtcaaaatacggcaaattacacaagtaacagcacttacaacaacaatctcaagacccttttggcttctctttcttcccgcaacgcttcctactccaccggattccaaaacgccaccgtcggccaagctccagacagagtcaccggacttttcaactgccgtggagatgtctcaacggaagtttgccgtagatgcgtctcctttgccgtcaacgacaccttaactcggtgtcctaaccagaaagaagccacactttattacgatgagtgtgtacttagatactctaaccagaatattctctcgacactaataaccaccggtggagttatcttggttaacacccggaatgtgacatctaaccaactagacctgttaagtgatttggttttgcctactctgaaccaagccgccaccgtagccttgaacagttccaaaaaattcggtacgagaaaaaacaattttactgcgttgcagagtttctatggactggttcagtgcacacctgatctcacgagacaagactgttcgcgttgtctccaactggtcatcaatcaaatacctactgacagaattggtgcaagaattattaatccgagctgtacttcaagatacgagatctacgcgttttacaccgaatccgccgttccaccaccaccaccaccaccgtcaatttctactcctccagtttcagctcctccgcgatctggaaaagatgggaattcaaaggtgttagtgatagccattgttgtgcctattatagtggctgttctgctttttatagctggttattgtttccttacaagaagggcaaggaagagttattacacaccatctgcatttgctggagatgatatcacaacagcagactcactacagcttgattatagaacaattcaaactgcaacagatgattttgtagagagtaataagattggtcaaggtggatttggtgaggtttacaagggtactttatcggatgggactgaagttgcggtgaagcgactatcaaagtcatcaggacaaggtgaagtagagttcaagaacgaggttgttcttgttgcaaagctacaacatagaaatctggttagacttcttgggttttgtctagacggagaagaaagagtactggtctacgagtatgtgcccaacaaaagtcttgattacttcctctttgaccctgcaaagaaaggccagctggattggactcgacgatacaagattatcggtggagttgctcgagggattctgtatcttcatcaagactcacgactcacaatcatacaccgtgacctcaaagccagtaacattctcttggacgcggatatgaatcctaaaattgcagattttggaatggctaggatctttggattggaccaaaccgaagagaacacaagcagaatagttggtacctatggttacatgtctcccgagtatgcaatgcatggtcagtactcaatgaaatctgatgtctatagcttcggagtgttagttcttgagattataagtggcaagaagaatagcagcttctaccaaacagatggtgcacatgacttggtctcatatgcttgggggctttggagtaacgggcgaccattagaactcgtggatccagctattgtagaaaattgccaaaggaatgaagttgttcgatgtgtccatatcggtcttttatgtgttcaagaagatcctgctgagcgtccgacgttgtcaaccattgttctgatgctcactagtaacactgtgactttacccgtgccacggcaacccggtcttttctttcagagtagaattggaaaagacccgcttgatacagatacaacgagcaaatctcttctagggtctgttgacgatgcatccatcacagatatacatcctcga

SEQ ID NO: 984 - protein, 669 aa, Arabidopsis thaliana
  AT4G23180.1
MRRNTDQESPIMSYYSSFFFLFLFSFLTSFRVSAQDPTYVYHTCQNTANYTSNSTYNNNLKTLLASLSSRNASYSTGFQNATVGQAPDRVTGLFNCRGDVSTEVCRRCVSFAVNDTLTRCPNQKEATLYYDECVLRYSNQNILSTLITTGGVILVNTRNVTSNQLDLLSDLVLPTLNQAATVALNSSKKFGTRKNNFTALQSFYGLVQCTPDLTRQDCSRCLQLVINQIPTDRIGARIINPSCTSRYEIYAFYTESAVPPPPPPPSISTPPVSAPPRSGKDGNSKVLVIAIVVPIIVAVLLFIAGYCFLTRRARKSYYTPSAFAGDDITTADSLQLDYRTIQTATDDFVESNKIGQGGFGEVYKGTLSDGTEVAVKRLSKSSGQGEVEFKNEVVLVAKLQHRNLVRLLGFCLDGEERVLVYEYVPNKSLDYFLFDPAKKGQLDWTRRYKIIGGVARGILYLHQDSRLTIIHRDLKASNILLDADMNPKIADFGMARIFGLDQTEENTSRIVGTYGYMSPEYAMHGQYSMKSDVYSFGVLVLEIISGKKNSSFYQTDGAHDLVSYAWGLWSNGRPLELVDPAIVENCQRNEVVRCVHIGLLCVQEDPAERPTLSTIVLMLTSNTVTLPVPRQPGLFFQSRIGKDPLDTDTTSKSLLGSVDDASITDIHPR

SEQ ID NO: 985 - DNA, 2010 bp, Oryza sativa
  LOC_Os07g35310.1
atggcgcatcgcgctggctgcctctcgatgctgctcaccgccgccgtcgtgctgctggcgctggcgccgcgtggcgcggcgtacccgtggcaggtgtgcggcacgacgggcaacttcacggccaacagcacgtaccaggccaacctcgacgccgtcgcggcggcgctgccccggaacatctcgtcgtcgccggacctcttcgcgaccgccatggtgggcgccgtgccggagcaggtgtcggcgctggcgctgtgccgcggggacgccaacgccacggagtgctccggctgcctcgccacggcgttccaggacgtgcagaacatgtgcgcctacgacaaggacgccgccatctactacgacccttgcatcctctactactccaacgtccccttcctctcctccgtcgacaacgccgcctcgacgagccgcgtcaacctgcagaacgtcacgtcggacccgggcaggttcaacggcatggtggcggcgctggtgaacgccaccgccgactacgccgcgcacaactccacccgccggtacgcgtccggcgaggccgtcctcgacagggagtcggagttccccaaggtgtacagctgggcgcagtgcacgccggacctgacgccggcgcagtgcggcgactgcctcgccgccatcatagccaagctgccgaggttgttcacgaaccgcatcggcggcagggttcttggagtcaggtgcagctaccggtacgaggtaaaccccttcctcaatggcctggtgatggtgcatctgactgcgccaccgattccgacagcatcaccgcccgccgctgccgcggcggcggccggagaagggaaagattacaatgttcctcgcttggttctagcaattttgctgcctactatagcagctttagtgctaatcaacattctagtttggctctgcttctggaggaggatggagaggctacgatcaggagcaactcagccatattccagcaactctgctgaatcggagaatatttcaagtgtggagtcgatgcttatcgacatttcgactttacgagctgctacagggtgttttgcagaacgcaacaagcttggcgaaggtggatttggtgcagtgtacaagggtactctgcctgatggcgatgaaatagcagtgaagagattatcgaagagttcagcacaaggagtgggagagctgaagaacgagctcgcattggttgcaaagctccagcacaagaatcttgtcaggcttgtcggtgtctgcctggagcaagaggagaggcttctcgtctatgagtttgttcccaaccgcagcctcgatcagatcctctttgacgccgacaagcgtcaacagcttgattggggaaagaggtacaagatcatcaacggcattgctcgtggcctgcaatacctccacgaggactcgcagctcaaggtagtccaccgtgatctcaaagcgagcaacatcttgctcgacatgaacatgaacccgaagatctctgactttgggctcgcgaggctcttcgggcgagaccagacgcagggggtcaccaacctcgtcatcggcacatatgggtacatgtcaccggaatatgcgatgcgaggcaactactccctcaagtccgacgtgttcagcttcggcgtcatggtgctggagatcgtgacggggaagaagaacaacgactgctacaactccctgcaatccgaagacctcttaacccttgtgtgggagcagtggacggcgagggcggtgtcggaggcggtcgacccggtgatgggcggcggtttctcgtggagcgacgtgatgcggtgcatccacatcggtctgctctgcgtgcaggagaaccctgcggatcggccggtgatgtcgtcggtggtgatgatgctcggcagcgacacggtgtcgctcagggcgccgtccaagccggcgttctgtgccaggaggaacggcggcaccggcggtgccggtgccagctcggggggcacgtcgtctggtacgtcgacggcggcgtcggtgcaaggcaag

SEQ ID NO: 986 - protein, 670 aa, Oryza sativa
  LOC_Os07g35310.1
MAHRAGCLSMLLTAAVVLLALAPRGAAYPWQVCGTTGNFTANSTYQANLDAVAAALPRNISSSPDLFATAMVGAVPEQVSALALCRGDANATECSGCLATAFQDVQNMCAYDKDAAIYYDPCILYYSNVPFLSSVDNAASTSRVNLQNVTSDPGRFNGMVAALVNATADYAAHNSTRRYASGEAVLDRESEFPKVYSWAQCTPDLTPAQCGDCLAAIIAKLPRLFTNRIGGRVLGVRCSYRYEVNPFLNGLVMVHLTAPPIPTASPPAAAAAAAGEGKDYNVPRLVLAILLPTIAALVLINILVWLCFWRRMERLRSGATQPYSSNSAESENISSVESMLIDISTLRAATGCFAERNKLGEGGFGAVYKGTLPDGDEIAVKRLSKSSAQGVGELKNELALVAKLQHKNLVRLVGVCLEQEERLLVYEFVPNRSLDQILFDADKRQQLDWGKRYKIINGIARGLQYLHEDSQLKVVHRDLKASNILLDMNMNPKISDFGLARLFGRDQTQGVTNLVIGTYGYMSPEYAMRGNYSLKSDVFSFGVMVLEIVTGKKNNDCYNSLQSEDLLTLVWEQWTARAVSEAVDPVMGGGFSWSDVMRCIHIGLLCVQENPADRPVMSSVVMMLGSDTVSLRAPSKPAFCARRNGGTGGAGASSGGTSSGTSTAASVQGK

SEQ ID NO: 987 - DNA, 2088 bp, Oryza sativa
  LOC_Os07g35580.1
atgtgccgcggatcagtcctcctcctccgtgtccatgccgcgctgcttctcctcgcggcgctcccggcgctgatcgccggccagccgtgggagatatgcggggagaacggcaactacacggcgaacagcacctaccaagccaacctcaagcagctcgccgcggcgctccacaagaacgtctcctccggcaccggcggcggccgcctcttcgcctcgggcgccgtcggcgccgtgccggacgccgtctacgcgctcgcgctctgccgcggcgacatcaacgcctcggcctgcgccgactgcgtcggcaccatcttccaggacgcgcagcagctgtgcccctaccgcaaggaggtgtccatcgtctacgacagctgctacctccgcttctccaacctcgacttcctctcctccgccgacaactccggcgtcgtcgacctctacaacaccgggaccgtctccggcgacgtcggccgctacgaccgcgcggtgacgggcctcctcaacgccacggccaggtacgcggcgggcaacaccaacgcgtcgtccaggctgttcgcgacgggggtgatggtcgggttcgacgcccagttccccaagatctacgccatggcgcagtgctcgccggacctgtcgccggcgcagtgcgggctgtgcctcggcgccatggtggcgcggtggtggcagacgttcgagcccaacacgcagggcgccaggagcgtcggcgcgcgctgcaacatgcgggtcgagctgtactcgttctacaacgtcccttccatgctgcagctgcaagccgaggccgtcgcgccgtcgccatcgccggcgccggcgccggcagggaagccacctgctgtgccgggcactacaggagggaaaaggagaaacggagcaggtaaagttcttgcaattgtaatgcctatagttgctgccatactggcagtcactgtaattggcttttgtttctggaggaggagaagaccagaaaaaacacctccaccaggaccgctccgatccgcatctcgttcggaggactttgagagtattgagtcactttttcttgatctatcaacactccgaatcgcaacagataacttctccgaaaataacaaacttggtgaaggaggatttggtgttgtttataagggatccctaccacatggtgaagagatagcagtaaagaggctctcacaaagctctgtgcaaggaatgggggagctgaaaaatgagctggttttggttgccaagctccagcacaagaatcttgtccgtttggtcggtgtttgtctagaagagcatgagaggatgcttgtctatgaatacatgcccaatagaagcttggataccattctttttgatgctgagaaaagcagtctgctagactggggaagaaggctgaaaataataaacggagtcgctcgaggaatgcagtatctccatgaagattcccagctgaagatcgttcatcgggaccttaaggcaagcaatgttcttctagactctgattacaaccccaagatttcagacttcggcttggcaaggctcttcggaggcgaccaaacacaggacgtcacaaatcgcgttgtcgggacatatggatacatggcgccagagtacgcgatgcgtgggcactactccgttaagtcagacgtgttcagcttcggcgtcctggtcctggagatcgtcacggggaggaggaacagcggctcctactacagcgagcaatccggcgatctcctaagcattatatgggagcactggaccatgggaaccatcatggagatggtggaccggtccatgggcgagcgcgcggcgggcggcgagatcgcgaggtgcatccacgtcgggctgctctgcgtgcaggagaacccggcgagcaggccggccatgtcggcggtgaacgtgatgctgagcagcggcacggtgtcgctcaaggcaccgtccaggccggcgttctacatccggaagggcggcggcgacgacggcggcggcacggggtcgtactcggggtcgttcgtcggcaccttgccgtcgtccggcaggtcggcgcccatgtcgcccaacgaggtgtccatcactgagctcgagccgaga

SEQ ID NO: 988 - protein, 696 aa, Oryza sativa
  LOC_Os07g35580.1
MCRGSVLLLRVHAALLLLAALPALIAGQPWEICGENGNYTANSTYQANLKQLAAALHKNVSSGTGGGRLFASGAVGAVPDAVYALALCRGDINASACADCVGTIFQDAQQLCPYRKEVSIVYDSCYLRFSNLDFLSSADNSGVVDLYNTGTVSGDVGRYDRAVTGLLNATARYAAGNTNASSRLFATGVMVGFDAQFPKIYAMAQCSPDLSPAQCGLCLGAMVARWWQTFEPNTQGARSVGARCNMRVELYSFYNVPSMLQLQAEAVAPSPSPAPAPAGKPPAVPGTTGGKRRNGAGKVLAIVMPIVAAILAVTVIGFCFWRRRRPEKTPPPGPLRSASRSEDFESIESLFLDLSTLRIATDNFSENNKLGEGGFGVVYKGSLPHGEEIAVKRLSQSSVQGMGELKNELVLVAKLQHKNLVRLVGVCLEEHERMLVYEYMPNRSLDTILFDAEKSSLLDWGRRLKIINGVARGMQYLHEDSQLKIVHRDLKASNVLLDSDYNPKISDFGLARLFGGDQTQDVTNRVVGTYGYMAPEYAMRGHYSVKSDVFSFGVLVLEIVTGRRNSGSYYSEQSGDLLSIIWEHWTMGTIMEMVDRSMGERAAGGEIARCIHVGLLCVQENPASRPAMSAVNVMLSSGTVSLKAPSRPAFYIRKGGGDDGGGTGSYSGSFVGTLPSSGRSAPMSPNEVSITELEPR

SEQ ID NO: 989 - DNA, 2031 bp, Oryza sativa
  LOC_Os07g43560.1
atgttgagctgtagtggcaacatgctgcgcgccgtccatgtcctcgccatcgccgccgccgtgctgaccctcgcgcccctcgccgcctcgtacccatggcaggcctgcaacgggagcagcaactacacggcgaacagcgcgttccagcgaaacctcggcgtcctggccgccgccctgcccggcaacgcctccacctcgccggacctcctcgccaacgccaccgtcggcggcgcgcccgacacggtctacgccctcgcgttctgcccgccgatcgacaaccagaacgcctccggctgccgcgcctgcgtcgccagcgccttcgcggacgcgcggagcctgtgcccgaacaacaggggcgcacacatcatctacgacggctgcgtcctcaccttctccggccgggacttcctcggcgccgccaccaacccggcggacatggagaggaagctccggaacaccgagaacgtcaccgtctccgacgtcggcgagttcaacggggccatctacgaggtcctcaacgccacggcggactacaccgccgccgcggcgaggaggttcggcaccggcgagatcagcttcgacccgacctacccggtcatctacagcatggcgtggtgcacgccggacatggcgccggggcgctgccgggcgtgcctggcggacaccatcgcccagatgcacgcctacttcaacccgaacgcgcagggcgccaggctcgtcggcgtgcggtgcgccgcgcggtacgagatttacccgttctacaccggccgcggcatggtgcaggtgccggtgagccggccgccggcggtgccgggaactcccgggaaaaagagtaaaactggtaagattcttgcaattgtactaccgatagtggcagctctacttgctagcgctatgatctgcttttgttgctggaggaggagaacaaaagctactaagctgtcactatcatattcttctcgttctgaggacattcaaaacatcgaatctcttattatggatctaccgacactacggattgccacagataactttgctgaaaacaacaaactaggtgaaggaggatttggtgaagtttacaagggatcctttcccggtggccaaaccatagctgtgaaaaggctctctcagagttctggacaaggcataggagagcttaaaaatgaactggttttaattgccaagctccagcacaagaatctcgtgaggctcgttggagtttgtttggaacaagaagagaagctacttgtctatgaatacatgcctaacaaaagtctagacacatttctttttgaccctgagaaacgcaaacaaatcgattgggcaaagaggttcatgataataaaaggaatcactggaggattgcaatatctgcatgaagattctcaattgaagataattcaccgtgatctaaaagcaagcaacgttctactggacgcaaatatgaaccctaagatttcagactttggcttggcaaggctttttggagatgatcagtcacaagaaacaactaaccgcgttgttggaacttatggatacatggcaccagaatacgctttacgtgggcaatattcaataaagtctgacgtatacagcttcggtgtgttgcttttggagatcatcacaggaagaaaaaacagtgactcctacaactctgaacaagctgttgatcttctgagcctcgtatgggaacattgggcaatgaaaactatcacggagatggttgacccatatttgaggagtgattcttcctctctagatgagattttgaggtgcattcatgttggacttgtatgtgtccaagaggaccctatggataggccaactctgtcaatgatcaatatcatgcttgacggcaatacagtttcagctaaagctccatcgagacctgcatttttcacagaaatgttgggcaatattaatattggttcaagcatgtattcccaaccataccctgtaaccgactccacggccaagcactcgacggccatgtcactaaatgatgtgacagtaacagagcctgaaccaaga

SEQ ID NO: 990 - protein, 677 aa, Oryza sativa
  LOC_Os07g43560.1
MLSCSGNMLRAVHVLAIAAAVLTLAPLAASYPWQACNGSSNYTANSAFQRNLGVLAAALPGNASTSPDLLANATVGGAPDTVYALAFCPPIDNQNASGCRACVASAFADARSLCPNNRGAHIIYDGCVLTFSGRDFLGAATNPADMERKLRNTENVTVSDVGEFNGAIYEVLNATADYTAAAARRFGTGEISFDPTYPVIYSMAWCTPDMAPGRCRACLADTIAQMHAYFNPNAQGARLVGVRCAARYEIYPFYTGRGMVQVPVSRPPAVPGTPGKKSKTGKILAIVLPIVAALLASAMICFCCWRRRTKATKLSLSYSSRSEDIQNIESLIMDLPTLRIATDNFAENNKLGEGGFGEVYKGSFPGGQTIAVKRLSQSSGQGIGELKNELVLIAKLQHKNLVRLVGVCLEQEEKLLVYEYMPNKSLDTFLFDPEKRKQIDWAKRFMIIKGITGGLQYLHEDSQLKIIHRDLKASNVLLDANMNPKISDFGLARLFGDDQSQETTNRVVGTYGYMAPEYALRGQYSIKSDVYSFGVLLLEIITGRKNSDSYNSEQAVDLLSLVWEHWAMKTITEMVDPYLRSDSSSLDEILRCIHVGLVCVQEDPMDRPTLSMINIMLDGNTVSAKAPSRPAFFTEMLGNINIGSSMYSQPYPVTDSTAKHSTAMSLNDVTVTEPEPR

SEQ ID NO: 991 - DNA, 2046 bp, Brachypodium distachyon
  Bradi1g25600.1
atggccacgcgtccccgcgaagccttcctcctcgccgtcgcctttttcctcctcgcgcagttggccaccgctcagcctccatggcagctctgcggcgacagcggcagctacacggcgaacagcacataccaatccaacctggggaagctctccgccgcgctccccaagaacgcctccgcgtcccggggggcccttttctccgccggcagcgccggctccgtcccggacatcgcctacgcgctcgcgctctgccgcggggacgtcaacgcctccgcctgcgagcgctgcgtcgccaccgccttccaggacgcgcagcagctctgcgcctacaagaaggacgccgccgtcttctacgacgcctgctacctccgcttctccaaccaggacttcctcgccaccaccaccgacaacggcaaccccatgatcctcctgaactcacagaacgtgagctcgccggtggcggtgttcgacgccgccgtccgcgctctcctcaacgccaccagcgactacgcggccgcgaacaacaactccaccaggcggcggttcgccacgggggaggagagcttcgacagcgcgaacctcaccatctacgggctcgcgcagtgcacgccggacatgtcgcctgccgactgccggagctgcctcgggagcataatcgccatggcgccgcagtatctcagcgggagcctgggagggagggttattgggatgcgctgcaatttcaggtacgaggtgtattctttcttctccggtggccccatgctgcggctgtcagcacccaccgcgccggcgccggcaccaccgcctacgcctttcaatgtgacgccgacggcaaccccaggaaggaaatcaggaaataagacggtggctgttctagcaattgccctgcctatatttgctgcagtttcagctataactacgatttgtctctgttatttgaggagtagaagaagaccagcaagcagtgagccaccatcttattcaactaaccatgaggacgttgaaagcattgagtcacttatcattgatctatctaccttacgtgctgcgacgaacaactttgctgagacgaataagcttggtgaaggaggatttggtgcagtttataagggagaccttcctgatggtcaagaaatagcagtaaagaggctttccaggagttcaggacaaggaataggagagctcaagaatgagcttgttttggtcgccaagcttcaacacaagaaccttgtcaggcttgtcggcgtctgcttgcaagaacatgagaaactgcttgtgtatgaatacatgccgaatagaagtatcgacaccatcctttttgatccagagaaaagtaaggagctagactggggaaagagattaaagataataagtggagttgcccgaggattacaatatcttcatgaagattcacaactgagaataattcaccgggacctcaaagcaagtaatgtcctattagactctgattacactcctaagatatccgacttcggtttggcaaggctattcggggcagatcaaacacgggaggtcacaaaccgtgtcgttggaacatatggatatatggcccctgagtacgcgatgcgcggccactattcggtaaagtcagacgtgtttagctttggcattttgatcttggaatttatgacaggaagaagaagcagtggctcctatacctttgatcagtctgtcgatctcttaagtcttatatgggagcactggtctacgggaacgattgcggagatcatagactcaactctgaaaactcatgctccaggagaccagatgcttaagctttttcacatcggacttatgtgtgttcaagataacccagcggataggcctatgatgtcaacaataaacatcatgctaagcagtaacaccgtgtcgctccagtctccatccaagccatcatttttcatcaccaagagcagcacaaactcaatggcgtactcagactcgtaccctaccgcttcccagtcgaccggtaagtcaggaatagtgtcaccaaatgaagtctcaatcacagagctggaaccaaga

SEQ ID NO: 992 - protein, 682 aa, Brachypodium distachyon
  Bradi1g25600.1
MATRPREAFLLAVAFFLLAQLATAQPPWQLCGDSGSYTANSTYQSNLGKLSAALPKNASASRGALFSAGSAGSVPDIAYALALCRGDVNASACERCVATAFQDAQQLCAYKKDAAVFYDACYLRFSNQDFLATTTDNGNPMILLNSQNVSSPVAVFDAAVRALLNATSDYAAANNNSTRRRFATGEESFDSANLTIYGLAQCTPDMSPADCRSCLGSIIAMAPQYLSGSLGGRVIGMRCNFRYEVYSFFSGGPMLRLSAPTAPAPAPPPTPFNVTPTATPGRKSGNKTVAVLAIALPIFAAVSAITTICLCYLRSRRRPASSEPPSYSTNHEDVESIESLIIDLSTLRAATNNFAETNKLGEGGFGAVYKGDLPDGQEIAVKRLSRSSGQGIGELKNELVLVAKLQHKNLVRLVGVCLQEHEKLLVYEYMPNRSIDTILFDPEKSKELDWGKRLKIISGVARGLQYLHEDSQLRIIHRDLKASNVLLDSDYTPKISDFGLARLFGADQTREVTNRVVGTYGYMAPEYAMRGHYSVKSDVFSFGILILEFMTGRRSSGSYTFDQSVDLLSLIWEHWSTGTIAEIIDSTLKTHAPGDQMLKLFHIGLMCVQDNPADRPMMSTINIMLSSNTVSLQSPSKPSFFITKSSTNSMAYSDSYPTASQSTGKSGIVSPNEVSITELEPR

SEQ ID NO: 993 - DNA, 2037 bp, Oryza sativa
  LOC_Os07g35290.1
atggcgcgccaccgcgtacgctgcctcctcgccgccgcgctcctcctcgtcgcgccgatggcggcggcccagccgtggcagttctgcgggcagagcggcaacttctcggcgaacagcgcgtaccagtccaacctccgccagctctccgccaccctccccaagaacgcctccgccgccctcttcgcggccggtagcctcggcaccgtcccggacatcgtctacgcgctcgcgctctgccgcggcgacgccaacgcctccgcctgcgagtcctgcgtcgacaacgccttccaggggggccagcagctgtgcccctacaacaaggacgtgttcatcgtctacgacctctgctacctccgcttcaccaaccgcaacctcctcgcctccgccacggacaacgggagccccatgatgctcatgaacgcgcagaacgcgagcgcgacggcggaggtgttcgacgccgccgccgccaccctcctcaacgccaccagcggctacgcggcggcgaactcgtccaggcggttcgccacgggggaggaggccttcgatgccgccgaccccaccatctacgggctgtcccagtgcacgccggacatgtcgccggacgactgccggagctgcctcgggggcataatcgcgttgatacctcagtacttcggccggaagaggggcgcgagggttatcgggacgcgctgcaactacaggtacgaggtgtatcctttcttcgccggaggctcgatgctgcggctcccggcgccggcggcgccggcggcgcctccgcctgcacctggaccagcaaacatgaccccaccggcgcacaccggagaaagaaagaaaaataaaagtggaacagctctagccattgcactgcccctagttgttgtattgctggctatggttgccatttgtttttctgttcagaggcggagaaaaagatcaaggtcaaaacagcaacattcatattcaatgcaaatgggggaggacattgaaagcgtagattcactttttatcgatctatcaacgctgcgtgctgcgacaggtaacttttccgagacaaataggcttggtgaaggaggatttggttcggtttataagggtgtccttcctaatggtgaagagatagctgtaaagaggctctctatgagttcaggacaaggaatagaagagctaaagaatgagcttgttttggtcgccaaacttcagcacaagaatcttgttaggcttgttggtgtttgcttgcaagaacatgagaaattgcttgtgtatgaatacatgcccaatagaagtatcgacaccattctatttgatcttgacaaaaggagggaactagactggggaaaaagatttaggataataaacggaattgctcgaggattacaatatcttcaagaagattctcagctgagaataattcaccgggacctcaaagcaagcaatgttctattggactccgactatactcctaagatttcggattttggtttggcaaggctatttgggggtgatcaaacaagggagatcacacgccatgttgtcggaacgtacggatatatggcgccagaatatgcgatgcgtgggcactattctgtaaagtcagatgtctttagctttggcatattgatgatagaaattgtgacaggaaggagaagcagtggttcactcagctttgatcaatcaaacgatctcctaagtcttgtatgggagcactggaccatgggaacaattttggagatgatggatccctctcttacaagccatgctcctcgagaccagatgctcaagtgtattcacattgggctactgtgtgttcaagataacccagcagatagacctatgatgtcaacagtgaatgtcatgcttagcagcagcacagtgtctcttcaatctccatccaagccatcatttttcattcccaaaagtgacacagactcaaatatatactcggaatcacacccactaacttcccaatcgactgcctcgaccggtaggtcgggagggatgtcagttaatgatgtgtcaattacagagcttgaaccaaga

SEQ ID NO: 994 - protein, 679 aa, Oryza sativa
  LOC_Os07g35290.1
MARHRVRCLLAAALLLVAPMAAAQPWQFCGQSGNFSANSAYQSNLRQLSATLPKNASAALFAAGSLGTVPDIVYALALCRGDANASACESCVDNAFQGGQQLCPYNKDVFIVYDLCYLRFTNRNLLASATDNGSPMMLMNAQNASATAEVFDAAAATLLNATSGYAAANSSRRFATGEEAFDAADPTIYGLSQCTPDMSPDDCRSCLGGIIALIPQYFGRKRGARVIGTRCNYRYEVYPFFAGGSMLRLPAPAAPAAPPPAPGPANMTPPAHTGERKKNKSGTALAIALPLVVVLLAMVAICFSVQRRRKRSRSKQQHSYSMQMGEDIESVDSLFIDLSTLRAATGNFSETNRLGEGGFGSVYKGVLPNGEEIAVKRLSMSSGQGIEELKNELVLVAKLQHKNLVRLVGVCLQEHEKLLVYEYMPNRSIDTILFDLDKRRELDWGKRFRIINGIARGLQYLQEDSQLRIIHRDLKASNVLLDSDYTPKISDFGLARLFGGDQTREITRHVVGTYGYMAPEYAMRGHYSVKSDVFSFGILMIEIVTGRRSSGSLSFDQSNDLLSLVWEHWTMGTILEMMDPSLTSHAPRDQMLKCIHIGLLCVQDNPADRPMMSTVNVMLSSSTVSLQSPSKPSFFIPKSDTDSNIYSESHPLTSQSTASTGRSGGMSVNDVSITELEPR

SEQ ID NO: 995 - DNA, 2073 bp, Zea mays
  GRMZM2G340048_T01
atggccacagcagcgcccggtcccggctcccggtcgcggctcctcccccttgccctctcctccttcctcctcctcctcctcctcctcctcatcgcgccgggggccgccgcgcagccgtggcaatcctgcgggaacacggacaactactcagccaatagcacttaccagtccaacctcgcgagcctcgccaaggcgctccccgcgaacgcatcccggtcggcgacgctattcgcggagggcagcgccggcgccctccccgacgccgtctacgcgctcgcgctctgccgcggggacatcaacgccacggcctgcggcgcctgcgtcaccacggcgttccaggacgcgcagcagctgtgcgcctacaacaaggacgccgccgtgttctacgacgcctgctacctccgcttctccaacaaggacttcatcgccagcgccaccaacaacggcgatgccatagtcctcatgaactcgcagaacgtgagcccgcccgtgcgggccttcgacgccgccgtcgccgtgctcctcaacgccaccgccgactacgccgcggccaactcgtcacggcggttcgccacgggggaggagggcttcgacgcgaccgatcccaccatctacgggctcacgcagtgcacgccgaacatgtcgcccgccgagtgccggacctgcctccggagcataatttccgatatgccgcagtacctcagcggcaggcggggcgggaggattatcggcatgcgctgtaatttcaggtatgatctctattctttcttctccggggggccgtcgctgcggctgccagcgccgtccgcgccggcgccggcaccgtctcctgcgcaggttaacgtgacgccgacggtaaccccaacagggagaagcagaaacagaacgggaattgttatagcaattgtattgcctatagttgctggcgtgctagctataactatggtttgtctctgtttcctgtggaggagaaggccagcaagagatcagacatcatcttattcagttaatcaatcagagattgaaagtattgattcacttcttctcgatatatcaatgctacgtgctgcaactgataactttgctgagagcaataggcttggtgaaggaggttttggtacagtctataagggtgtccttcctgacaaccaagaaattgcagtgaagaggctctcacagagctcagggcaaggaatacaagagctgaaaaatgagcttgttttggttgccaagcttcagcacaagaatcttgtcaggcttgttggtgtttgcttgcaagaatatgagaaactgcttgtgtatgaatacatgcccaacaaaagcatcgacaccattctttttgattctgagaaaagcaaggagctagattggggaaagagagttaagataatagatggaattgctcgagggttacagtatctccatgaagattctcagttgaagattattcaccgggaccttaaggcgagcaatgtccttttaaactctgattatactcctaagatatctgattttggcctagcaaggctatttggtggggatcaatcacgggaggtcacaaatcgagtcgtcggaacatatggatatatgtctccagagtatgccatgcgtggccactattctataaagtcagatgtcttcagcttcggcgtcttgatcctggaaatattaaccggaagaagcagcagtggttcctttaatatcgagcaatctgttgatctcttaagtcttgtctgggagcactggacaatgggaacaattgtggagatcatggatccatctctgagaggcaaagctcctgcagaacagatgctgaaaaatgtccatatcgggctactgtgtgttcaagataaccctgttgatagaccgaagatgtcaacagtaaacatcatgctcagcagtggcactatgcctctccagtctccattaaagccagcattcttcattcccaagagcggctactactcaactgttcattcagaatcatatcctatagcttcccgatccgtcgataatggcaagccaggggcgatatcaccaaacgaagtgtcaattacagagctggaaccaaga

SEQ ID NO: 996 - protein, 691 aa, Zea mays
  GRMZM2G340048_T01
MATAAPGPGSRSRLLPLALSSFLLLLLLLLIAPGAAAQPWQSCGNTDNYSANSTYQSNLASLAKALPANASRSATLFAEGSAGALPDAVYALALCRGDINATACGACVTTAFQDAQQLCAYNKDAAVFYDACYLRFSNKDFIASATNNGDAIVLMNSQNVSPPVRAFDAAVAVLLNATADYAAANSSRRFATGEEGFDATDPTIYGLTQCTPNMSPAECRTCLRSIISDMPQYLSGRRGGRIIGMRCNFRYDLYSFFSGGPSLRLPAPSAPAPAPSPAQVNVTPTVTPTGRSRNRTGIVIAIVLPIVAGVLAITMVCLCFLWRRRPARDQTSSYSVNQSEIESIDSLLLDISMLRAATDNFAESNRLGEGGFGTVYKGVLPDNQEIAVKRLSQSSGQGIQELKNELVLVAKLQHKNLVRLVGVCLQEYEKLLVYEYMPNKSIDTILFDSEKSKELDWGKRVKIIDGIARGLQYLHEDSQLKIIHRDLKASNVLLNSDYTPKISDFGLARLFGGDQSREVTNRVVGTYGYMSPEYAMRGHYSIKSDVFSFGVLILEILTGRSSSGSFNIEQSVDLLSLVWEHWTMGTIVEIMDPSLRGKAPAEQMLKNVHIGLLCVQDNPVDRPKMSTVNIMLSSGTMPLQSPLKPAFFIPKSGYYSTVHSESYPIASRSVDNGKPGAISPNEVSITELEPR

SEQ ID NO: 997 - DNA, 2064 bp, Zea mays
  GRMZM2G374309_T01
atggcaacggccacggccgcgttgggtcgcgtcgcctccccgcgcctcgtcatgggctaccttctcttcctcaccgtcgcctccctcctcctcttctcgccgcgggccgctgcgcaggcgtggcagctctgcgggaacaccggcaactacacggccaacagcacctaccagtccaacctcgaaagcctcgccaaggcgctctccgcgaacgcgtcccgctcgaggaacctcttcgcggagggcagcgtcggcgccgtcccgtatgtcgtctacgcgctcgcgctttgccgcggggacaccaacgccacggcctgcggctcctgcgtcgccacggggtttcaagacgcgcagcagctctgcccctacaagaatgacgcggccgtggtctacgacgactgctacctccgcttctccaaccaggatttcatcgccagcaccaccgacaacggcaatgataacatcatcctcatgaacactcagagcgtgagctcgccggtgcaggcgttcgacgccgccgtcgtcatgctcctcaacgccaccggcgactacgcggcggcgaactcgtcgcggtttgccacgggggaagagggcttcgacgccagctaccccaccatctacgggctcacgcagtgcacgccggacatgtcgtccgcagactgccggagctgccttgggagcataatatcggcgatgccagggtctctcagcggaagtaagggcgggaggattatagggacgcggtgcaatttcaggtacgaggtgtattctttcttctccggagcgccctcgctacgtctgccagcggcgtcgccaccggcgccactgccatctcctacggcatttaacgtgacgccgacggcaaccccaccaggaagaaccagaaccaaaacaggacttgctttagcaattgtgttgccgataattgctgcggtgctagcgatcagttttgtttgtctatgtttcttctcgaggaggagaaaacaagcaagggagcagacaccatcttattcaacaattgctggagacatggaaagcatcgagtcacttctttttgatatatcaactttacgtgccgcgactggtaactttgccgagagcaataggcttggtgaaggaggctttggtgctgtctataagggcatccttcgtgatggtcaagaaattgcagtgaagaggctgtcacagagttcagggcaagggatacaagagctgaaaaacgagcttgttttggttgccaagctccaacaaaagaaccttgttaggcttgttggtgtttgcttgcaagaacatgagaaactgcttgtgtatgaatacatgcccaatagaagcatcgacaccatccttttcgatcctgagagaaacaaggagctagattggggaaccagattcaagataataaatggaattgccagaggactacagtatctccatgaggattctcagctgaagatcattcaccgggaccttaaagcgagcaatgtccttttagactctgattatacacctaagatttcagattttggcctggctaggctatttggaggggatcaaacccgggagattacaagtcgcgttgttggaacatatgggtatatggcacccgagtatgccatgcgtggccactattctataaagtccgatgttttcagctttggcgtcttggttctagaaatcttaaccggaagaagaagcagtggttcctttaacatcgaccagtctgttgacctcttaagtcttgtttgggagcactggaccatgggaacaattgctgaggttatggacccatctctgagaggcaaagctcctgcacagcagatgctgaaatgtgtccacatcgcgctactgtgtgttcaggacagtccggtcgataggccgatgatgtcgacagtaaacgtcatgctcagcagcagcacttcctctctccaggctccgttgaagccagtatttttcattcccaagagtggttattactcaactgtttattcagaatcatatcctacagcttcccaaaccacaggggcggtatcaccaaatgaagtgtcaattacagaattggaaccaaga

SEQ ID NO: 998 - protein, 688 aa, Zea mays
  GRMZM2G374309_T01
MATATAALGRVASPRLVMGYLLFLTVASLLLFSPRAAAQAWQLCGNTGNYTANSTYQSNLESLAKALSANASRSRNLFAEGSVGAVPYVVYALALCRGDTNATACGSCVATGFQDAQQLCPYKNDAAVVYDDCYLRFSNQDFIASTTDNGNDNIILMNTQSVSSPVQAFDAAVVMLLNATGDYAAANSSRFATGEEGFDASYPTIYGLTQCTPDMSSADCRSCLGSIISAMPGSLSGSKGGRIIGTRCNFRYEVYSFFSGAPSLRLPAASPPAPLPSPTAFNVTPTATPPGRTRTKTGLALAIVLPIIAAVLAISFVCLCFFSRRRKQAREQTPSYSTIAGDMESIESLLFDISTLRAATGNFAESNRLGEGGFGAVYKGILRDGQEIAVKRLSQSSGQGIQELKNELVLVAKLQQKNLVRLVGVCLQEHEKLLVYEYMPNRSIDTILFDPERNKELDWGTRFKIINGIARGLQYLHEDSQLKIIHRDLKASNVLLDSDYTPKISDFGLARLFGGDQTREITSRVVGTYGYMAPEYAMRGHYSIKSDVFSFGVLVLEILTGRRSSGSFNIDQSVDLLSLVWEHWTMGTIAEVMDPSLRGKAPAQQMLKCVHIALLCVQDSPVDRPMMSTVNVMLSSSTSSLQAPLKPVFFIPKSGYYSTVYSESYPTASQTTGAVSPNEVSITELEPR

SEQ ID NO: 999 - DNA, 2043 bp, Setaria italica
  Si029127m
atggacacggccgcgcggcgccgcggcgtcctcccactcctcgtcacgggccttctgctcgccctcgcgccgctggccgccgcgcagccgtggccccattgcgggagcaccggcggcaactacacggccaacagcacctaccagtccaacctcgcacagctcgccgcggcgatccgcgcgaacgcgtcccggtcggggaacctcttcgccacgggcagcgtcggcgccgtcccggacatcgtctacgctctggccctctgccgcggcgacaccaacgcttcctcctgcggggactgcgtgaccacggcgttccaggacgcgcagcagctgtgcccctacaacaaggacgcgacggtgctgtacgacctctgctacctgcgcttctccaaccagaacttcctcgcctccaccagcaacagcaaccccgtcatgctcaggaacacccagaacgtgaactcgccggtgcgggctttcgaggccgcagtcggcgtgcttctcaacgccaccggcgactacgcggcggcgaattcgtccaggaggttcgctacgggggaggagggcttcgacaccagcaaccccaccatctacgggctcacgcagtgcacgccggacatgtcgccccccgactgccggagctgccttgggagcataatcgcgatggtgccgcagttcagagggagccagggcgggagggtcatcggattgcggtgcaatttcaggtacgaggtgtattctttcttctccgggggaccgtcgctgcggctgcccgcgccgtccacgccggcgccggcgccatctcctacgccagttaacgtgacgccgacggcaaccccgccagggagacgcagaaacaaagcaggaattgttgcagcaattgcaatgcctatagttgctgcggtgctagctatcagtacggtttgtctctgtttcctgtggaggaggagaagaccagcaagagaacagacaccatcttactcaactaatgatgcggacatcgaaagcatcgattcacttcttcttgacatatcaactttacgtgctgcgaccgatcactttgctgagagcaataggcttggtgaaggaggttttggtgcggtctataagggtgtccttcctgatggccaagaaattgcagtgaagaggctctcacagagttcaggccaaggaatacaagagctgaaaaatgagcttgttctggttgccaaactgcaacaaaagaatcttgttaggcttctcggtgtttgcttgcaagaacatgagaaactgcttgtgtatgaatacatgcccaatagaagcattgacactattcttttcgatcctgagaaaagcaaggagcttgattgggaaaagagagtcaagataataaatggaattgctcgaggattacagtatctccatgaagattctcagttgaagattattcaccgggatcttaaagcgagcaatgtccttttggactctgattatactcctaagatttcagattttggcttggctagattatttggaggggatcaatcacgggagatcactagtcgagttgttggaacatatggatatatgtcacccgagtatgccatgcgtggccactactctataaagtctgatgtattcagctttggggtcctgattctagaaatcttaaccggaagaagaagcagcggctcatttaatttcgagcaatctgttgatctcttaagtcttgtttgggagcactggaccacggggacaattgtggagattatggatccatctctgagaggcaaagctcctgcagaacagatgctgaagtgtgtccacatagggttactatgtgttcaggataacccggttgacagaccgatgatgtcaacagtaaatgtcatgctcagcagcggcactgtctctcttcaggctccattgaagccagtatttttcattcccaagagcggctactcaactgtttattcagaatcatatcctacagcttcccagtccaccggcaacggtaaaacaggggtgatgtcaccgaatgaagtgtcgatcacagaactggaaccaaga

SEQ ID NO: 1000 - protein, 681 aa, Setaria italica
  Si029127m
MDTAARRRGVLPLLVTGLLLALAPLAAAQPWPHCGSTGGNYTANSTYQSNLAQLAAAIRANASRSGNLFATGSVGAVPDIVYALALCRGDTNASSCGDCVTTAFQDAQQLCPYNKDATVLYDLCYLRFSNQNFLASTSNSNPVMLRNTQNVNSPVRAFEAAVGVLLNATGDYAAANSSRRFATGEEGFDTSNPTIYGLTQCTPDMSPPDCRSCLGSIIAMVPQFRGSQGGRVIGLRCNFRYEVYSFFSGGPSLRLPAPSTPAPAPSPTPVNVTPTATPPGRRRNKAGIVAAIAMPIVAAVLAISTVCLCFLWRRRRPAREQTPSYSTNDADIESIDSLLLDISTLRAATDHFAESNRLGEGGFGAVYKGVLPDGQEIAVKRLSQSSGQGIQELKNELVLVAKLQQKNLVRLLGVCLQEHEKLLVYEYMPNRSIDTILFDPEKSKELDWEKRVKIINGIARGLQYLHEDSQLKIIHRDLKASNVLLDSDYTPKISDFGLARLFGGDQSREITSRVVGTYGYMSPEYAMRGHYSIKSDVFSFGVLILEILTGRRSSGSFNFEQSVDLLSLVWEHWTTGTIVEIMDPSLRGKAPAEQMLKCVHIGLLCVQDNPVDRPMMSTVNVMLSSGTVSLQAPLKPVFFIPKSGYSTVYSESYPTASQSTGNGKTGVMSPNEVSITELEPR

SEQ ID NO: 1001 - DNA, 2061 bp, Brachypodium distachyon
  Bradi1g25647.1
atggcctcgcaccaccagcaccaccacctcccctcccacctcgcccccgccgcggccctactcctcgccttcctcctcgcgccgccggccgccgccctgacgccgctctgcggcaagaacagcaactacaccgccaacagcacctaccaggccaacatccgggccctctccctaaccctacccaagagcgccaactcgtcgcggacgctcttcgcgaccggaagagtcggcgccctgccggacatcgtctacgcgctcgccctctgccgcggcgacaccagcgcctccgcctgcggcgcctgcgtcgccaccgccttccaggacgcgcagcagctctgcgcctacgacagggacgcctccgtcttctacgacccttgcttcctccgcttctccgaccagaacttcgtgtccgacaccagcggcgacaacggcaactccatcgccctgatgaacacgcagaacgtgaccgcgccggtgaagctgttcgacgacgccgtgggcgtgctgcttaacgccaccgcggattacgcggccgcgaactcctccaggcggttcggcacaggggaggccgggttcgagacggtcgacaaggggtacccgaagatttacgggcttgcgcagtgcaggccggacatggcatcggccgattgccggagctgcctcgcgaatatcatcagggacatgcccaaattcttcagcgggaagcagggtggtaggattattggaattcagtgcttctacaggtatgagcagtatccgttcttcttcgggccttcgctgctgcagctcccggcgccttccttgggggcagctccagagccggcgccggcgaacgcgacgccaccggaaaccggaggaggtggaacaacgaacagtgctggtaggattttagcgattgccctgcctatagccgctgcaattatggctgctgtcatgttttgcctttgtctgtggatgaggaagaggaaaccggcacgaaagcaatcactagcttatccaaccaatccagaggacatacagactatcgattcactcattcttgacctatcaactctacgagtcgcaacagataactttgatgaaagcaataaacttggcgaaggagggtttggtgcagtttataagggagtccttgctggcgatgaggaaatagcagttaaaagactctcacaaagttctcgacaagggatagaggagctaaaaaatgagcttgttttggttgctaagcttcaacacaagaatttagtgagacttctcggtgtttgcttggaagaaaatgaaaaattacttgtgtatgaatacatgcccaacaaaagcattgacaccattctttttgatcctgatagaagcagtcagctagattggggaaagagatttaggattgtcaatgggattgctcgaggcttacaatatctccatgaagattctcagctcaaaataattcatcgggaccttaaagcaagcaatgttctgttagacaatgaatttaatcctaagatttcagattttgggttagcaaggctgttcggaagtgatcaatcacaagatgtcacgaaccgtgtcgtcggaacctatggatacatggctccggagtacgctatgcgtgggaattactccatcaagtccgatgtgtttagctttggtattttaatactagaaatcgtcacaggaagaaggaacagcggctcatttgactcggagcaatctgttgatctcttaagttttgtatgggagcattggacaatgggaacaattctagaaacaatggattcatccctgactaagcattctcctggagaccagatgctgaagtgcattcacgtgggacttctttgtgttcaagaagacccggcagatagaccgatgatgtcggtggtgaatgtcatgctgagcagcagcaccgtgtcactccaagctccatctaggccagcattttgcttccaaaattggggcaccaaagattcagacatgcactcggagccattccgaggagtttcgcagtccacggacaggttgcctatgtcaccgaacgaagtttcgattactgaacttgaaccgaga

SEQ ID NO: 1002 - protein, 687 aa, Brachypodium distachyon
  Bradi1g25647.1
MASHHQHHHLPSHLAPAAALLLAFLLAPPAAALTPLCGKNSNYTANSTYQANIRALSLTLPKSANSSRTLFATGRVGALPDIVYALALCRGDTSASACGACVATAFQDAQQLCAYDRDASVFYDPCFLRFSDQNFVSDTSGDNGNSIALMNTQNVTAPVKLFDDAVGVLLNATADYAAANSSRRFGTGEAGFETVDKGYPKIYGLAQCRPDMASADCRSCLANIIRDMPKFFSGKQGGRIIGIQCFYRYEQYPFFFGPSLLQLPAPSLGAAPEPAPANATPPETGGGGTTNSAGRILAIALPIAAAIMAAVMFCLCLWMRKRKPARKQSLAYPTNPEDIQTIDSLILDLSTLRVATDNFDESNKLGEGGFGAVYKGVLAGDEEIAVKRLSQSSRQGIEELKNELVLVAKLQHKNLVRLLGVCLEENEKLLVYEYMPNKSIDTILFDPDRSSQLDWGKRFRIVNGIARGLQYLHEDSQLKIIHRDLKASNVLLDNEFNPKISDFGLARLFGSDQSQDVTNRVVGTYGYMAPEYAMRGNYSIKSDVFSFGILILEIVTGRRNSGSFDSEQSVDLLSFVWEHWTMGTILETMDSSLTKHSPGDQMLKCIHVGLLCVQEDPADRPMMSVVNVMLSSSTVSLQAPSRPAFCFQNWGTKDSDMHSEPFRGVSQSTDRLPMSPNEVSITELEPR

SEQ ID NO: 1003 - DNA, 2067 bp, Brachypodium distachyon
  Bradi1g25657.1
atggcctcgccctaccagcgccgccacctcccctcctccttcctcgcccccgccgcggccctactcatcgccttcctcctagcgccgctagcctccgcccaaacgccatggaagtcctgcggcgggagcagcaactacaccttgaacagcacctaccaggccaacatccggctcctctccaccaccctacccaagaacacctcctcgtcgcggacgctcttcgcgaccgaaagcgtagggaccctgccggacatcgtctacgcgctcgctctctgccgcggcgacaccaacgcctccgcctgcggcgactgcgtcgccactgccttccaggacgcgcagcagctctgcgcctacgacaaggacgccaccgtctattacgacccctgcttcctccgcttttccaaccagaatttcctctcctctaccggcggcgacaacggcaaccccctcatcctgacgaacacacagaacgtgaccgcgccggtgaaggtgtttaacgatgctgtgggcgtgctcatgaacgccaccgcggattacgcggccaggaactcctccaagcggttcgccacaggagaggagggattcgagacggtcgacaagggaaaaccaaagatttacgggctggcgcagtgcaggcctgacatggcatccaacgattgccggagctgcctcgcaaatatcatcccgtacatactccaatacatgagcgggaagcagggcggtaggattcttggaattcagtgcaactacaggtacgagcagtatccattcttcaccggtccttcgctgctacagctcccggcgccttccttgggggcagctccagagccagcgccggggaatccaacgctaccggtggccggaggagcaggaacaacaaacagtactggcaggattttagcaatcgcactgcctatagtcgctgcaattttggctgctgtaatattttgtctttgtctgtggaggaggaagaggaaaccggcacgaaagcaatcactaccttattcaaccaatccagaggacatacaaactatcgattcactcattcttgatctagcaactctacgagtcgcaacagataactttgacgaaagcaataaacttggtgaaggagggtttggtgcggtttataagggaatccttgctggcgatgaggaaatagcagttaaaagactctcacaaagttctcgacaaggaatagaggagctgaaaaatgagcttgtcttggttgctaagcttcaacacaagaatttagtgagacttgtgggtgtttgcttggaagaacatgaaaaattacttgtgtatgaatacatgcccaacaaaagcatcgacaccattctttttgattctgaaagaagcagtcagctagattgggggaaaagatttaggattatcaatgggattgctcgaggcttacaatatctccatgaagattctcagctcaaaataattcatcgggaccttaaagcaagcaatgttctgttagacaatgaatttaatcctaagatttcagattttgggttagcaaggctattcggaagtgatcaatcacaagatgtcacgaaccgtgtcgtcggaacctatggatacatggccccagagtacgctatgcgtgggaattactccatcaagtcagatgtttttagctttggtgtgttgatactagaaattgtcacaggaagaagaaacagtggctctgagtcagagcaatctgttgacctcttaagtttggtatgggagcactggacactgggaacaattctagagatcatggattcatccatgactaaccattctcctggagaccagatcctgaagtgcattcacgttggacttctttgtgttcaagaggacccagcagatagaccgatgatgtcggtggtgaatgtcatgctgagcagcagcaccgtctctctccaagctccatctaggccagcattctgcatccaaaagtggggtaccaaagactcagacatacactcggagccataccgaggagtttcgcagtccaccagcaggtcacctatgtcaccaaacgaagtttctattactgaacttgagccgaga

SEQ ID NO: 1004 - protein, 689 aa, Brachypodium distachyon
  Bradi1g25657.1
MASPYQRRHLPSSFLAPAAALLIAFLLAPLASAQTPWKSCGGSSNYTLNSTYQANIRLLSTTLPKNTSSSRTLFATESVGTLPDIVYALALCRGDTNASACGDCVATAFQDAQQLCAYDKDATVYYDPCFLRFSNQNFLSSTGGDNGNPLILTNTQNVTAPVKVFNDAVGVLMNATADYAARNSSKRFATGEEGFETVDKGKPKIYGLAQCRPDMASNDCRSCLANIIPYILQYMSGKQGGRILGIQCNYRYEQYPFFTGPSLLQLPAPSLGAAPEPAPGNPTLPVAGGAGTTNSTGRILAIALPIVAAILAAVIFCLCLWRRKRKPARKQSLPYSTNPEDIQTIDSLILDLATLRVATDNFDESNKLGEGGFGAVYKGILAGDEEIAVKRLSQSSRQGIEELKNELVLVAKLQHKNLVRLVGVCLEEHEKLLVYEYMPNKSIDTILFDSERSSQLDWGKRFRIINGIARGLQYLHEDSQLKIIHRDLKASNVLLDNEFNPKISDFGLARLFGSDQSQDVTNRVVGTYGYMAPEYAMRGNYSIKSDVFSFGVLILEIVTGRRNSGSESEQSVDLLSLVWEHWTLGTILEIMDSSMTNHSPGDQILKCIHVGLLCVQEDPADRPMMSVVNVMLSSSTVSLQAPSRPAFCIQKWGTKDSDIHSEPYRGVSQSTSRSPMSPNEVSITELEPR

SEQ ID NO: 1005 - DNA, 2079 bp, Zea mays
  GRMZM2G076987_T01
atgaccacggttgcgcaccatcaccacctcgccgctgccaccgtgctcttcttcgtcgcattcaccatggcgcctctcgccgccggggaccccgtgggccagctctgcggtaccagcggcaactacacgctcaacagcacctaccagggcaacatccgccgcctcgccgccacgctgccgaagaacgcctccacctccgcgacgctcttcgccacggacaccttcggcgccgtcccggacatcgtctacgcgctcgcgctctgccgcggcgacaccaacgcctccgcctgcagcggctgcgtcgccgccgcgttcctggacgcgcagcagctgtgcgcctacaacaaggacgccaccatgttctacgacccctgcctcctccgctactccaaccagaacttcctcgccgaccccagcagcgatggccgcgggaccgcgctcatcctcatgaacacgcagaacgtcaccgcgcggttcaaggtgttcgacgccgccgtcgccgcgctcctcaacgccaccgccgcctacgcggccgccaattcgtccaaaaggttcggcaccggggtcgaggcgttccagaacttcgacagcaaccgcccgaggatctacgggctggcgcagtgcacgccggacatgacgccggccgactgccagagctgcctctcgggtattatccagacggggcccaagtatttcagcgggaagcagggtggcaggattcttagtgtgcggtgcaactacaggtatgagcagtacccgttctttacaagcaccccactgcttcagctggcggagcctaccgtgggggccccggcgcccgcgcccgcggtggtcaacggaactccaacgccaccgacgaccggaggagcacgacgaggaacaacaggaaataaaactggtagagttttagccattacactgcctatagttgctgcagtgctagctactgtagtactttgttcatgcctctggaggaggaagaggaaaacacaagggaagtcgtcactaccagatacaactaaccctgaggacatacaaagtattgattccctcattattgatgtgtcaactctacgagctgcaacagaaaactttgctgaagccaataagctcggtgaaggaggttttggttcagtatataagggaatcctccccgatgaccaggaaatagcagtgaaaaggctctcgcagacttctagacaagggatggaggagctgaaaaacgagcttgtgttggttgctaaactgcaacacaagaatttagtgaggcttgtcggggtttgcttggaggaccatgaaaaattgcttgtctatgaatacatgcccaacaaaagccttgacaccattctatttaatcacgagagatgtggagagctggattgggggaagaggtttaagatagttaacgggatcgcccgtggcttgcagtaccttcatgaagattctcaggtgaagataatccacagggatcttaaagcgagcaatgttctgttagacaatgacttcaaccctaagatctcggattttggcttagcaaggctattcggaagtgagcaatcacgagatgtcaccaaccgcgtcgtcggaacctatggatacatggcccctgagtacgccatgcgtgggcactactctgtcaagtccgacgtgttcagcttcggcgttttaatcctagaaatcgtcaccggaaggcgaaatggtggctcctatagctctgaggaatcggccgatctccttagtctggtgtgggagcactggacgacggggacattggtggagatcatggatccatccttgagcagccttgctccacgagacctgatgttgaagtgcatccacatcggcctcctctgcgttcaagatgaccatgaggacaggccgatgatgtcgacagtgaatgtcatgcttagtagcagcacggtgaccctccaagctccatcgaggccggcgttttgcttcccgaagagtggcttcaactcagagatcaactcagaagtgtacccgccaggagcttatcagtccgcgagcaggtcgcccatgtcgctcaacgacgtctcaatcactgagctcgagcccaga

SEQ ID NO: 1006 - protein, 693 aa, Zea mays
  GRMZM2G076987_T01
MTTVAHHHHLAAATVLFFVAFTMAPLAAGDPVGQLCGTSGNYTLNSTYQGNIRRLAATLPKNASTSATLFATDTFGAVPDIVYALALCRGDTNASACSGCVAAAFLDAQQLCAYNKDATMFYDPCLLRYSNQNFLADPSSDGRGTALILMNTQNVTARFKVFDAAVAALLNATAAYAAANSSKRFGTGVEAFQNFDSNRPRIYGLAQCTPDMTPADCQSCLSGIIQTGPKYFSGKQGGRILSVRCNYRYEQYPFFTSTPLLQLAEPTVGAPAPAPAVVNGTPTPPTTGGARRGTTGNKTGRVLAITLPIVAAVLATVVLCSCLWRRKRKTQGKSSLPDTTNPEDIQSIDSLIIDVSTLRAATENFAEANKLGEGGFGSVYKGILPDDQEIAVKRLSQTSRQGMEELKNELVLVAKLQHKNLVRLVGVCLEDHEKLLVYEYMPNKSLDTILFNHERCGELDWGKRFKIVNGIARGLQYLHEDSQVKIIHRDLKASNVLLDNDFNPKISDFGLARLFGSEQSRDVTNRVVGTYGYMAPEYAMRGHYSVKSDVFSFGVLILEIVTGRRNGGSYSSEESADLLSLVWEHWTTGTLVEIMDPSLSSLAPRDLMLKCIHIGLLCVQDDHEDRPMMSTVNVMLSSSTVTLQAPSRPAFCFPKSGFNSEINSEVYPPGAYQSASRSPMSLNDVSITELEPR

SEQ ID NO: 1007 - DNA, 2049 bp, Setaria italica
  Si029121m
atggccatggatgcgcaccaccaccacctgcccacctacctcgccgcggccctcttcctcgccttcgccctcgcgccgctcgccgccggggaccccctgggccagcgctgcggggacagcggcaactacaccttgaacggcacctaccagggcaacatccggcgcctcgccgccacgctccccaagaacacctcctcctccccaacgctcttcgcgaaggactccaccggcgacgtcccggacatcgtctacgcgctcgcgctctgccgcggcgacaccaacgcctccgcctgcggggactgcgtcgcgacggcgttcacggacgcgcagcaggtgtgcccctacaacaaggacgccaccgtcttctacgacccctgcctcctccgctactccaaccagaacttcctcgcctcaaccgccggcgacggccgcgggaacgccctcatcctcatgaacacgcagaacgtcaccgcgccgttcagtgtgttcgacaacgccgtggccgtgctcctcaacgccatcgccaactacgcggccgacaactcgaccaagaggttcggcacgggggtggaggggttccggacattcgacagcaacaacccgaggatctacgggctggcgcagtgcacgccggacacgacgccggccgactgccggacctgcctgtccggtataattcagagtgggccaaagtatttcagcgggaagcagggtggtaggattcttggcctgcgctgcaactacaggtatgagcagtactcgttcttcaccagcaccccgctgcttcagctgccggagcctaccgtgggggccccaccgccggtgaacgggacgccgccgacgactggaggaggaagaagaaacaaaactggtagaattttagccattgcacttcctatattcgccggggtactagctattgtagttatttgttcttgtctttggaggagcaagaagaaaacatcaggaaagtcatcactaccagatacaactaacccagaggacatacatagtatcgattcgctcattattgatctttcaactctgcgagctgcaacggaaaactttgatgaagccaataaactcggtgaaggtggttttggtgcagtttataagggaatcctccctgataatcaggaaattgcagtgaaaaggctctcacagagttctaggcaaggaatagaggagctgaaaaatgagcttgttttggttgctaagctgcaacacaagaatttagttaggcttgtcggtgtttgcttggaggatcatgaaagattgcttgtctatgaatacatgcccaacaaaagcatcgacactattcttttcgattccgagagatgtggtgagcttgattgggggaagagatttaagatagttaatgggattgctcgtggactgcagtatcttcatgaagattctcaagtgaagattatccaccgtgacctcaaagcaagcaatgttctgttagactatgacttcaatcctaagatctcagatttcggcttagcaaggctattcgaaaatgaccaaacacaagatgtcacaaatcgtgttgtcggaacctatggatacatggcccctgaatatgctatgcgtgggcattactctatcaagtctgatgtgttcagcttcggggttttaatcctagagatcgtcatgggaaggagaaatggtggctcgtacagcaccgatgaatctgctgatctccttagtttggtgtgggagcactggacaacgggaacgctggtggagatcatggattcatccttgagcagcctcgctccacgagaccagatgttgaagtgcatccacatcggactcctctgcgttcaagacaaccccgcagaacgaccgatgatgtcaacggtaaatgtcatgctcagcagcagcaccgtgaccctccaagctccatccaggccggcattttgcatcccaaagagtggcttcaattctaaaatgtactcggaagggtacccaggaggtttatattctgcgagcagatcacctatgtcgctgaacgacgtttcaattactgaacttgatccaagg

SEQ ID NO: 1008 - protein, 683 aa, Setaria italica
  Si029121m
MAMDAHHHHLPTYLAAALFLAFALAPLAAGDPLGQRCGDSGNYTLNGTYQGNIRRLAATLPKNTSSSPTLFAKDSTGDVPDIVYALALCRGDTNASACGDCVATAFTDAQQVCPYNKDATVFYDPCLLRYSNQNFLASTAGDGRGNALILMNTQNVTAPFSVFDNAVAVLLNAIANYAADNSTKRFGTGVEGFRTFDSNNPRIYGLAQCTPDTTPADCRTCLSGIIQSGPKYFSGKQGGRILGLRCNYRYEQYSFFTSTPLLQLPEPTVGAPPPVNGTPPTTGGGRRNKTGRILAIALPIFAGVLAIVVICSCLWRSKKKTSGKSSLPDTTNPEDIHSIDSLIIDLSTLRAATENFDEANKLGEGGFGAVYKGILPDNQEIAVKRLSQSSRQGIEELKNELVLVAKLQHKNLVRLVGVCLEDHERLLVYEYMPNKSIDTILFDSERCGELDWGKRFKIVNGIARGLQYLHEDSQVKIIHRDLKASNVLLDYDFNPKISDFGLARLFENDQTQDVTNRVVGTYGYMAPEYAMRGHYSIKSDVFSFGVLILEIVMGRRNGGSYSTDESADLLSLVWEHWTTGTLVEIMDSSLSSLAPRDQMLKCIHIGLLCVQDNPAERPMMSTVNVMLSSSTVTLQAPSRPAFCIPKSGFNSKMYSEGYPGGLYSASRSPMSLNDVSITELDPR

SEQ ID NO: 1009 - DNA, 1977 bp, Brachypodium distachyon
  Bradi1g12377.1
atggcgccatccccacgagccacgcgcagcctcctctttcttctccttctcctggtcgtcgcagccagagccgccgaccctgtgctcaacgactgcccgagcaacacgaactacaccagcggcggcgccttccacgccaacctcgacgccctcctctcctccctacccgccggcgcggctgcggcgtccggattcgcgaagaatgccaccggcgcggcgcagccggacgaggcgtacgggctcgcgcagtgccgcgccgacctcaacgccaccgactgccgcaagtgcctcgacgactcggtgcgggacatggccaccaagtgctccggccagaaaagcgccatgctcatctacgacggctgcctgctccggcatgccaacgcgagcttctttggcgtcgccgacacgtcggtggggctgtgcctcgtgaacttgcagaacgccacgcagccggagcggttcatgccgctgctgggcacgctgatgagcaacctaactcgaacggcggcttacacgtctccgcggatgttcgctgtcggcacgaccagcctcacgccgttccaggatgtctatggcatggcgcagtgcagccgggacctcggcgccaacgactgcaacggctgcctcgtggaagccatgtccagaattcccggctgctgcaacgggaagcagggtggccagatcatcttccggacctgctccatccggttcgagatgtccgctttctacaacgtccgggccgctgaggcggcgatggcgccgctgccgcctgctggcaccggtaacactagcgataactccggcccagcaagcaccggaagaggtggcacagtcaaaacagctctcgccgtctcaattcctgttgctgctgtgctgttggtgctgctggtcattgcgttctgcgtcctctctaagaggaacaggaaaccccacaggcatgtgcagattgcaagcgcagataatggaaatggagacgaaatgatgagttcagaatctctcctgtatgatttgagtactctacaagctgccacggacaatttctcggaagacaataagcttggagaaggcggatttggaccggtgtacaaaggcatactgcacgatgggcaggagattgcggtgaagaggttgtcgacaacctcacagcaaggacatctggagatgaagaacgaggttgtctttctcgcaaagcttcagcacaagaatctagtgcgcttgttaggttgctgcatcgacggggatgagaagctccttgtttatgagttcctcagcaacaaaagcctagacaagattctattcgaccctggaaggcagcaagagctcagctggggtaacagacacaaaatcatccaagggatctgtcgtggtcttctttatcttcatgaagactcgaggttgaccatcattcatcgggacctcaaggcgagcaacatcttgttagaccccgacatgaaccccaagatctccgatttcggcctcgcgaagctttttacagtggatgcaagtgtcggaaacacaagccgcatcgccggaacgtatggatacatggcgccggaatacgcactacacggcatcttctcggccaagtcagacgtgttcagctacggcgtcctggttctagaggtcgtgacaggccgccgaaatgcttacggccaagattacgaagaccttgtatcctctgtgtggaggcactggagccgtgggaacgtgtcgcggttgctggagagctgctccgccgatgggcttcgtccgcaggagatgctgcggtgcatccacgtagcgctgctctgcgtgcaggaggacgcgcaccttcggcctggcatggcggccgtcgtcgtcatgctgaacagccgttcgataacgctaccggcgccgacagcgcctgccttcattgtgccgagccgtgtggcggctagaaccaaagttgttcgtgcgccatcaataaatgatgcttctgtttctgatttggagccccgg

SEQ ID NO: 1010 - protein, 659 aa, Brachypodium distachyon
  Bradi1g12377.1
MAPSPRATRSLLFLLLLLVVAARAADPVLNDCPSNTNYTSGGAFHANLDALLSSLPAGAAAASGFAKNATGAAQPDEAYGLAQCRADLNATDCRKCLDDSVRDMATKCSGQKSAMLIYDGCLLRHANASFFGVADTSVGLCLVNLQNATQPERFMPLLGTLMSNLTRTAAYTSPRMFAVGTTSLTPFQDVYGMAQCSRDLGANDCNGCLVEAMSRIPGCCNGKQGGQIIFRTCSIRFEMSAFYNVRAAEAAMAPLPPAGTGNTSDNSGPASTGRGGTVKTALAVSIPVAAVLLVLLVIAFCVLSKRNRKPHRHVQIASADNGNGDEMMSSESLLYDLSTLQAATDNFSEDNKLGEGGFGPVYKGILHDGQEIAVKRLSTTSQQGHLEMKNEVVFLAKLQHKNLVRLLGCCIDGDEKLLVYEFLSNKSLDKILFDPGRQQELSWGNRHKIIQGICRGLLYLHEDSRLTIIHRDLKASNILLDPDMNPKISDFGLAKLFTVDASVGNTSRIAGTYGYMAPEYALHGIFSAKSDVFSYGVLVLEVVTGRRNAYGQDYEDLVSSVWRHWSRGNVSRLLESCSADGLRPQEMLRCIHVALLCVQEDAHLRPGMAAVVVMLNSRSITLPAPTAPAFIVPSRVAARTKVVRAPSINDASVSDLEPR

SEQ ID NO: 1011 - DNA, 2004 bp, Zea mays
  GRMZM2G140721_T01
atgcacagccttctgcccatcctcctctgctcgtttctcctcgcaacggcagccaacgccgacaacccgttctacacaggctgtccgaacaacacgaactacacgcgcggcagcgcgttccaggccaacctcaacgccctcctcgcatccctcccctccgcggccgccgcgtcagcgggttttgccacgaacaccaccggcaccgcgcccgaccaggcgtatggcctcgcgcagtgccgcgccgacgtgaacgcgtcggactgccgcgcgtgcctcgacggctcgacgcgggacatggccagggtgtgcccaggccagaagagcgccatgctcatctacgacgcgtgccagctgcggcactccaacgcgagcttcttcggcgccgtcgacgcgtcggtcgtggtctggcagcctaacgcgcagaacgcgacgcagcaggagcagttcacgacgcggctcggcgcgctcatgggcagcgtcacggagagggcggcgtacgcgtccccgcggaggttcgcggtcggctcggccgccgtgacgcccttcgtgaacgtctacggcatggcgcagtgcacgcgggacctcgccggcgacgactgcaaccgctgcctcgtcggcgccgtctcgttcatcccgacgtgctgcgacggcaggcaaggcgcccgcatcgtgtacccgagctgctccatccggttcgaggtgtatccgttctacgacgcccaggctgccgacgcggcgatgtcgccggcaccggcaccgggagccggatccgtcaacggcagcgaccagtcgggcctaggagaaagcgggagcggcagtcacaaggtccgggcagctcttcttgtggcaattcctgtcgctgttgcgctgctgcaagttgctgtcttcctcttcctccgcaagaggaacagacaaccgcacaagcatgtgcaggttgcaagcaacgtacacgaagatgaagaagacatgacaagctcagagtatctcctctatgatctgagcaccctacgagctgccacggacaacttttcggaagaaaataagctcggcgagggagggtttgggccagtgtacaaaggcacgctgcaagacgggcaggagattgcagtgaagaggctgtcagcaacttcgcagcaagggcaggtggagatgaagaacgaggtggtcctgttggcgaagctccagcacaggaacttggtacgcctgctcggctgctgcaccgaggaacacgagaggctcctcgtctacgagttcctcaccaacaacagcctcgacaaaatcctcttcgatccagcacggcggcaggagctgggctggggactgaggcagaggatcatcgagggcatcggccgcgggctcctctacctccacgaggaatcgaggctgaccatcatccaccgggacctcaaggccagcaacatcctgctggacgcggacatgaaccccaagatctccgacttcggcttggccaagctgttcagcctcgactccagcgtgggaaacaccagccacattgccggaacatacggatacatggcgccggagtacgccatgcacggcctcttctcggccaagtcggacgtcttcagctacggcgtccttgtcctcgagatcgtcaccggccgccgcaactcgtacacgcatgcttcaggaccgtctgaagatctgcttacatttgtttggacgcactggagccgtgggagcgtgcagcctctgctggaggggtgccccgacgaggggctccgtgcgcaggagatgctgaggtgcatccacgtcgctctgctctgcgtccaggaggatccgctcgaccgccccagcatggcatcggtcgtcgtcatgctcaacagccgctccatcacgctgccggcgcccggcgcgccagcgtacgcggtgccccgccgtggaaccacggtcaggagcgcggctcgccagggcctggtggatgccgcggcatctagggagcagtccgttaacggcgcctccttttctgacatggagccgcgc

SEQ ID NO: 1012 - protein, 668 aa, Zea mays
  GRMZM2G140721_T01
MHSLLPILLCSFLLATAANADNPFYTGCPNNTNYTRGSAFQANLNALLASLPSAAAASAGFATNTTGTAPDQAYGLAQCRADVNASDCRACLDGSTRDMARVCPGQKSAMLIYDACQLRHSNASFFGAVDASVVVWQPNAQNATQQEQFTTRLGALMGSVTERAAYASPRRFAVGSAAVTPFVNVYGMAQCTRDLAGDDCNRCLVGAVSFIPTCCDGRQGARIVYPSCSIRFEVYPFYDAQAADAAMSPAPAPGAGSVNGSDQSGLGESGSGSHKVRAALLVAIPVAVALLQVAVFLFLRKRNRQPHKHVQVASNVHEDEEDMTSSEYLLYDLSTLRAATDNFSEENKLGEGGFGPVYKGTLQDGQEIAVKRLSATSQQGQVEMKNEVVLLAKLQHRNLVRLLGCCTEEHERLLVYEFLTNNSLDKILFDPARRQELGWGLRQRIIEGIGRGLLYLHEESRLTIIHRDLKASNILLDADMNPKISDFGLAKLFSLDSSVGNTSHIAGTYGYMAPEYAMHGLFSAKSDVFSYGVLVLEIVTGRRNSYTHASGPSEDLLTFVWTHWSRGSVQPLLEGCPDEGLRAQEMLRCIHVALLCVQEDPLDRPSMASVVVMLNSRSITLPAPGAPAYAVPRRGTTVRSAARQGLVDAAASREQSVNGASFSDMEPR

SEQ ID NO: 1013 - DNA, 2004 bp, Setaria italica
  Si024498m
atgtccaggcttctccccctcctcctcctcagctcctccctcttcgccttaaccaccaacgccgacgagcgagggctactacagttctacgactgcccgagcaacacgaactacacgcgcggcagcgcgttccaggccaacctcatcgcactcctctccttcctccccgccgccgtggccgcgtcctccgggttcgccgagaacatcacaggctccgcgcccgaccaggcgtacggcctcgcgcagtgccgcgccgacctcaacgcgtcggactgccgcgcgtgcctcgacggctcggcgcgggacatgaccgccatgtgccccggccagaagagcgccatgctcatctacgacggctgccttctgcggcactccaacgcgagcttctccggcgtcgtcgacacgtcggcgtgggtctgcatgtgtaacacgcagaacatgacgcagccggaggaattcagttcgcggctcggcgcgctgatgggtaacctcacggcgaaggcggcgtacgcgtccccgcagatgttcgcggccggtgagaccagcctcacgcccttcgtgaacatcttcggcatggcgcagtgcacgcgggacctcgacgacgacgactgcaaccgctgcctcaccagagccgtcgcgtccatcccgagctgctgcgaccggaagcagggcggccgggtcatctaccggacctgctccgtccggtacgaggtgtacccgttctacaacgcccatgccgccgaggccgcgatgtcgccggcgccgaccccgggaggagggcccgtcaacggcagcgatcactcgggcccaggaagcaacgggagtagtcgcacggtcacgacggctcttctcgtgtcaattcctgtcgctgttgggctgctagtgctgctgctagtttctgcctgtctctgcaagaggaacagaaaaccacgcaagcatgtgccggttgcaagcaacatgcattcagatgctgaagaaatgagaagctcagagtctctattgtatgatttgagcacgctgcgagctgccaccgacaacttttcagaagaaaacaagctgggcgaaggcgggtttgggcctgtctacaaaggtacactgcaaaacgggcaggacattgcagtgaagagattgtcagcaacttcgcagcaaggacaagtggagatgaagaacgaggttttcctgttggcaaagctccagcacaggaacttggtgcgactgctcggctgctgcatcgaggaacacgagaggctcctcgtctacgagttcctaaccaacaacagcctagacaagatcctcttcgatcctgctcggcagcagcagctgggctggggactgaggctgaagattatcgaggggatcggccgagggctcctttacctccacgaggactcgaggttgaccatcatccaccgcgatctcaaggcgagcaacatattgctggacgcggacatgaaccccaagatctccgacttcggcttggccaagctgttcaacatcgactcgagcgtcggaaacaccagccgcattgccgggacctacgggtacatgtcgccggagtacgccctgcacggcatcttctctgcgaaatcagacgttttcagctacggcgtcctcgtcctggagatcgtcactggccggcgcaacaccttcacgcatgcgtctggaccctctgaagatctgctcacctatgtctggaggcactggagccgcgggagcgtgcagccgctgctcgaggggtgccccggcgagggccggcggccgcaggagatgctgaggtgcatccatgtcgggctgctctgcgtccaggaggatccgcagctccggcccagcatggcgtccgtcgtcgtcatgctcaacagccgctccatcacgctgccggcgcccgccgcgccagcgtacgcggttcccggacgtgcggacgcgcaggggaccgtgaggaacaacaccgttgggtctcgagagcactccatcaatgacgtttccgtttctgacttggagccgcgt

SEQ ID NO: 1014 - protein, 668 aa, Setaria italica
  Si024498m
MSRLLPLLLLSSSLFALTTNADERGLLQFYDCPSNTNYTRGSAFQANLIALLSFLPAAVAASSGFAENITGSAPDQAYGLAQCRADLNASDCRACLDGSARDMTAMCPGQKSAMLIYDGCLLRHSNASFSGVVDTSAWVCMCNTQNMTQPEEFSSRLGALMGNLTAKAAYASPQMFAAGETSLTPFVNIFGMAQCTRDLDDDDCNRCLTRAVASIPSCCDRKQGGRVIYRTCSVRYEVYPFYNAHAAEAAMSPAPTPGGGPVNGSDHSGPGSNGSSRTVTTALLVSIPVAVGLLVLLLVSACLCKRNRKPRKHVPVASNMHSDAEEMRSSESLLYDLSTLRAATDNFSEENKLGEGGFGPVYKGTLQNGQDIAVKRLSATSQQGQVEMKNEVFLLAKLQHRNLVRLLGCCIEEHERLLVYEFLTNNSLDKILFDPARQQQLGWGLRLKIIEGIGRGLLYLHEDSRLTIIHRDLKASNILLDADMNPKISDFGLAKLFNIDSSVGNTSRIAGTYGYMSPEYALHGIFSAKSDVFSYGVLVLEIVTGRRNTFTHASGPSEDLLTYVWRHWSRGSVQPLLEGCPGEGRRPQEMLRCIHVGLLCVQEDPQLRPSMASVVVMLNSRSITLPAPAAPAYAVPGRADAQGTVRNNTVGSREHSINDVSVSDLEPR

SEQ ID NO: 1015 - DNA, 1974 bp, Eucalyptus grandis
  Eucgr.E03020.1
atgttcgacctctcaaacgctcaacgctgctatgacacgggcaacttcacagctaccagcaacttcgccaagaaccgggagcttgtcctctcttctctccctagcgatgtggcttcaaacggcgggttctactctgggaaggtagggaacagctcggacgttgtttatgtgctcagtttctgcagaggcgactcttcgaacgactcttgcttcaagtgcttaagctctgctgctgaagatttgatgatcaagtgtccaaaccaaaaagctgcggtcacctgggggacctgggagacaggagaacctccttgcatcatccgttacgctgatggtccgatgtatggcaagaagctgacatttccgacactaaagttacctaacgtagacgacatcacgatggatcagaatcagttcgatctgatatggaagaactttacggaggagctggcaacaagtgcttcgatggggacgtcagagctcaagtttgcagcagggagaacggtgttgccgaacgtcgagaccatgttcgcacagttgcagtgcagccctgatttgtctcagattgattgccagagttgcctgtgggaatgcataaatgattatcaagattgttgccatggaagacgaggcgggtttgttggcaagccgagctgcattttccgatgggacttgtacccgtttttcaagtctgattccatcaatctgctgccatctccgccaccaccaactgcagtcaccaaggccgaccctgctgctcctccacctgcaaatgcacaagtcaccaatggtaatatcttgaagtcattacgcattgtggttgctgtggtaggttcggcaaatctcttcgtgctggttattgtctccgtgtgttgcttgattagaagcagaagaagtaatccatggatggtttcatctgcaaaagacgaggtcaaaactgctgaaagcttacagttcgaaataagcgagatcagggccgccacaaattcctttgcagaaggcaataagcttggagaagggggattcgggaaagtgtatcggggtaggcttcccaacgggcaagaaatagctgtgaagaggctatcacaaagctcaggacaaggcctccaagaatttaagaatgagattgtgttggtcgcgaagcttcaacaccggaatttagtgagactgcttggattttgcttcgaagaagaggaaaagctactggtatatgagcttatgcccaacaaaagtcttgactacttcatgttcgaccctgagaaaagcaaacaactggactggcgaagacgttataacataatatcaggcatcgctcgagggatgctctatcttcatgaagattctcggctccgaatcattcactgtgatttaaaggctagcaacatcttgctggacaacaatatgaacccaaagatttcggattttggcatggcaaggattttcggagttgatcaaactaacgcaagcactagaagaatcataggaacctatggttacatgtccccggaatatgcgatgcatgggcaattttctcaaaagtctgatgtttacagcttcggcgtcctcctccttgagatcatttgtggcaagaggaatgactactactaccaatctgatggaggtgaagctctcgcaagctatgcttggaaacattggagagacaatgtgccttcggaaatcttggacccggtattgggagaatcttattccagaagccaagagctaagatgcatacacattggctttctatgtgttcaggaagatccggctgatagaccgaccatggcaagcatagttcttgcgctgagcagccaaactcttagtctgctagtgccacgggaacctgcctttttcctccgaagctggacggaaccaccaaagaacatcatagcaaatgaccaaggacatgatcaaaataccagcggctccacacctttgtcggtcaatggagtgtcgatcactgaactctccgctcga

SEQ ID NO: 1016 - protein, 658 aa, Eucalyptus grandis
  Eucgr.E03020.1
MFDLSNAQRCYDTGNFTATSNFAKNRELVLSSLPSDVASNGGFYSGKVGNSSDVVYVLSFCRGDSSNDSCFKCLSSAAEDLMIKCPNQKAAVTWGTWETGEPPCIIRYADGPMYGKKLTFPTLKLPNVDDITMDQNQFDLIWKNFTEELATSASMGTSELKFAAGRTVLPNVETMFAQLQCSPDLSQIDCQSCLWECINDYQDCCHGRRGGFVGKPSCIFRWDLYPFFKSDSINLLPSPPPPTAVTKADPAAPPPANAQVTNGNILKSLRIVVAVVGSANLFVLVIVSVCCLIRSRRSNPWMVSSAKDEVKTAESLQFEISEIRAATNSFAEGNKLGEGGFGKVYRGRLPNGQEIAVKRLSQSSGQGLQEFKNEIVLVAKLQHRNLVRLLGFCFEEEEKLLVYELMPNKSLDYFMFDPEKSKQLDWRRRYNIISGIARGMLYLHEDSRLRIIHCDLKASNILLDNNMNPKISDFGMARIFGVDQTNASTRRIIGTYGYMSPEYAMHGQFSQKSDVYSFGVLLLEIICGKRNDYYYQSDGGEALASYAWKHWRDNVPSEILDPVLGESYSRSQELRCIHIGFLCVQEDPADRPTMASIVLALSSQTLSLLVPREPAFFLRSWTEPPKNIIANDQGHDQNTSGSTPLSVNGVSITELSAR

SEQ ID NO: 1017 - DNA, 1956 bp, Eucalyptus grandis
  Eucgr.E04192.1
atgactcactcatcatccactctttattttctcatttttctggctgttctgatccgagcctccgcacatcatgcagaattctgtaactacaccaggaacttcacgtcaaacagcgcctatgtgaagaaccgcaacaccatcctcagctctctctctgaaaacgtggctgcccatgacggtttctggaacacgagcacgggccagaacccagacgccatctacgctcttgctttctgccgaggcgatacgtcggcaaatctctgcgagaactgtgtgggcactgcgctccacgatttagtggagaggtgccccgaccagaagggggctttctcctggggaaccggaggccagccatgctttgtccgatactcggacactccaatctacggcatactgcaaatggaacctacccttttgattgatagcgtcgacatcatcaccatgagcccagcagtatggtggaacttgacgttaggagtattgaaccaagctgtggacagcccttcgaagctaaagttcgcaacggggcaggccaccttgccggacaaccgtacgatctactcattgttgcagtgcagtcctgacttgtcggcaaacaattgcaggagttgcttgaacgaagccattgactatgatgataagcacggccgcggaaagcaagacagcggtgtttataagccaagctgtattttccggtgggatttgtacccgtttgtggagtcaagccatagtccatcaccacctccggctgctccggctgctcctggtggaaatttcagcaaaggtaccttggttgcaactatcgtttcagtcgctgtttttgtaacgcttctcttcatcggttgttgttggcttcggaggaggcgagcacagaagaaatatgaagcggcaaaagaagaatgtggtgtaaccgagatcccatccttaaagtccttgcaatttgattgggatactttactttcagcaacgaacaacttttctcaagaaaacaagcttggcgaaggtggattcggggaagttttccagggtagacttcccaatggacgagatatagcagtgaagaggctatcccatacttcaggacaaggcggggaagaatttaagaatgagattatgctcgtagcgaagcttcaacaccggaatttagtgagattgcttggattttgcttggaaggaggggaaaagctactcgtatatgagtttgtgcctaacaaaagcttggactacttcttcttcgaccccatgaaaagcaaacaattggattggccaatacgttacaagataatatcaggtatcgctcgagggatgctctatcttcatgaagattctcggcttcgagtcattcaccgggatttaaaagctagcaacatcttactagacaacgatatgagccccaagatttcggatttcggcatggcaaggatttttagagttgatcaaagtaacgcaagcactaaaagaattgtaggaacctacggttacatgtccccggaatatgctatgcacggacaattctcccaaaagtcggatgtttatagcttcggtgtcctccttcttgagatcatttgcggcaagaggaataactactactatcaatctaatagaggcgaggatctcacaagctatgcttggaaacattggagaagcgatgcgcctttggatatattggacccggcattgggagaatcttattctagaagccaagtgctcaaatgcatacatatcagcttcctatgcgttcaggaagatccagctaatagaccgaccatggcaaacatagttcttgcgttgagtggccaaactcttagtttgccagtgccacgagaacccgcctttttcctccaaagggaaatgccgaataacttcatggggaaagaccagggatatgatcaaattaccagcagctctgtgccattgtcgattaatgaagcgtcggtcaccgaagtctaccctcga

SEQ ID NO: 1018 - protein, 652 aa, Eucalyptus grandis
  Eucgr.E04192.1
MTHSSSTLYFLIFLAVLIRASAHHAEFCNYTRNFTSNSAYVKNRNTILSSLSENVAAHDGFWNTSTGQNPDAIYALAFCRGDTSANLCENCVGTALHDLVERCPDQKGAFSWGTGGQPCFVRYSDTPIYGILQMEPTLLIDSVDIITMSPAVWWNLTLGVLNQAVDSPSKLKFATGQATLPDNRTIYSLLQCSPDLSANNCRSCLNEAIDYDDKHGRGKQDSGVYKPSCIFRWDLYPFVESSHSPSPPPAAPAAPGGNFSKGTLVATIVSVAVFVTLLFIGCCWLRRRRAQKKYEAAKEECGVTEIPSLKSLQFDWDTLLSATNNFSQENKLGEGGFGEVFQGRLPNGRDIAVKRLSHTSGQGGEEFKNEIMLVAKLQHRNLVRLLGFCLEGGEKLLVYEFVPNKSLDYFFFDPMKSKQLDWPIRYKIISGIARGMLYLHEDSRLRVIHRDLKASNILLDNDMSPKISDFGMARIFRVDQSNASTKRIVGTYGYMSPEYAMHGQFSQKSDVYSFGVLLLEIICGKRNNYYYQSNRGEDLTSYAWKHWRSDAPLDILDPALGESYSRSQVLKCIHISFLCVQEDPANRPTMANIVLALSGQTLSLPVPREPAFFLQREMPNNFMGKDQGYDQITSSSVPLSINEASVTEVYPR

SEQ ID NO: 1019 - DNA, 6480 bp, Glycine max
  Glyma10g10160.1
atgggtcgacctgagccatgcgtcctcttcgcccaaaacttcgttcatactcatctcgacgagtacgtcgacgaggtgatgttttcggagcccattgttattactgcgtgtgagtttctggaacagactgcgtcatcagctgctcaagcagtgacacttgttggggcaacttcacctccatcatttgcgatagaggtgtttgttcattgtgagggagagacaaggtttagaagactttgtcagccttttctctattcacactcttcgtcaaatgtactagaagtagaggctgttgttactagtcatctagttgtaaggggcagctatcgcagtctgagtttggttatatatggcaacacagctgaggatctgggtcagtttaacattgatattgatgacaatgcattgactgatcttgttgattctactgaggggaagcttgaagaccttccacctgcattacgctcaactaattttacaattgatgattcacgttcatctctgagggtgttgtctattccagttcctgcaacagatatttctgttgaagtcaatctttttctacagttgatgttaaaaattttggagttttcagagcttggggatgctgggcataaaattgtagatcctgtagtgtctgcaatcacttcttacatttccagtgacatatgtgaatcaatcggtgggagatatcagatgcagaagagatctgagaatttggaagagttgcacagtgttgttaatgagggaagaaaagagcttctagaggtttataaggttcttcacaaaaaatttaggagtggatcttctgagtgttcaccagatgccaattatcttgaaatggatgctgaaatgttggattccaaaactttggtggatatgtttaaccagtactttcattttcaacggcactcttcttgtataggagatcactgcctttctcagagtgagcatgccctattaatattgagcatggcttatttgctttgttctggtagagagagtggctttcagtttgttagtagtgggggaatggagcagcttgcagtgtttttttccaaggattggcaaaattctactactattatgctactgcttcttggtgttgtagagcgggctactaggtattcagttggatgtgaagcctttttaggttggtggccccgggaagatgaaaatataccctctagtatcagtgaaggttatagtcatttgttgaagttgatattgtcaaaacctcgtcatgatgttgcttctcttgcaacctatttgcttcaccgcttacgattttatgaaattgcttcaagatatgagtctgcagttctttctgtgctgggaaacatcggtactgttggcagggttacagatgttacactgaatatgctcagttctgctgaaattctgctcagaaagctcctgaaattgataaattcacgtggtccaattgaagatccttctcccatagcttgtgcaagcagatcacttattactggtcaaacagatggattgttgtcatataaaacaacttccagcttgattagctcttcaagttgttgcttttcagattgtgatattgattcccatttattgggacttttgaaggagaggggttttctttcattatcaactgcattgttgtcatcatctatactgcgtgtggagagtggccatgtaatggaaatcttcatggatgtcacatcatccattgaggccgtgattctatcatttcttttttgtcgttcaggcttgatattgctattgcaggatcctgaactttctagtacattaatccgtgctcttaggggcggtcaccgaggcaacaaggaagattgtattcctcttcgatatgcttccatttttatttcaaagggtttcttttgtagtccacccgagattggaatgataattgagatacatttaaaaatggttaatgccgttgatagtttgctttctttgaatccgcagtcggaagagttcttatgggttgtctgggaactctctatgctctcacgatcggattgtgggcgccaggcattattggctttagggaattttcctgagagcaggtgtcatccgccgtcgcccgccgccgtcgccgccgccgtccgccgcaaccgccgccgtctgccgccgccgccgtcactttccggcggctatttctccggcgaagccagggttaggctcgccttgggaagcgcgagccagtcggccaactcgcgtcagcaacggagcagccacgcgccgccaccgtcccgcgcgtcctccggcgcgtgcagtccacgcgccgccgtcccggcgccggaatcgcgccgcgcctccgccgttctcttgggtttcaccttgtgggtcaaaatggcttcccctggacctgttttctccttctccgggactccaaccatcacaactgctaaactcaattggaaaaattacccctcatggtctgcttccgtagaactttggtttcttggtcaaggacaccatgaccacttggagaaagcttccgattctgtttcaagtgacaaaagagccgaatgggagaagcttgattatcaactgtgtgctgtgttatggcaatcagttgagccggatattttggatatccttagatcatttaaaacgtgtcgttccttttggaagaaggctcaagaaatttttgccaatgatattcagagcttatttgatgcaaccatgaaggttacagcccttaagcaaaccagccatgacatgattgctcatgtgggtaaggctcgggctgccgtggaagagctgagaaagtttcttgtggctgattcattagaagaagtgaacaggaaactggacaagttttacatggtccttatcctgagaagcttacactcagactttgatcatgttcgtgatcaagtactcgctggggatcaggttccatccatggattctctcatcactaggcttctccgtgtgcctcacttatcgaaggatgaaaatcctactgatagtgtggagacgtcagcaatggttgcatcacgtggtagaggaggcggtcgcaacagcagaggaggccgcaatggaaggggtggacgtcctcattgcacctactgcaagaggatgggtcacacccaagagaattgttattcgttgcatgggtttcctgacaaggttgcacaggtttctagatcagagaaagcagagtctaagttctctgatgaggagtatcaggagtatttgaagctcaaatctgagagacccagcaaccaagctcaatcctcatctgtaccatgtttttcaacagcttgtatctctcaatcaattgaaggtcctagtccttggatactcgactcaggtgcctctgaccatatttctggtaataagtcttccttttcatccttttccttaccaaaaattcctcacctcgtcactgtagctaatggctccaaggttgcgtctcaaggaagtggtcaagtttcattgtctccttccttgaaattaaactctgttttattccttccgcagtgtccctataatttaatctcactaagtcaattaactcgttcgttaaattgttcagtaacctttactgctaattcttttgttattcaggaacatgggacggggcgactgattggagaaggacatgaatcacgaggactttactatttggaatccagtccacttgggtcttgttttgcaatctcaaaacccaaacttttgcatgatcgtctaggacacccaagtttatcaaaattgaagatgatggtccctagtcttaagaatcttcgagtcttagattgtgagtcttgtcaactaggaaaacatgtcaggtcgtcatttcctcaaactgtacaaagatgtaactcggctttctctaccattcattctgatatttggggaccaagtcgtgttacatcttttggttttcgatattttgtaaccttcattgatgaattctccagatgtacttgggtttatttaatgaaagacagatctgaacttttgcctatatttgtgtcattctacaatgaaattgagaatcaatttggaaaaacaattaaaattttcagaagtgataatgctaaagagtatttctctcatgatctttcttcttttctgtcttccaaaggtattctacatcaatccacatgtcctcacacaccacaacaaaatggtattgcagaaaggaagaatcgtcatcttcttgaaactgcacgctccctaatgctaaattcgaatgttccgatacatcattggggagatgcggtgcttactgcttgtttcctaataaatcggatgccttcttcttctcttgaaaaccaaattcctcactcacttgtctttcctcatgatcctttatttcatgtctctcctaaagtgtttggttgtacctgttttgttcatgatttgtctcctggtttagataaactctctgctaggtcagtcaaatgtgtcttcctgggttattctcgtcttcaaaagggttacaaatgctactctccaaccatgagacgatactacatgtctgcagatgtaaccttctttgaagacacacctttcttttcaccctccgtggaccattcttcatctcttcaggaagttcttcctattccttctccttatcccctagataactcaggccaaaatgtcagtattgttccatcttcctcaccaaattcacctgaagtcatcttaccacctctgactacagatcaacacaggacaaggcagattggatctccaatacctgaagcctctcctagtgattctcgtccttcttcaaccagtcctccactcatggatccgccctctccttccacttcttctcctcattctgattcacattggcccattgccatcagaaaaggtactcgttctactcgtaatcctcatcctatttataatttcttaagctatcaccgtttgtctccttcatacagttcctttgtttgttcattgtcttcccttgccattccttccactgtccgtgaggcacttgatcatcctggctggagacaggctatgattgatgaaatgcaggcccttgaaaataatggtacttgggagcttgttcctcttccccctggtaagacccctgtgggttgtaggtgggtctacactgttaaagttgggcccactggtgaggttgatcggcttaaggctcgtttggtagctaaaggctacacacaggtatatggcattgattactgtgatactttctctcctgtcgccaaactcaccactgttcgtctgtttcttgctatggctgctattcgtcactggcccctccatcagcttgatattaagaatgcctttctccacggtgatcttgaggaggatatttatatggagcaaccacctgggtttgttgctcagggggagtatggccttgtgtgtaagcttcatcgatctctctatgggttgaagcaatctcctcgtgcttggtttggtaaatttagtcatgttgttcacatgtttggactgaaacgaagtgaagctgatcactctgtattttattgtcatacatctcctggaaaatgtgtttatctaatggtctatgttgatgatatagtgattacagggaatgatgctactaagatcagccagctaaaagagcatctattcagtcattttcagaccaaagatttgggatctttgaagtatttccttggtattgaagtggctcaatcaggagatggtgttgtgatctctcagaggaagtatgcccttgatattttagaagaaacaggtatgcaaaattgtagacctgttgaaagtcctatggatcctaatttgaagctcatggcagatcaaagtgaagtttatcctgaccccgagagatataggaggcttgtgggaaaactcatttaccttaccatcactagacctgatatctcctttgctgtgggagtggttagccaatttatgcaaaatcctcatttggaccattggaatgctgtcatgcgtattttgaggtatattaagagagctcctggacaagggttgttgtatgaagacaaaggtaatacgcaattatcaggatattgtgatgctgattgggctggctgtcccatggataggaggtctacatcaggctattgtgtcttcattggaggaaatcttgtttcttggaaaagcaagaaacagacggttgtagctcggtctagtgcagaagctgaatatcgatcgatggctatggttacttgtgaactcatgtggattaaacaatttctgcaagaattgaggttttgtgaagagttgcaaatgaagttgtattgtgataatcaggctgctcttcatattgcctcaaacccagtctttcatgaaaggactaagcatatagagattgattgtcatttcattcgagagaagcttctgtccaaggagattgtcactgagttcattggttctaatgaccagccagcggatattttgactaagtccctaagaggacccagaattcagactatatgttccaagcttggtgcatatgatttatatgctccagct

SEQ ID NO: 1020 - protein, 2160 aa, Glycine max
  Glyma10g10160.1
MGRPEPCVLFAQNFVHTHLDEYVDEVMFSEPIVITACEFLEQTASSAAQAVTLVGATSPPSFAIEVFVHCEGETRFRRLCQPFLYSHSSSNVLEVEAVVTSHLVVRGSYRSLSLVIYGNTAEDLGQFNIDIDDNALTDLVDSTEGKLEDLPPALRSTNFTIDDSRSSLRVLSIPVPATDISVEVNLFLQLMLKILEFSELGDAGHKIVDPVVSAITSYISSDICESIGGRYQMQKRSENLEELHSVVNEGRKELLEVYKVLHKKFRSGSSECSPDANYLEMDAEMLDSKTLVDMFNQYFHFQRHSSCIGDHCLSQSEHALLILSMAYLLCSGRESGFQFVSSGGMEQLAVFFSKDWQNSTTIMLLLLGVVERATRYSVGCEAFLGWWPREDENIPSSISEGYSHLLKLILSKPRHDVASLATYLLHRLRFYEIASRYESAVLSVLGNIGTVGRVTDVTLNMLSSAEILLRKLLKLINSRGPIEDPSPIACASRSLITGQTDGLLSYKTTSSLISSSSCCFSDCDIDSHLLGLLKERGFLSLSTALLSSSILRVESGHVMEIFMDVTSSIEAVILSFLFCRSGLILLLQDPELSSTLIRALRGGHRGNKEDCIPLRYASIFISKGFFCSPPEIGMIIEIHLKMVNAVDSLLSLNPQSEEFLWVVWELSMLSRSDCGRQALLALGNFPESRCHPPSPAAVAAAVRRNRRRLPPPPSLSGGYFSGEARVRLALGSASQSANSRQQRSSHAPPPSRASSGACSPRAAVPAPESRRASAVLLGFTLWVKMASPGPVFSFSGTPTITTAKLNWKNYPSWSASVELWFLGQGHHDHLEKASDSVSSDKRAEWEKLDYQLCAVLWQSVEPDILDILRSFKTCRSFWKKAQEIFANDIQSLFDATMKVTALKQTSHDMIAHVGKARAAVEELRKFLVADSLEEVNRKLDKFYMVLILRSLHSDFDHVRDQVLAGDQVPSMDSLITRLLRVPHLSKDENPTDSVETSAMVASRGRGGGRNSRGGRNGRGGRPHCTYCKRMGHTQENCYSLHGFPDKVAQVSRSEKAESKFSDEEYQEYLKLKSERPSNQAQSSSVPCFSTACISQSIEGPSPWILDSGASDHISGNKSSFSSFSLPKIPHLVTVANGSKVASQGSGQVSLSPSLKLNSVLFLPQCPYNLISLSQLTRSLNCSVTFTANSFVIQEHGTGRLIGEGHESRGLYYLESSPLGSCFAISKPKLLHDRLGHPSLSKLKMMVPSLKNLRVLDCESCQLGKHVRSSFPQTVQRCNSAFSTIHSDIWGPSRVTSFGFRYFVTFIDEFSRCTWVYLMKDRSELLPIFVSFYNEIENQFGKTIKIFRSDNAKEYFSHDLSSFLSSKGILHQSTCPHTPQQNGIAERKNRHLLETARSLMLNSNVPIHHWGDAVLTACFLINRMPSSSLENQIPHSLVFPHDPLFHVSPKVFGCTCFVHDLSPGLDKLSARSVKCVFLGYSRLQKGYKCYSPTMRRYYMSADVTFFEDTPFFSPSVDHSSSLQEVLPIPSPYPLDNSGQNVSIVPSSSPNSPEVILPPLTTDQHRTRQIGSPIPEASPSDSRPSSTSPPLMDPPSPSTSSPHSDSHWPIAIRKGTRSTRNPHPIYNFLSYHRLSPSYSSFVCSLSSLAIPSTVREALDHPGWRQAMIDEMQALENNGTWELVPLPPGKTPVGCRWVYTVKVGPTGEVDRLKARLVAKGYTQVYGIDYCDTFSPVAKLTTVRLFLAMAAIRHWPLHQLDIKNAFLHGDLEEDIYMEQPPGFVAQGEYGLVCKLHRSLYGLKQSPRAWFGKFSHVVHMFGLKRSEADHSVFYCHTSPGKCVYLMVYVDDIVITGNDATKISQLKEHLFSHFQTKDLGSLKYFLGIEVAQSGDGVVISQRKYALDILEETGMQNCRPVESPMDPNLKLMADQSEVYPDPERYRRLVGKLIYLTITRPDISFAVGVVSQFMQNPHLDHWNAVMRILRYIKRAPGQGLLYEDKGNTQLSGYCDADWAGCPMDRRSTSGYCVFIGGNLVSWKSKKQTVVARSSAEAEYRSMAMVTCELMWIKQFLQELRFCEELQMKLYCDNQAALHIASNPVFHERTKHIEIDCHFIREKLLSKEIVTEFIGSNDQPADILTKSLRGPRIQTICSKLGAYDLYAPA

SEQ ID NO: 1021 - DNA, 1980 bp, Citrus clementina
  clementine0.9_004435m
atgggttttaaaattttgcttggtttcgtttcttacatgcttctgagtatcattcgtcttacctccggccagacatgttacgacacaggaaacttcaccactaatagtacctacggtaagaatcgggaactgtttctctcatttcttgcttctaacgtaaccgcgaacaagggtttctacacttccaccattggccaaattcccgacgaagtttatggtcttgcactctgcagaggagattctactccagaagcatgtgccagctgccttaatttcacagttcgtgatatgatgaagaactgtccgaaccaaaaagaagcaatttcatggggaggaatggattttccatgcgttgtacgctattcaaaccgctctttctttggaaaactagagctgaaacctacagaattcaaccataatataaataacatcacttcaagtttgaaacagtttgatcggatctggaggagtttaatggatcgcgtactggcaaaagcttcttcgggcaattcgaagcccaaatttgcaactgaagaggcaaatttgacaagctctgaaacgatttatgcactaatgcagtgcactccagatatatcccagagtgactgtgaattttgtctacgtcaaagtatggctgatttgcagagttgctgttatgggaaaaaaggaagttatgttttgggacccagctgtatatttcgctgggaaatgtatccattctatggagctactgccgattctttatcgccatctcctctgagtccacccagtactactactgatacgacaaccaccaaagacaaaggaggcaatagcatttcatctggaactgtcataatcattgttgtttctacgagtattttcatcattgcacttgttgctttgatcacttgtgtctttctacgaaggaggaagcagaagcaggatctcacaaaagctgatgaaatcaatactgcggaatccttgcaatttgacttcagcaccatcagagatgcaacaaataacttctccacagataataagcttggacaaggtggatttggtgctgtttacaagggaaggctttcacacggacaggaaatagcagtaaagaggctgtctaaaaattcggttcaaggagaactagaatttaaaaacgaggtcctattggtggccaggcttcaacatagaaatttggttaggcttctaggtttctcctttgaaggaaccgaaaggcttctcatctatgagtttgtgcctaattcaagcgtagataaatttatatttgatgcaatcaagcgcgtgcaactagattgggaaacccgatacaaaatcattgggggcatagctcgaggaattctttaccttcacgaagattcaaggttacggatcattcatcgtgacctcaaagcaagtaatattcttttagatgcagacatgattccaaaaatttcagactttggaatggcaaggttgtttgaaatggatcaaagtcaaggcgatacaagtagaattgtcgggacatttggctacatggctccagaatatgtaacgcgagggcacttctccattaaatctgatgtttttagctttggtgtgttagtcctggaaatcatcagtggtcaaaagaataatagtttccgtattggagaggaggcagaggacttactgacctacgcatggaaaaattggaacgaaggaacagctttaaatatgatagatcccacattgaggaatggttccagtagtgaaataatgagatgcatccacatcggattgctatgtgttcaagaaaatgttgcaaatagaccaacaatggcttcggttgttgtcatgcttaatagcagctctctctccctgccactaccttcgcagcctgcattttttatgcgcactacaatggagcaggataatttggaattcaccgcatctgatcaatctaaaagcggttccatccattttacagtcaatgaagttacagttagtgagctagaccctcgc

SEQ ID NO: 1022 - protein, 660 aa, Citrus clementina
  clementine0.9_004435m
MGFKILLGFVSYMLLSIIRLTSGQTCYDTGNFTTNSTYGKNRELFLSFLASNVTANKGFYTSTIGQIPDEVYGLALCRGDSTPEACASCLNFTVRDMMKNCPNQKEAISWGGMDFPCVVRYSNRSFFGKLELKPTEFNHNINNITSSLKQFDRIWRSLMDRVLAKASSGNSKPKFATEEANLTSSETIYALMQCTPDISQSDCEFCLRQSMADLQSCCYGKKGSYVLGPSCIFRWEMYPFYGATADSLSPSPLSPPSTTTDTTTTKDKGGNSISSGTVIIIVVSTSIFIIALVALITCVFLRRRKQKQDLTKADEINTAESLQFDFSTIRDATNNFSTDNKLGQGGFGAVYKGRLSHGQEIAVKRLSKNSVQGELEFKNEVLLVARLQHRNLVRLLGFSFEGTERLLIYEFVPNSSVDKFIFDAIKRVQLDWETRYKIIGGIARGILYLHEDSRLRIIHRDLKASNILLDADMIPKISDFGMARLFEMDQSQGDTSRIVGTFGYMAPEYVTRGHFSIKSDVFSFGVLVLEIISGQKNNSFRIGEEAEDLLTYAWKNWNEGTALNMIDPTLRNGSSSEIMRCIHIGLLCVQENVANRPTMASVVVMLNSSSLSLPLPSQPAFFMRTTMEQDNLEFTASDQSKSGSIHFTVNEVTVSELDPR

SEQ ID NO: 1023 - DNA, 1935 bp, Populus trichocarpa
  POPTR_0011s03220.1
atgggttctaaaactatcgtctctcttctttttcatgttattatcataagcatcactcttaccggtgctgaagtctgttataacacaggaaactttacagctaatagcacctatgcaaaaaaccgagaccttgttctccgttcactagcttccaatgtcacagccaatgggggtttctataatactacaataggtttaggcaatgacacagtttatggtcttgtgttctgtatggcttccgcatcagctgaaatttgttccagctgcgtcaattctgctattcaaactctcatggcagcatgtccaaaccaaaaagaagcgatttcatggggagggaatccagttccatgtattgtacattatgcgaatcgttattttttaggatcacttgagctatctcctactgatgctggatataatacgggtatccttgacccatcttttagacagtttcttcaaatttggagtggtttgatgacagacacagtaacaatagcttccacgggctcatccaggtttaagttagcagctgagacggcagacctatcatccactcaaaaaatttatgtatttatgcagtgcactcctgatgtatcaccgagtaattgcagagattgcctacaacattccgtagattactataaaagttgttgcaacgggtatcaaggaggttatgcccagaaaccaaactgtgtttttcggtgggatttgtatcccttctacaacttatttcctcaagtaacatctccatctccatcatctcctccaccaaccaataccacaatcaggaaagggaaggagaataatgcttctcggacagttattgttaccatcgtccctacatctatcttcttggcacttgttatcctcattctcaccattttccgttttaggaagccaaagcaagaggtcaaaaatttcgatgaaaacagtagcacaaaatgctgggaattcaaatttgccaccatcaaacttgcaacaaacgacttctctgatgataataagcttggacaaggtggttttggtgctgtttacaagggtatacttgcagatggacaagctatagctgtaaagagattatcaagtaattctgggcaaggagcagtagaatttaggaatgaggtagggctactagccaaacttgctcaccggaatcttgttaggttactggggttctgcttggaaggaacagaaaagcttctaatctacgagtttgtgcctaattcaagtcttgatcaatttatacatgatccaaacaaacgattagtcctggattgggagaagcgctacaaaatcatagaaggcatagctagagggattctgtacctgcatcaagattctcagctctggattattcatcgtgatctcaagcctggcaacattctgttagatggaaacatgaatgctaaaatttcagattctggaatggcaaagttaatgaaaactgatcaaactcatgatgctacatcgaggatcgctggaacctttggctatattgctccagagtatgcatggaaaggacagttctcggtcaagtcagacgtgtttagttttggagtgctagtcttggagattgtgagcggtcaaaaacctagtttccgcaatggagatgacatggagcaccttacgagccatgcatggagacgttggagggaagggactgctttagatcttatagatcccattttgaggaacgactcaacagctgcaatgatgagatgcatccacattgggttactctgcgttcaagaaaatgtagctgacaggccgacaatggcttcagttgttcagatgctaagcaactcctctcttactttacaaacaccttttgaaccagcttcttcattgagctatacttcaacgatggagcaatcccagcttaagattatcccactatcgaagaatgagatttcaattactgagttagatcctcga

SEQ ID NO: 1024 - protein, 645 aa, Populus trichocarpa
  POPTR_0011s03220.1
MGSKTIVSLLFHVIIISITLTGAEVCYNTGNFTANSTYAKNRDLVLRSLASNVTANGGFYNTTIGLGNDTVYGLVFCMASASAEICSSCVNSAIQTLMAACPNQKEAISWGGNPVPCIVHYANRYFLGSLELSPTDAGYNTGILDPSFRQFLQIWSGLMTDTVTIASTGSSRFKLAAETADLSSTQKIYVFMQCTPDVSPSNCRDCLQHSVDYYKSCCNGYQGGYAQKPNCVFRWDLYPFYNLFPQVTSPSPSSPPPTNTTIRKGKENNASRTVIVTIVPTSIFLALVILILTIFRFRKPKQEVKNFDENSSTKCWEFKFATIKLATNDFSDDNKLGQGGFGAVYKGILADGQAIAVKRLSSNSGQGAVEFRNEVGLLAKLAHRNLVRLLGFCLEGTEKLLIYEFVPNSSLDQFIHDPNKRLVLDWEKRYKIIEGIARGILYLHQDSQLWIIHRDLKPGNILLDGNMNAKISDSGMAKLMKTDQTHDATSRIAGTFGYIAPEYAWKGQFSVKSDVFSFGVLVLEIVSGQKPSFRNGDDMEHLTSHAWRRWREGTALDLIDPILRNDSTAAMMRCIHIGLLCVQENVADRPTMASVVQMLSNSSLTLQTPFEPASSLSYTSTMEQSQLKIIPLSKNEISITELDPR

SEQ ID NO: 1025 - DNA, 1971 bp, Populus trichocarpa
  POPTR_0011s03280.1
atgggttctaaaactatcgtctctcttctttttcatgttattatcataagcatcactcttaccggtgctgaagtctgttataacacaggaaactttacagctaatagcacctatgcaaaaaaccgagaccttgttctccgttcactagcttccaatgtcacagccaatgggggtttctataatactacaataggtttaggcaatgacacagtttatggtcttgtgctctgtatggcttccccatcagctgaaaattgttccagctgcgtcaattatgctattcaaactctcatggcagcatgtccaaaccaaaaagaagcaatttcatggggagggaatccacttccatgtattgtacgctatgagaatcgttatttttttcgatcacttgagccatctcctactagcgctttatataatacgggtatccttgacgcaacttctagacagtttgatcaattttggagtggtttgggagaaacggtaagaaacgcttccacgggctcatccaggcttatgccagcagttgagacagcagacctaccatccactcaaaaaatttatgtatttatgcagtgcactcctgatgtatcaccgagtaattgcagtgtttgcctacaacaatccgtagattactatacaagttgttgctacgggcatcaaggaggtattgtcctgaaaccaaactgtgtttttcggtgggatttgtatcccttctacgacttatttcctcaagtaacatctccaccaccatctccatctccatctccaccatctcctccatttgttattagttctcctccgccaaccaataccacaatcaggaaagggaaggagaatactgcttctcggacagttattgttaccatcgtccctacatctatcttcttggcacttgttatcctcattctcaccattttccgttttaggaagccaaagcaagaggtcaaaaatttcgatgaaaacagtagcacaaaatgctgggaattcaaatttgccaccatcaaacttgcaacaaacgacttctctgatgataataagcttggacaaggtagttttggtgctgtttacaagggtatacttgcagatggacaagctatagctgtaaagagattatcaagtaattctgggcaaggagcagtagaatttaggaatgaggtagggctactagccaaacttgctcaccggaatcttgttagattactggggttctgcttggaaggaacagaaaagcttctaatctacgagtttgtgcctaattcaagtcttgatcaatttatacatgatccaaacaaacgattagtcctggattgggagaagcgcaaaaaaatcatagaagacatagctagagggattgtgtacctgcatcaagattctcagctctggattattcatcgtgatctcaagcctggcaacattctgttagatggaaacatgaatgctaaaatttcagattctggaatggcaaagttaatgaaaactgatcaaactcatgatgctacatcgaggatcgctggaacctttggctatattgctccagagtatgcatggaaaggacagttctcggtcaagtcagatgtgtttagttttggagtgctagtcttggagattgtgagcggtcaaaaacctagtttccgcaatggagatgacatggagcaccttacgagccatgcatggagacgttggagggaagggactgctttagatcttatagatcccattttgaggaacgactcaacagctgcaatgatgagatgcatccacattgggttactctgcgttcaagaaaatgtagctgacaggccgacaatggcttcagttgttcagatgctaagcaactcctctcttactttacaaacaccttttgaaccagcttcttcattgagctatacttcaacgatggagcaatcccagcttaagattatcccactatcgaagaatgagatttcaattactgagttagatcctcga

SEQ ID NO: 1026 - protein, 657 aa, Populus trichocarpa
  POPTR_0011s03280.1
MGSKTIVSLLFHVIIISITLTGAEVCYNTGNFTANSTYAKNRDLVLRSLASNVTANGGFYNTTIGLGNDTVYGLVLCMASPSAENCSSCVNYAIQTLMAACPNQKEAISWGGNPLPCIVRYENRYFFRSLEPSPTSALYNTGILDATSRQFDQFWSGLGETVRNASTGSSRLMPAVETADLPSTQKIYVFMQCTPDVSPSNCSVCLQQSVDYYTSCCYGHQGGIVLKPNCVFRWDLYPFYDLFPQVTSPPPSPSPSPPSPPFVISSPPPTNTTIRKGKENTASRTVIVTIVPTSIFLALVILILTIFRFRKPKQEVKNFDENSSTKCWEFKFATIKLATNDFSDDNKLGQGSFGAVYKGILADGQAIAVKRLSSNSGQGAVEFRNEVGLLAKLAHRNLVRLLGFCLEGTEKLLIYEFVPNSSLDQFIHDPNKRLVLDWEKRKKIIEDIARGIVYLHQDSQLWIIHRDLKPGNILLDGNMNAKISDSGMAKLMKTDQTHDATSRIAGTFGYIAPEYAWKGQFSVKSDVFSFGVLVLEIVSGQKPSFRNGDDMEHLTSHAWRRWREGTALDLIDPILRNDSTAAMMRCIHIGLLCVQENVADRPTMASVVQMLSNSSLTLQTPFEPASSLSYTSTMEQSQLKIIPLSKNEISITELDPR

SEQ ID NO: 1027 - DNA, 1977 bp, Citrus clementina
  clementine0.9_004451m
atggcgaagggctgctcaagattggttttcttcttctttttcctcatacttgctgtgtccattaatgcccagaacgtctgttcaaatgacgttggtaattacacaagtaacagtgcctataaaacaaaccttaacagcgtcttatcctccatcgcctctaatacagccgtagactatgggttctacaatgagtctacaggccaagaacctgacaaagtcaacgtcattgctctttgtagaggagatattgcaaccgatgtttgtcgaggttgcttagaaaacgctactcaggaaatcttgcgagtttgtcccaaccaaaagaaagcaattatatggtctgctgaatgtctgctccgctactcgaacaaaacaattttcggtgtgctggaaactggacctacttactacatgtggaatatgaacaatgtcacggacgatgtgagcctgtttaaccaggcgctgcaggatttgttgaggagattacgagacacagctgcatctgggaattctcaaaaaaagtttgcaacaggagatatgacagcaagttttaggacgatatatgcacttgaacaatgtactcctgatctgtctgagctgcagtgctctgattgcctggatagggctattggagaaattccaaattgttgcagtgggaagataggagggagagttcttaaacccagctgtaatttcaggtttgagactgagcgtttttacaacccaacagccaactcaccaccaccatcgccacccccaccggctgaaggaaacggtagtgacacagctcgaacggtcatcatcatccttattccaacagttggttttgtgattcttattatcttcatctgtttctttttaagaagaaggaagccgagggataactctaaggttaaaagcgaagctgccgccggggacgaaattaatagagcagaatccttacaattcgacttcaatacaattagagttgcaacagataacttctccgatgcaaataagcttggacaaggaggattcggggctgtttacaagggtagactttatgatggagcagaaattgctgtgaaaaggctgtctagggattcaggacagggagatctggaatttaagaatgaggtcctgttagtggccaatcttcaacatcgtaatttagtcaggttgcttggtttttctttggaaggaaatgaaagacttcttatttatgagtttgtgcctaacacaagcctggaccacttcatattcgatccgactaggcgggcacaattagattgggaaaggcgatacaaaattattggaggcattgctagagggcttctttaccttcacgaagactctcgtcttcggattattcaccgtgatctcaaaactagtaatgttttgttagatgcagagatgacccctaaaatagcagatttcggcatggccaggttgtttgagatggatgaaactcaaggcaatacgagtagaattgtagggacctatggctatatggctccagaatatgcaatgcatggacaatattcagttaagtcagatgtttttagttttggagtattggttctcgagatcataagcggtcagcgaaataattgtttccgaaatggagagacagtagaagatcttttaagctctgcatggaaaaattggagggagggaacgacagtgaatatcatagatccaacattgagtagtggttcaattactgaaatgataagatgcattcacatcggattattatgtgttcaagaaaatgtagccagcaggcctacaatggcttctgttgttctcatgcttaatagctactccctcacacttccagtaccttcagaaccagcattttttatggatagcatcattgaatccgacatgtcatcctcactagcccacgactcaagaattatggaaaccgatcagcccggttgtgaaactcttccattgtcaggcaacaacgaaatttcaattaccgacctgtatcctcga

SEQ ID NO: 1028 - protein, 659 aa, Citrus clementina
  clementine0.9_004451m
MAKGCSRLVFFFFFLILAVSINAQNVCSNDVGNYTSNSAYKTNLNSVLSSIASNTAVDYGFYNESTGQEPDKVNVIALCRGDIATDVCRGCLENATQEILRVCPNQKKAIIWSAECLLRYSNKTIFGVLETGPTYYMWNMNNVTDDVSLFNQALQDLLRRLRDTAASGNSQKKFATGDMTASFRTIYALEQCTPDLSELQCSDCLDRAIGEIPNCCSGKIGGRVLKPSCNFRFETERFYNPTANSPPPSPPPPAEGNGSDTARTVIIILIPTVGFVILIIFICFFLRRRKPRDNSKVKSEAAAGDEINRAESLQFDFNTIRVATDNFSDANKLGQGGFGAVYKGRLYDGAEIAVKRLSRDSGQGDLEFKNEVLLVANLQHRNLVRLLGFSLEGNERLLIYEFVPNTSLDHFIFDPTRRAQLDWERRYKIIGGIARGLLYLHEDSRLRIIHRDLKTSNVLLDAEMTPKIADFGMARLFEMDETQGNTSRIVGTYGYMAPEYAMHGQYSVKSDVFSFGVLVLEIISGQRNNCFRNGETVEDLLSSAWKNWREGTTVNIIDPTLSSGSITEMIRCIHIGLLCVQENVASRPTMASVVLMLNSYSLTLPVPSEPAFFMDSIIESDMSSSLAHDSRIMETDQPGCETLPLSGNNEISITDLYPR

SEQ ID NO: 1029 - DNA, 2013 bp, Eucalyptus grandis
  Eucgr.D00833.1
atgatcgctccgccgcgttccgccgtccccctcctcctctcgctcctcgccctcaccgcctccgcccatggcgccgaccctctctaccacgtctgtgggaccaacggcaacttcaccgccaacggcacctatggggacaacctcaacgccctcctcacctccgtcgtcgccgccgccgccgcggacgactacgggttctacaacctctccgccggcggcgggagcgccgattccgtcaacgccatcgccctctgccggggcgacgtcggggccgccgactgccggagctgcctgaacgactccgccgccgagatcgccggccggtgcccggtgcagaaggaggcgatcatctggtacgacaactgcatgctccggtactcgaaccgctccatttttcggaccaaggaggacttgcccggctactacatgtggaatctcaacaacgtcaccaacaatgtcgatcagttcaatcaggttttgagaaatctgatggatgatttgagagatcgagccgcgaatggcaattcgacgaggaaatttgcggttggaaacgctaccgctccaaacttccaaactctgtttggacttgtgcagtgcactccagacttgtcgcagcaacaatgcgacgattgtctagtgggaaccattggacaaattcctcagtgttgtaatcagaaacaaggaggaagggttattattcccagttgcaatatcaggtttgaagtaggccgcttttttgatccttcggcttatgagacgtcaccatcaccaccgcaatcgccagtttctcctccacctcctccaacgaataacccacccgctaaaggaaaggatactaactcaggtcatattaccctcattatcacaatcccagctgttggattatctcttttaattgctggaatattgtgcatctgtttgaggtcaagaagattgaagaaaaatttcgaaactgtacctgtagatgaaatcacaaatgcagaatccctgcagtttgacttgaataccatcagagaggcaacaaatgacttctctgacgcaaataaattgggacaaggtggatttggcgtagtttacaagggaacattggccaatggacaagttatagcggtaaaaaggctgtctgtagatttgggacaaggtgatccagaattcaagaatgaagtcctcttggtcgcaaggcttcaacaccggaatttggttaggctcttaggattttgcctggaggggagagaaaggcttcttatctatgaatttgtaccaaactcgagcctggaccactttatatttgatcctgttaggcgtaggcagctggattgggagaggcgtcaaaagataataggaggcattgctcgtgggcttctttatcttcatgaggattctcaacttcgaattattcatcgggatctcaaagcaagcaatgttttgctagatgcagagatgaaccctaaaatttcagattttggtacagcaaggctatttgcggtggatcaaagtcaagacgccacaagcagggttgttggcacttatgggtacatggctccagagtacgcaatgcatggattgttctcagtcaagtcagatgtctttagttttggggtgttgctactagagattattagtggtcaaaaaagtagccgcttctgcaatggggataccacggaggaccttcttagctatgcatggaggagttggagggaagcgaccccctcagatctcatagatcctaatttggctgatggttcgaggattgaaatattgaggtgcattcatgtcggattgctgtgtgttcaagaaattgaggctgacagacccaccatgggttcggtggttctgatgctcagtagttactccaccaccttgccactaccatcacaacctgcattcattttgcccagtatccctgaatctgacacagcttcgcgggtgatgataactcattcaaatcgatccaaagacagagaaatccaagaatcagtgaatgaggcttccatcaccgagctgtatcctcga

SEQ ID NO: 1030 - protein, 671 aa, Eucalyptus grandis
  Eucgr.D00833.1
MIAPPRSAVPLLLSLLALTASAHGADPLYHVCGTNGNFTANGTYGDNLNALLTSVVAAAAADDYGFYNLSAGGGSADSVNAIALCRGDVGAADCRSCLNDSAAEIAGRCPVQKEAIIWYDNCMLRYSNRSIFRTKEDLPGYYMWNLNNVTNNVDQFNQVLRNLMDDLRDRAANGNSTRKFAVGNATAPNFQTLFGLVQCTPDLSQQQCDDCLVGTIGQIPQCCNQKQGGRVIIPSCNIRFEVGRFFDPSAYETSPSPPQSPVSPPPPPTNNPPAKGKDTNSGHITLIITIPAVGLSLLIAGILCICLRSRRLKKNFETVPVDEITNAESLQFDLNTIREATNDFSDANKLGQGGFGVVYKGTLANGQVIAVKRLSVDLGQGDPEFKNEVLLVARLQHRNLVRLLGFCLEGRERLLIYEFVPNSSLDHFIFDPVRRRQLDWERRQKIIGGIARGLLYLHEDSQLRIIHRDLKASNVLLDAEMNPKISDFGTARLFAVDQSQDATSRVVGTYGYMAPEYAMHGLFSVKSDVFSFGVLLLEIISGQKSSRFCNGDTTEDLLSYAWRSWREATPSDLIDPNLADGSRIEILRCIHVGLLCVQEIEADRPTMGSVVLMLSSYSTTLPLPSQPAFILPSIPESDTASRVMITHSNRSKDREIQESVNEASITELYPR

SEQ ID NO: 1031 - DNA, 1962 bp, Eucalyptus grandis
  Eucgr.D00841.1
atgatcgctccgcggcgttccgccgtccccctcctcctctcgctcctcgccctcgccacctccgcccatggcgacgaccctctccgctacttctgcgggaccaaaggcaacttcactgccaacggcacctacggggacaacctcaaggccctcctcacatccgtcgtcgccgccgccacagcagacggtggcggcttctacaacctttcagtcggcggcgggagccccgacgccgtcaatgccatcgccctctgccggggcgacgtcggggccgccgactgccggagctgcctgaacgattccgccgccgagatcgcccgccagtgcccgatgcagaaggaggcgatcatctattacgacaaatgcatgcttcgttactcgaatcggtccatctttggcgtggtggagatttcgccttattggcacgtgtggaacgtcaacaaaatcaccaacaacgtcgatcagttcaatcaggttttgcgcaatctgatggatggtttgagagaccgagctgcaagtggcaattcgacgaggaaatttgccgtcgggaatgcgacagctccaaacttccagactctgtttggactagtgcagtgcactgaagacttgacgtggctacaatgtgacaattgtttggtgaatgctattggaaaaattccttgttgtgatcagacaataggaagaaggtaccttactcccagttgcaatatcaggtttcaagtaagccccttttttgatacttcagcttatgagtcgccaccatcaccaccggaatcgccagtttctcctccaccaactccaacgaataacccatccactaaaggaaaggatactaactcaggtcgtattgccctcattatcacaatcccagctgttggattatctcttttagttgctggaatattatgcatctgtttgaggtcaagaagattgaagaaaaattttgaaaatgaaatcagaaatgcagaatccctgcagttcgacttgaatatcatcagagaggcaacaaatgacttctctgatgcaaataaggtgggacaaggtggatttggcgtagtttacaagggaacattggccaatggacaagttatagcagtaaaaaggccctctgtagatttgggacaaggtaatcaagaatttaagaatgaggtcctcttggttgcaaggcttcaacaccggaatttggttaggctcttaggattttgcctggaggaaagagaaaggcttcttatctatgaattcgtaccaaactcaagcctggatcactttttatatgatcctgttaggcgtagccagctgggttggcaaaggcgtcaaaagataatagggggcattgctcgtgggcttctttatcttcatgaggattctcaacttcgaatcattcatcgggatcttaaagcaggcaatattttgcttgatgcagagatgaaccctaaaatttcagattttggtacagcaaggctatttgcagtggatcaaactcaagacgccacaagcagggttgttggcacttatgggtacatggctccagagtatgcaatgcatggattgttctcagtcaagtcagatgtctttagttttggggtgttgctactagagattattagtggtcaaaaaagtagccgcttctgcaatgggaataccacggagggtcttcttagctatgcatataggagtttgagggaagggaccccctcagatctcattgatcctaatttggctggtggttcgaggactgaaatgttgaggtgcattcatgttggattgttgtgtgttcaagaaatcgaggccgacagaccaaccatgggtgcggtggttttgatgctcagcagttattccaccaccttgccactaccatcacgacctgcattcattttgcccaagaaatccaagaatcagggaacgaggcttctatcaccgagctatatcctcaatgatcacagattggagtctatatttgtg

SEQ ID NO: 1032 - protein, 654 aa, Eucalyptus grandis
  Eucgr.D00841.1
MIAPRRSAVPLLLSLLALATSAHGDDPLRYFCGTKGNFTANGTYGDNLKALLTSVVAAATADGGGFYNLSVGGGSPDAVNAIALCRGDVGAADCRSCLNDSAAEIARQCPMQKEAIIYYDKCMLRYSNRSIFGVVEISPYWHVWNVNKITNNVDQFNQVLRNLMDGLRDRAASGNSTRKFAVGNATAPNFQTLFGLVQCTEDLTWLQCDNCLVNAIGKIPCCDQTIGRRYLTPSCNIRFQVSPFFDTSAYESPPSPPESPVSPPPTPTNNPSTKGKDTNSGRIALIITIPAVGLSLLVAGILCICLRSRRLKKNFENEIRNAESLQFDLNIIREATNDFSDANKVGQGGFGVVYKGTLANGQVIAVKRPSVDLGQGNQEFKNEVLLVARLQHRNLVRLLGFCLEERERLLIYEFVPNSSLDHFLYDPVRRSQLGWQRRQKIIGGIARGLLYLHEDSQLRIIHRDLKAGNILLDAEMNPKISDFGTARLFAVDQTQDATSRVVGTYGYMAPEYAMHGLFSVKSDVFSFGVLLLEIISGQKSSRFCNGNTTEGLLSYAYRSLREGTPSDLIDPNLAGGSRTEMLRCIHVGLLCVQEIEADRPTMGAVVLMLSSYSTTLPLPSRPAFILPKKSKNQGTRLLSPSYILNDHRLESIFV

SEQ ID NO: 1033 - DNA, 2007 bp, Eucalyptus grandis
  Eucgr.D00843.1
atgatcgctccgccgcgttccgccgtccccctcctcctctcgctcctcgcccttgccacctccgcccatggcgccgaccctctctactacttctgtgggaccaacggcaacttcaccgccaacggcacctacggggacaaccttaacgccctcctcacctccgtcatcaccgccaccgccgccgactacgggttctacaacctctctgccggcagcgggagcgccgatgccatcaacgccattgccctctgccggggcgacgttggggccgctgactgccggagctgcctgaacgactcggcccccgcgatcgccggccggtgcccggtgcagaaggaggcgatcatctggtacgacaactgcatgctccggtactcgaaccgctccatttttcgggccatggaggatttgcccgccttcggcttggcgaaccccaacaacgtcaccaacaacgtcgatcagttcaatcaggttttgagaaatctgacggatggtttgagagaccgagctgcgaatggcaattcgacgaggaaatttgccgtcgggaacgcgacagctccaaacttccagactctgtttggactagtgcagtgcactccagacttgtcgcagcaacaatgcgacaattgtttggtgaatgctattggaaaaattccttggtgttgtgatcagaaacaaggaggaaggtatgttactcccagttgcaatatcaggtttgaagtataccgcttttttgatccttcggcttatgagtcgccaccatcaccaccagaatcgacagtttctcctccacctcctccaacgaataacccatcccctaaaggaaaggatactaactcaggtcgtattgccctcattatcacaatcccagctgttggattatctcttttagttgctggaatattatgcatctgtttgaggtcaagaagattgaagaaaaatttcgaaactgtacctgtagatgaaatcagcaatgcagaatccctgcagttcgacttgaatatcatcagagaggcaacaaatgacttctctgactcaaataagttgggacaaggtggatttggcgtagtttacaagggaacattggccaatggacaagttatagcagtaaaaaggctgtccgtagatttgggacaaggtgatcaagaattcaagaatgaggtcctcttggttgcaaggcttcaacaccggaatttggttaggctcttaggattttgcctagaggggagagaaaggcttcttatatatgaatttgtaccaaactcaagcctggatcactttatatatgatcctgttaggcgtagccggctggattgggaaaggcgtcaaaagataatagggggcattgctcgtgggcttctttatcttcatgaggactctcaacttcgaatcattcatcgggatcttaaagcgagcaatattttgcttgacgcagagatgaatcctaaaatttcagattttggtacagcaaggctatttgcggtggatcaaactcaagacgccacaagcagggttgttggcacttatgggtacatggctccggagtacgcaatgcatggattgttctctgtcaagtcagatgtctttagttttggggtgttgctactagagattattagtggtcaaaaaagtagccacttctgcaacgggaataccacagaggaccttcttagctatgcatggaggagttggagggaagggaccccctcagatctcatagatcctaatctggctgatggttcgaggaccgaaatgttgaggtgcattcatgttggattgctgtgtgttcaagaaatcgaggccgacagaccaaccatgggtgcggtggttttgatgctcagtagttactccaccaccttgccactaccatcacgacctgcattcatttccagtatccctgaatctaacacagcttcgcgggtgatggtaactcattcaaatcaatctgaaaacaaagaaatccgagaatcagtgaacgaggcttctatcaccgagctatatcctcga

SEQ ID NO: 1034 - protein, 669 aa, Eucalyptus grandis
  Eucgr.D00843.1
MIAPPRSAVPLLLSLLALATSAHGADPLYYFCGTNGNFTANGTYGDNLNALLTSVITATAADYGFYNLSAGSGSADAINAIALCRGDVGAADCRSCLNDSAPAIAGRCPVQKEAIIWYDNCMLRYSNRSIFRAMEDLPAFGLANPNNVTNNVDQFNQVLRNLTDGLRDRAANGNSTRKFAVGNATAPNFQTLFGLVQCTPDLSQQQCDNCLVNAIGKIPWCCDQKQGGRYVTPSCNIRFEVYRFFDPSAYESPPSPPESTVSPPPPPTNNPSPKGKDTNSGRIALIITIPAVGLSLLVAGILCICLRSRRLKKNFETVPVDEISNAESLQFDLNIIREATNDFSDSNKLGQGGFGVVYKGTLANGQVIAVKRLSVDLGQGDQEFKNEVLLVARLQHRNLVRLLGFCLEGRERLLIYEFVPNSSLDHFIYDPVRRSRLDWERRQKIIGGIARGLLYLHEDSQLRIIHRDLKASNILLDAEMNPKISDFGTARLFAVDQTQDATSRVVGTYGYMAPEYAMHGLFSVKSDVFSFGVLLLEIISGQKSSHFCNGNTTEDLLSYAWRSWREGTPSDLIDPNLADGSRTEMLRCIHVGLLCVQEIEADRPTMGAVVLMLSSYSTTLPLPSRPAFISSIPESNTASRVMVTHSNQSENKEIRESVNEASITELYPR

SEQ ID NO: 1035 - DNA, 1893 bp, Eucalyptus grandis
  Eucgr.D00842.1
atgatcgctccgccgcgttccgccgtccccctcctcctctcgctcctcgccctcgccgcctccgcccatggcgccggccacgcctgcgggaccaacggcaacttcaccgccaacggcacctacggggacaacctcaacgccctcctcacctccgtcgtcgccgccgccgccgcagacgccgccgctgccgactactacgggttctacaacctctccgccggcggcgggagccccgatgccgtcaatgccatcggcctctgccggggcgacgtcggggccgtcgactgccggagctgcctgaacgactccgccgccgagatcgcccgccagtgcccagtgcagaaggaggcgatcatctggtacgacaactgcgtgcttcggtactcgaaccgatccatttttcggaccgaggaggactcgcccaccttctactggcaaaaccgcaagaacctcaccaacaacgtcgatcagttcaatcagattttgagagatctgatggatggtttgagagatcgagctgcaaatggcaattcgacgaggaaatttgcggttggaaatgctaccgctccaaacttccaaactctgtttggacttgtgcagtgcactccggacttgtcgcagcaacaatgcagcgattgtttagtgggaaccattggaaaaattcctcagtgttgtaatcagaaacaaggaggaagggttattactcccagttgcaatatcaggtttcaagtataccctttttttgatccttcggcttatgagtcgccaccatcaccaccacaatcaccagtatctcctccaactcctccaaagaataacccatcccctaaagctgaaccagtagatgaaatcagcaatgcagaatccctgcagttcgacttgaatataatcagagaggcaacaaatgacttctctgactcaaataagttgggacaaggtggatttggcgtagtttacaagggaacattggccaatggacaatttatagcagtaaaaaggccatctgtagatttgagacaaggtaatcaagaatttaagaatgaggtcctcttggttgcaaggcttcaacaccggaatttggttaggctcttaggattttgcctggaggaaagagaaaggcttcttatatatgaattcgtaccaaactcaagcctggatcactttttatatgatcctgttaggcgtagccagctaagttggcaaaggcgtcaaaagataatagggggcattgctcgtgggcttctttatcttcatgaggattctcaacttcgaatcattcatcgggatcttaaagcgggcaatattttgcttgacgcagagatgaaccctaaaatttcagattttggtacagcaaggctatttgcggtggatcaaactcaagacgccacaagcagggttgttggcacttatgggtacatggctccagagtacgcaatgcatggattgttctcagtcaagtcagatgtctttagttttggggtgttgctcctagagattattagtggtcaaaaaagtagccgcttttgcaacggaaataccacggagggccttcttagctatgcatataggagttggagggaagggaccccctcagatctcatagatcctaatttggctgatggttcaaggaccgaaatgttgaggtgcgttcatgttggattgctgtgtgttcaagaaatcgaggccgacagaccaaccatgggtgcggtggttttgatgctcagtagttattccaccaccttgccactaccatcacgacctgcgttcattttgcccagtatccttgaatctgacacaactccgctggtgatggtaactcattcgaatcaatccgaaaacagagaaatccaagaatcagtgaacgaggcttctatcaccgagctatatcctcga

SEQ ID NO: 1036 - protein, 631 aa, Eucalyptus grandis
  Eucgr.D00842.1
MIAPPRSAVPLLLSLLALAASAHGAGHACGTNGNFTANGTYGDNLNALLTSVVAAAAADAAAADYYGFYNLSAGGGSPDAVNAIGLCRGDVGAVDCRSCLNDSAAEIARQCPVQKEAIIWYDNCVLRYSNRSIFRTEEDSPTFYWQNRKNLTNNVDQFNQILRDLMDGLRDRAANGNSTRKFAVGNATAPNFQTLFGLVQCTPDLSQQQCSDCLVGTIGKIPQCCNQKQGGRVITPSCNIRFQVYPFFDPSAYESPPSPPQSPVSPPTPPKNNPSPKAEPVDEISNAESLQFDLNIIREATNDFSDSNKLGQGGFGVVYKGTLANGQFIAVKRPSVDLRQGNQEFKNEVLLVARLQHRNLVRLLGFCLEERERLLIYEFVPNSSLDHFLYDPVRRSQLSWQRRQKIIGGIARGLLYLHEDSQLRIIHRDLKAGNILLDAEMNPKISDFGTARLFAVDQTQDATSRVVGTYGYMAPEYAMHGLFSVKSDVFSFGVLLLEIISGQKSSRFCNGNTTEGLLSYAYRSWREGTPSDLIDPNLADGSRTEMLRCVHVGLLCVQEIEADRPTMGAVVLMLSSYSTTLPLPSRPAFILPSILESDTTPLVMVTHSNQSENREIQESVNEASITELYPR

SEQ ID NO: 1037 - DNA, 1863 bp, Populus trichocarpa
  POPTR_0004s02560.1
atgttgtttatattttcttgcatccttctgcacctagcttctctaaccatagctcaaacgcaattctgttcaaatgatgtaggtaactacaccaccaacagcaatttccgaagaaacctcaacagtgtcctgtcttccctggattcaaatactcaaattgactacggattttacaatctatcggttggccaacctggtcctgaccaagcaaatgtaattgcactttgcagaggagataatattggaatagacgaatgccagaattgtattggaaattcttcgggtaatatcttacagttctgtccaaaccagaaagaggcatttggaattgctgatacttgtattctacgatactccaacaaatccatatttggtgtcatggaagacaatccagtatccattcttgtgaacacggtcaatgctacagatgtgaatcagttcaatcaggctcttcaaacgttaatgagtagacttcgaagcacagctgcttcagggaactctctccgaaagtttgcgacaggaaatgaaactgccgggtttgacaccatttttgggcttgttcaatgcacacctgatctatctgagccgcagtgtgatgattgcatcgctggggctattcgggtgattgcaacatgttgtgatggaagacaaggagcgagaatcacaagtccaagctgcaatctcaggtatgaagtctaccgtttcttcggagttacaccggccacaccacagcttccagcttcgccatcgccacaagcaccatcagttcctcctcctccaccaccagcagaagctgtggaagaaatgataacagcagaatccttgcaattcgacttcagtactattagagctgcaacagataacttttctgaggaaaataagcttggacaaggtggatttggttctgtttacaagggtacactttctaatggacaagaggtagcagtcaaaagactttccaaggattctggacaaggagatttagaatttaaaaatgaagtcctgttggttgccaagctacaacaccggaatttagttagacttcaaggattttgcttgcaaggaatcgaaaggcttcttatctacgagtttgtgcctaatgccagccttgatcacttcatattcaatcaagcgaggcgagcacagctggactgggaaaggcgttacaagatcattggaggcatcgctcgtggacttctttaccttcatgaggactctcgccttcgaatcattcatcgcgacctcaaagctagcaacattttattggatgcagacatgaatcctaaaatttccgatttcgggatggcaagattgttcgtgatggatgaaactcaaggcaatacaagtagaatcgtggggacatatggctacatggctccagagtatgcgatgcatggacaattctcagtgaaatcagacgtgtttagtttcggcgtgctaatcttggagattgtgagtggtcagaaaaacaactgttttcgtaatggtgaaactgtagaggatttattgagctatgcatggagaaattggagggaaggcacaggtttgaatgttatagaccctgctttgagcactggttcaagaactgaaatgatgagatgtatccatattggtttactctgtgttcaagaaaacatagctgatagaccaaccatggcttcgattgttctaatgctaagcagctattctcttactctgccagtaccttctcaaccagcattttttatgaacagcagcacatatcaatcagacatatcatcgtcaatggactacaattcaagggtgactaattcctcagaggccaaaactgaagctctcccattgtcagcaaatgaggcatcaattactgagttataccctcgt

SEQ ID NO: 1038 - protein, 621 aa, Populus trichocarpa
  POPTR_0004s02560.1
MLFIFSCILLHLASLTIAQTQFCSNDVGNYTTNSNFRRNLNSVLSSLDSNTQIDYGFYNLSVGQPGPDQANVIALCRGDNIGIDECQNCIGNSSGNILQFCPNQKEAFGIADTCILRYSNKSIFGVMEDNPVSILVNTVNATDVNQFNQALQTLMSRLRSTAASGNSLRKFATGNETAGFDTIFGLVQCTPDLSEPQCDDCIAGAIRVIATCCDGRQGARITSPSCNLRYEVYRFFGVTPATPQLPASPSPQAPSVPPPPPPAEAVEEMITAESLQFDFSTIRAATDNFSEENKLGQGGFGSVYKGTLSNGQEVAVKRLSKDSGQGDLEFKNEVLLVAKLQHRNLVRLQGFCLQGIERLLIYEFVPNASLDHFIFNQARRAQLDWERRYKIIGGIARGLLYLHEDSRLRIIHRDLKASNILLDADMNPKISDFGMARLFVMDETQGNTSRIVGTYGYMAPEYAMHGQFSVKSDVFSFGVLILEIVSGQKNNCFRNGETVEDLLSYAWRNWREGTGLNVIDPALSTGSRTEMMRCIHIGLLCVQENIADRPTMASIVLMLSSYSLTLPVPSQPAFFMNSSTYQSDISSSMDYNSRVTNSSEAKTEALPLSANEASITELYPR

SEQ ID NO: 1039 - DNA, 2046 bp, Populus trichocarpa
  POPTR_0011s03270.1
atgtacgcaagcacggtgccaatggattcttcaaaattagtgcttctactttcgttctcttacatccttctacaccaaccttcccttaccgctgctcagccgaacttcatttattataactgtaactacaacaacaccggcaactacacaactaatagcacgtaccaaagaaacctcaacagccttctgtcctccctagcatccgacactcaaattgactacggattttacaatctatccgttggcgaatttcctgaccgagtaaatgcaattgcactatgcagaggagacgttgccgttgatgtttgtcgaagttgcgttaatgactctactcataagatcttagaggtttgtcctaacaagatgggggcatttggagtttacgcactctgtatgatacgatactcaaacacatctatattcggtgttgtggatgaaaaaccatctatctaccaggcgaatggaaagaatgttttggatgtaactctatttaatcaggcactacaaacattatttgccagacttcgagccaaagctgcatcagggaactctttaaagaaattcgcaactggaaaccaaagtgctggagttgaaacagtatatgctattgttcaatgcacgcctgacttatctgaggggcagtgctccagttgcctgcttggggtttttcggatgattacaaactgttgtggtgggaacgtacaagggaagattggagctaaactcataacaccaagctgcaatttgaggtgggagattggaccgttttttaatggtacacttgagatattaccatcacctccaccaccacaaatatcatcacctacatctcttcctgcaccagcacaaggaaagaagagcaacacagttcggatcattgtcattactgttgtcccagctgtcggtgctgtgatactcgtcatctgcatgtgcctattcataagaacacgaaagcaaagggaaaaggaaaggattgaaactggggacgaaatagaaagtgcagaatcattgcaattcgcattcagcaccattcgagatgcaacagaggacttttcggagaaaaataagctgggacagggtggatttggtgctgtttacaagggagcacttcctagcggacaagagattgctgtgaaaagactttctaaggactctgggcaaggagatttggaattcaaaaatgaagtcttattggtggcaagactccagcaccggaatttagtcaggcttctgggtttctgcttgcaaggaattgaaaggcttcttatctatgagtttgtgcctaatgcgagccttgatcacttcatatttgatccaatcaagcgtgtgcatttgaactgggaaagacgttacaagattattggaggaattgctcgagggctcctttaccttcacgaggattctcgacttcgaatcattcatcgtgacctcaaagccagcaacattttgttagatgaagagatgaatccgaaaatttcagattttggcatggcgaggttgttcgtagtggatcaaactcaaggcaatacaagtagaattgtgggaacctatggctatatggctccagaatatgcaatgcaaggacacttctcggtcaagtcagacgtatttagtttcggcgtgctagttttggagattgtgactggtaaaaaaaatagttttcgcaatggaaatgacatagagcaccttttgagccatgcatggagaaactggagggaagggacagctcaagatattatagatcccgttttgagtagtggctcagcaacagaaatgttgagatgcatccacattgggttactctgcgttcaagaaaatgtagctgaaaggccgacaatggcttcagtagttctcatgctaagcagctcttccctcacattgcaaataccttctcagcctgcattttttatgaacagcagcacatatcaatcagatctgtcatcctcaatggagcataattcaagggtgactgagtcctcgctatctgaatctgtagctatccctttgtccaaaaatgaggtttcaattactgagttgtatcctaga

SEQ ID NO: 1040 - protein, 682 aa, Populus trichocarpa
  POPTR_0011s03270.1
MYASTVPMDSSKLVLLLSFSYILLHQPSLTAAQPNFIYYNCNYNNTGNYTTNSTYQRNLNSLLSSLASDTQIDYGFYNLSVGEFPDRVNAIALCRGDVAVDVCRSCVNDSTHKILEVCPNKMGAFGVYALCMIRYSNTSIFGVVDEKPSIYQANGKNVLDVTLFNQALQTLFARLRAKAASGNSLKKFATGNQSAGVETVYAIVQCTPDLSEGQCSSCLLGVFRMITNCCGGNVQGKIGAKLITPSCNLRWEIGPFFNGTLEILPSPPPPQISSPTSLPAPAQGKKSNTVRIIVITVVPAVGAVILVICMCLFIRTRKQREKERIETGDEIESAESLQFAFSTIRDATEDFSEKNKLGQGGFGAVYKGALPSGQEIAVKRLSKDSGQGDLEFKNEVLLVARLQHRNLVRLLGFCLQGIERLLIYEFVPNASLDHFIFDPIKRVHLNWERRYKIIGGIARGLLYLHEDSRLRIIHRDLKASNILLDEEMNPKISDFGMARLFVVDQTQGNTSRIVGTYGYMAPEYAMQGHFSVKSDVFSFGVLVLEIVTGKKNSFRNGNDIEHLLSHAWRNWREGTAQDIIDPVLSSGSATEMLRCIHIGLLCVQENVAERPTMASVVLMLSSSSLTLQIPSQPAFFMNSSTYQSDLSSSMEHNSRVTESSLSESVAIPLSKNEVSITELYPR

SEQ ID NO: 1041 - DNA, 1998 bp, Eucalyptus grandis
  Eucgr.E03056.1
atggatcctcccaaactccctctcttgcttcttctcacatttgcttccgccattaacgcccaatttttcccaaagccctattgtggttcgactggcaacttcagcgccgacagcacctaccaaaccaccctcgccaccatcctctcctccatctccaccgccaactccttgttcctcacctacggcttcttcaacgcctccttcgccgtctccggcgcctcccaaaccctctatgtcatcggctcctgccacggcgacctcacctccgagagctgccgcacctgcctcaatggctcagcctccgacatccgccgcctctgccccctccagaaggaggcggtcctctacagcgagaactgctccgtccgttactccaacacctcgatcttccgcacagtcaaaaccgacccttactacgtgctaaacaacgtcaacgacgtcacaagcccagacacgtacaacgctgcgctgcggacgctgctggaccgtctgcggggtgagacagcgggcggcggctcactgaggaagtacgcgacgggcaacacatcggcggttttcaacacgatctacgcgatgacacaatgcacgccggacttgaccaaccagcaatgcatcgactgcctggtgacagtcatcgggagacttgggcagtgctgtgctgggaagatgggagtgaggatcatggccccgagttgccagttccagtacgagaccgatgatcagttcttcgatccggtgggtgagcaacttccgccgtcccctgcaccggtggcagatgcgctgcctccgccaccaggtggaaagagcaatttgaataggactgtgatcattgtggtcgccacaagtgtttctgcggtttttcttgttggtgttattgtacttctgagagtgaaaaggaagaagaaacccaggcaaagagttgaaggtgaggctgtggatgaaattagcacagtggagtcgctgcaatttgatttcggcactattagagaggcaacggataatttctctaattccaagaagcttggacaaggaggttttggtgctgtttacatgggccggctctacaatggacaggaaattgcagtgaaacggctgtctcataattccagccaaggagaagtagaattcaagaatgaggtcatgttactagctaggctacaacataggaacttggtcaggctcctaggtttctgtttggaaggggtggaacgtctactcatttacgagtttgtgcccaattcaagccttgatcaattcatattcgatcccctgaagcgtgccaatctcaattgggataggcgtcaaaagataataatgggtgtcgctcgagggctactttacctacacgaagattctcgacttcgtatcatccatcgggacctcaaagccagcaacattttgttggactccgacatgaatcctaagatatctgatttcggtatggcaagactattcgagttggaccagactcaggcagagacaaaccggatcgtggggacctacggatatatggcgccagagtatgcaatgcatggaaacttctcgatcaaatccgatgtcttcagttttggtgtgctggttttggagattgtgagtgggcaaaagaataatattttccgggcaggtgatcatgcggagatccttataagctctgtttggaagaattggagggaaggaacaatatccaaaatcatcgatccctctataacctctagtttgagtaccgaaattgtgaggtgtgtccacattggtctactgtgcgtccaagaaaatgtggctaaccgaccgacaatggcctcagtccttctcatgcttaacagccactcagtcacactgcaagtgccgtcacaacctgcattcttcatgcacagcgacatcgaatccgatatgtcatctactcaagattacaattcaagggtgtctgacgtcgacagattaagaagcaaatcgaaccaattctcgaacaacgaggtctctgtgactgagccatatccacgg

SEQ ID NO: 1042 - protein, 666 aa, Eucalyptus grandis
  Eucgr.E03056.1
MDPPKLPLLLLLTFASAINAQFFPKPYCGSTGNFSADSTYQTTLATILSSISTANSLFLTYGFFNASFAVSGASQTLYVIGSCHGDLTSESCRTCLNGSASDIRRLCPLQKEAVLYSENCSVRYSNTSIFRTVKTDPYYVLNNVNDVTSPDTYNAALRTLLDRLRGETAGGGSLRKYATGNTSAVFNTIYAMTQCTPDLTNQQCIDCLVTVIGRLGQCCAGKMGVRIMAPSCQFQYETDDQFFDPVGEQLPPSPAPVADALPPPPGGKSNLNRTVIIVVATSVSAVFLVGVIVLLRVKRKKKPRQRVEGEAVDEISTVESLQFDFGTIREATDNFSNSKKLGQGGFGAVYMGRLYNGQEIAVKRLSHNSSQGEVEFKNEVMLLARLQHRNLVRLLGFCLEGVERLLIYEFVPNSSLDQFIFDPLKRANLNWDRRQKIIMGVARGLLYLHEDSRLRIIHRDLKASNILLDSDMNPKISDFGMARLFELDQTQAETNRIVGTYGYMAPEYAMHGNFSIKSDVFSFGVLVLEIVSGQKNNIFRAGDHAEILISSVWKNWREGTISKIIDPSITSSLSTEIVRCVHIGLLCVQENVANRPTMASVLLMLNSHSVTLQVPSQPAFFMHSDIESDMSSTQDYNSRVSDVDRLRSKSNQFSNNEVSVTEPYPR

SEQ ID NO: 1043 - DNA, 1983 bp, Eucalyptus grandis
  Eucgr.E03589.1
atggatcctcccaaactccctctcttgcttgttctcgtgtttgcttccaccatcgacgcccaagatctcttcccaaagccgtactgtggttcgaccggcaacttcagcgccaacagcacctaccaaaccgccctcaccgccctcctctcctccatctccaccaccaactccttgtccctcacctacggcttcttcaacgcctccttcgccgtctccggcgcctcccaaaccctctatgtcatcggctcctgccgcggcgacctcacctccgagagctgccgcacctgcctcaatggctcagcctccgacatccgccacctctgccccctccagaaggaggcggtcctctacagcgagaactgctccgtccgttactccaacacctcgatcttccgcacagtcaaaaccgaccctgactaccagctgttcaacgtcaacaacgtcacgagcccagacacgtacaacgctgcgctgcggacgctgctggaccgtttgcggggtgagacagcgggcggcggctcgctgaggaagtacgcgacgggcaacacatcggcggttttcaacacgatctacgcgatgacacaatgcacgccggacttgaccaaccagcaatgcatcgactgcctggtgacagtcatcgggagacttgggccgtgctgtgctgggaagatgggagtgaggatcatggccccgagttgccagttccggtacgagaccgatgatcagttcttcgacccggtgggtgagccacttccgccgccccctgcaccggtggcagatgcgctgcctccgccaccaggtggaaagagcaattcgaataggactgtgatcattgtggtcgccacaagtgtttctgcggtttttcttgttggtgttattgtacttctgagagtgaaaaggaagaagcaacccaggcaaagagttgaaggtgagactgtggatgaaattagcacagtggagtcgctgcaatttgatttcggcactattagagaggcaacggataatttctccaattccaagaagcttggacaaggaggttttggtgctgtttacatgggccggctctacaatggacaggaaattgcagtgaaacggctgtctcataattccagccaaggagaagtagaattcaagaatgaggtcatgttactagctaggctacaacataggaacttggtcaggctcctaggtttctgtttggaaggggtcgaacgtctactcatttacgagtttgtgcccaattcaagccttgatcagttcatattcgatcccctgaagcatgccaatctcaattgggataggcgtcaaaagataataatgggtgtcgctcgagggctgctttacctacacgaagattctcgacttcgtatcatccatcgggacctcaaagccagcaacattttgttggactcagacatgaatcctaagatatccgatttcggtatggcaagactattcgagttggaccagactcaggcagagacaaaccgggatcgtggggacctatatgcaatgcatggaaacttctcgatcaaatccgatgtcttcagttttggtgtgctggttttggagattgtgagtgggcaaaagaataatatttttcgggctggtgatcatgcggagatccttataagctctgtttggaagaattggagggaaggaacaatatccaaaatcatcgatccctctataacctctagtttgagtactgaaattgtgaggtgtgtccacattggtctactgtgcgtccaagaaaatgtggctaaccgaccgacaatggcctcagtccttctcatgcttaacagccactcggtcacattgcaagtgccgtcacaacctgcattcttcatgcacagcaacatcgaatccgatatgtcatctactcaggattacaattcaagggtgtctgacgtcgacagattaagaagcaaatcgaaccaattctcgaacaacgaggtctctgtgactgagccatatccacgg

SEQ ID NO: 1044 - protein, 661 aa, Eucalyptus grandis
  Eucgr.E03589.1
MDPPKLPLLLVLVFASTIDAQDLFPKPYCGSTGNFSANSTYQTALTALLSSISTTNSLSLTYGFFNASFAVSGASQTLYVIGSCRGDLTSESCRTCLNGSASDIRHLCPLQKEAVLYSENCSVRYSNTSIFRTVKTDPDYQLFNVNNVTSPDTYNAALRTLLDRLRGETAGGGSLRKYATGNTSAVFNTIYAMTQCTPDLTNQQCIDCLVTVIGRLGPCCAGKMGVRIMAPSCQFRYETDDQFFDPVGEPLPPPPAPVADALPPPPGGKSNSNRTVIIVVATSVSAVFLVGVIVLLRVKRKKQPRQRVEGETVDEISTVESLQFDFGTIREATDNFSNSKKLGQGGFGAVYMGRLYNGQEIAVKRLSHNSSQGEVEFKNEVMLLARLQHRNLVRLLGFCLEGVERLLIYEFVPNSSLDQFIFDPLKHANLNWDRRQKIIMGVARGLLYLHEDSRLRIIHRDLKASNILLDSDMNPKISDFGMARLFELDQTQAETNRDRGDLYAMHGNFSIKSDVFSFGVLVLEIVSGQKNNIFRAGDHAEILISSVWKNWREGTISKIIDPSITSSLSTEIVRCVHIGLLCVQENVANRPTMASVLLMLNSHSVTLQVPSQPAFFMHSNIESDMSSTQDYNSRVSDVDRLRSKSNQFSNNEVSVTEPYPR

SEQ ID NO: 1045 - DNA, 1923 bp, Eucalyptus grandis
  Eucgr.E03585.1
atggatcctccaaatctccctctcttgcttcttctcaccttggcttccaccattaccgcccaatctttcccaacgcccttctgtggttcgactggcaacttcagcgccgacagcacctaccaaatcaccctcaccgccctcctctcctccatctccaccaccaactccttgtccctcacctacggcttcttcaaggcctcctccgccgtctccggcgcctcccagaccctctatgtcatcggctcctgccgtggtgacctccctgccgagagctgtcgcgcctgtctcaatgcctcggcctctgacgttcgtgacctctgccccctccagaaggaggcggtcctctacagcgggaactgcaccatccggtactctaacgcctcgatcttcggcacagtcacgaccgacccccgctactcgctgtccaacgtgaacaacgtcacgagcccggacacgtacaacgcggcgctgcagacactgctgggtagtctgcagggcgaggcggcgggcggtggctcgctgaggaagtacgcgacagggaatgtgtcggcgggtttcgacaggatctatgcgatggtgcagtgcacgccggacttgacggagcaggattgcagcgactgcctggtgacagttgtcgcgacacttgggcagtgctgtgccgggaagttgggagtgaatatcatggcaccgagttgccagttccggtacgagaccactgatcggttcttcgacccggtcagcgagccacttccgccgccacccgcaccgctgccgcaggtgggagatgtgctgcctccgccgtcaggtggaaagagcaatttgaataggactgtgatcattgtggtcgccacaagtgtttctgcggtttttcttgttggtgttattgtacttctgagagtgaaaaggaagaagcaacccaggcaaagagttgaaggtgaggctgcggatgaaattagcacagtggagtcgctgcaatttgatttcgacaccattagagaggcaacagataatttctctaattccaacaggcttggacaaggaggttttggtgctgtttacatgggccggttcttcaatggacaggaaattgccgtgaaacggctatctcataattccagccaaggagaagtagaattcaagaacgaggtcatgttactagctaagctacaacataggaacttggtcaggctcctaggtttctgtttggaaggggtcgaacgtctactcatttacgagtttgtgcccaattcaagccttgatcagttcatattcgatccccttaagcgtgccaatctcaattgggataggcgtcaaaagataataatgggggtcgctcgagggctgctttacctacacgaagattctcgacttcgtatcatccatcgggacctcaaagccagcaacattttgttggactctgacatgaatcctaagatatccgatttcggtatggcaagactattcgagttggaccagactcaggcagagacaaatcggattgtggggacctacggatatatggcgccagagtatgtaatgcatggaaacttctctatcaaatccgatgtcttcagttttggtgtactggttttggagattgtgagtgggcaaaggaacaatattttccgggcaggcgatcatgtagagatccttataagctctgtttggaagaattggagggaaggaacaatatccaaaatcgttgatccctctataacctctagtttgagtaccgaaattgtgaggtgtgtccacattggtctactgtgcgtccaagaaaatgtggctaaccgactgacaatggcctcagtccttctcatgcttaacagccactcggtcacactccaagtgccgtcacaacctgcattctccatgcacagcgacatcgaatccgatgtgtcatctactcaggattacgattca

SEQ ID NO: 1046 - protein, 642 aa, Eucalyptus grandis
  Eucgr.E03585.1
MDPPNLPLLLLLTLASTITAQSFPTPFCGSTGNFSADSTYQITLTALLSSISTTNSLSLTYGFFKASSAVSGASQTLYVIGSCRGDLPAESCRACLNASASDVRDLCPLQKEAVLYSGNCTIRYSNASIFGTVTTDPRYSLSNVNNVTSPDTYNAALQTLLGSLQGEAAGGGSLRKYATGNVSAGFDRIYAMVQCTPDLTEQDCSDCLVTVVATLGQCCAGKLGVNIMAPSCQFRYETTDRFFDPVSEPLPPPPAPLPQVGDVLPPPSGGKSNLNRTVIIVVATSVSAVFLVGVIVLLRVKRKKQPRQRVEGEAADEISTVESLQFDFDTIREATDNFSNSNRLGQGGFGAVYMGRFFNGQEIAVKRLSHNSSQGEVEFKNEVMLLAKLQHRNLVRLLGFCLEGVERLLIYEFVPNSSLDQFIFDPLKRANLNWDRRQKIIMGVARGLLYLHEDSRLRIIHRDLKASNILLDSDMNPKISDFGMARLFELDQTQAETNRIVGTYGYMAPEYVMHGNFSIKSDVFSFGVLVLEIVSGQRNNIFRAGDHVEILISSVWKNWREGTISKIVDPSITSSLSTEIVRCVHIGLLCVQENVANRLTMASVLLMLNSHSVTLQVPSQPAFSMHSDIESDVSSTQDYDSR

SEQ ID NO: 1047 - DNA, 2013 bp, Eucalyptus grandis
  Eucgr.E03586.1
atggatcctcggaatctccgtctcttgcttcttctcgtgtttgcttccaccatcgacgcccaagatctcttcccaaagccgtactgtggttcgaccggcaacttcagcgccgacagcacctaccaaaccaccctcaccgccctcctctcctccatctcctccaccaactccttgcccctcacctacggcttcttcaacgcctcctccgccgtctccagcgcctcccagaccctctatgtcatcggctcctgccgcggcgacctcaccgccgagagctgccgcacctgcctcaatggctcagcctccgacatccgcgatctatgccccctcgagaaggaggcggtcctctacagcgagaactgcaccgtccgttactccaacacctcgatcttccgcacactcgaaaccgaccctgactaccagctgttcaacgtcaacaacgtcacgagcccagacacgtacaacgctgcgctgcagacactgctggaccgtctgcggggcgaggcggcgggcggcggctcgctgaggaagtacgcgacgggcaacacatcggtgggtttcaacacgatctacgcgatgacacaatgcacgccggacttgaccgaccagcaatgcagcgactgcctggtgacagtcatcgggagacttgggcagtgctgtgccgggaagatgggagtgaggatcatggccccaagttgccagttccggtacgagaccaatgatcggttcttcgacctggttggcgagccacttccgtcggcgcccgcaccgctatcaccggcggcagacgcaccgcctccttcgccaggtggaaagagcagttcaacgaagactgtgatcattgcagttgcgacaagtgcttctgcggtccttgttatcggcgttgtcatactcctgataatgaaaaggaagcggaagcagcccagacaaagagttgaaggtgaagttgaggatgaaataagcacggcagagtcactgcaatttgattttggcactattagagcggcaactgataacttctctgattccaagaagcttggacaaggcggttttggtgctgtttacttgggtcggctctccaacggacaagaaattgcggtaaaacggctgtcgcagaattctggacaaggagaagtagaattcaagaatgaggtaatgttattagctaggctacaacataggaacttggttaggctccttggtttttgcctagaaggagttgagcggcttctcatttacgagtttgtgcccaattcaagccttgaccagttcatattcgatcccctgaagcgtgcaaatctcaactgggataggcgccacaaaataataatgggtgttgctcgagggatgctttacctacatgaggactctcgacttcgtatcattcatcgggacctcaaagccagcaacattttgttggactcggacatgaatcctaaaatatcagattttggtatggcgaggctgtttgagttggaccaaactcaagcagagacgaaccgagtcgtggggacatacggttatatggcaccagaatatgcaatgcatggaaacttctctgtcaagtccgatgtcttcagtttcggagtgctagttttggagattgtaagtggtcaaaggaacaatcttttccaagtgggcgataacacagaggtccttataagctatgtttggaagaattggagggaaggaacaatatcaaatatcattgatccctgtataacttctaatttgagtactgaaattgtgaggtgtgtccacattggtctactgtgcgtccaagaaaatgtggttaatcgaccgacaatggcctcaatccttctcatgcttaacagccactccgtcacactccaagtgccatcacaacctgcgttctttttgcacagcggcaacgagtccgatatgtcatcaacgcaagattacagttcgagagtgcctgaggtcgacaaatcaagaaacaaatcaaaccagtccttgaaaaaggaggcctccatgaccgagccatatccacgg

SEQ ID NO: 1048 - protein, 671 aa, Eucalyptus grandis
  Eucgr.E03586.1
MDPRNLRLLLLLVFASTIDAQDLFPKPYCGSTGNFSADSTYQTTLTALLSSISSTNSLPLTYGFFNASSAVSSASQTLYVIGSCRGDLTAESCRTCLNGSASDIRDLCPLEKEAVLYSENCTVRYSNTSIFRTLETDPDYQLFNVNNVTSPDTYNAALQTLLDRLRGEAAGGGSLRKYATGNTSVGFNTIYAMTQCTPDLTDQQCSDCLVTVIGRLGQCCAGKMGVRIMAPSCQFRYETNDRFFDLVGEPLPSAPAPLSPAADAPPPSPGGKSSSTKTVIIAVATSASAVLVIGVVILLIMKRKRKQPRQRVEGEVEDEISTAESLQFDFGTIRAATDNFSDSKKLGQGGFGAVYLGRLSNGQEIAVKRLSQNSGQGEVEFKNEVMLLARLQHRNLVRLLGFCLEGVERLLIYEFVPNSSLDQFIFDPLKRANLNWDRRHKIIMGVARGMLYLHEDSRLRIIHRDLKASNILLDSDMNPKISDFGMARLFELDQTQAETNRVVGTYGYMAPEYAMHGNFSVKSDVFSFGVLVLEIVSGQRNNLFQVGDNTEVLISYVWKNWREGTISNIIDPCITSNLSTEIVRCVHIGLLCVQENVVNRPTMASILLMLNSHSVTLQVPSQPAFFLHSGNESDMSSTQDYSSRVPEVDKSRNKSNQSLKKEASMTEPYPR

SEQ ID NO: 1049 - DNA, 1983 bp, Vitis vinifera
  GSVIVT01005158001
atggctatgagttattgggaactaactttcttcctctcatgccttctcatacagcttgttcctctcactgttgctcagtttttccctaaagaagaatgcatttcagatagaggtaactacaccgataacagtacataccaggcagacctcaatagcctcctgacctccttctcaaacaaccaagttgagtatgggttttacaattcctctgttggtgaggtgaacggaatcggactctgtagaggggatctcacgccggatacatgtcgtagttgtatcaatagctccagccaggacattcgacgattatgtcccaactacaaggaggcagttttatattacgatctttgcatgttacgatactcttaccgccccatatttggcacagcacagacttcgcctgattacgctctggtaaacacccaaaatttctcggacatcgaccactcgacacaggagcgggacaacttgttgcttgacctccaagaaaaagccgcctctggtggtcctcttcgaaagtatgcaacaaacgagacgtcggctagttcagaaaccatatatgcacttgcccaatgcacgcctgatttagaagatcgggaatgcagtaactgtctagccagccttattaatacgtatgccagtttttttaagtacaggcaaggagggagagctatggcaccaagctgtaactataggtacgagatctattcgttctatgaccctctccccgttgcacaggcaccatctcctactaattcttctcctcctccgccaaatgatgccactactggagacggaaaaagtaacagagcgcgaactgtaattatcattgttatcccgactgttgtttctgtgatacttatctcctgcatctgcatctgcatctttttgagagtgagaaagccaaaaggcaaaaatgaaactaacgaagaaattttgagcgtggaatccttgcaattcaaccttggtcctattagaaatgcaacagataacttttctgattctaataagcttggacaaggagggtttggagctgtttacaagggtacactttccaatggacaagatatagctgtgaaaaggttgtctagggattctagacaaggagacatggaattcaagaatgaagtcctattagtggccaagcttcaacacaggaatttggttagactcttaggtttttgctttgaaggaatagaaagacttctcatatatgagtttgtgcctaatacaagtctcgataattttttatttgatccaattaagcgttcacaattatcttgggaaagacgttacaaaattataattggcattactcgggggcttttgtatctccatgaagattctcaacttcgaattattcatcgtgatctcaaagccagcaatgttttgctagatgaaaaaatgaatcctaaaatttcagattttggcatggcaaggttattttcattggatcaaactcaaggtgatacaagtaggatcatgggaacctatggatatatggctccagagtatgcaatgcatgggaatttttcaatgaagtcagatgtctttagttttggtgtgttggttttggaaattgttagcggtcaaaagaacacttgtttccataatggggagaatgtggaggaccttctaagctttgcatggagaagctggagggataggtcagtttcaaatttgatagatccttcggtgagcactggctcaagaagtgaaattatgagatgcatacatattgggttgttatgtgttcaagaaaatgtagctgacagaccaacaatggcttcagttgttctcatgctgagtagctactctgtcactctcccattaccttcacaacctgctttctttatgcacagtagcatagacccagagccaccctttctgcaggactttgattctggggtaactaagtcttctgataatgcttcaccacagatgtcggtcaatgatgtttcaattactgagctccaccctcgt

SEQ ID NO: 1050 - protein, 661 aa, Vitis vinifera
  GSVIVT01005158001
MAMSYWELTFFLSCLLIQLVPLTVAQFFPKEECISDRGNYTDNSTYQADLNSLLTSFSNNQVEYGFYNSSVGEVNGIGLCRGDLTPDTCRSCINSSSQDIRRLCPNYKEAVLYYDLCMLRYSYRPIFGTAQTSPDYALVNTQNFSDIDHSTQERDNLLLDLQEKAASGGPLRKYATNETSASSETIYALAQCTPDLEDRECSNCLASLINTYASFFKYRQGGRAMAPSCNYRYEIYSFYDPLPVAQAPSPTNSSPPPPNDATTGDGKSNRARTVIIIVIPTVVSVILISCICICIFLRVRKPKGKNETNEEILSVESLQFNLGPIRNATDNFSDSNKLGQGGFGAVYKGTLSNGQDIAVKRLSRDSRQGDMEFKNEVLLVAKLQHRNLVRLLGFCFEGIERLLIYEFVPNTSLDNFLFDPIKRSQLSWERRYKIIIGITRGLLYLHEDSQLRIIHRDLKASNVLLDEKMNPKISDFGMARLFSLDQTQGDTSRIMGTYGYMAPEYAMHGNFSMKSDVFSFGVLVLEIVSGQKNTCFHNGENVEDLLSFAWRSWRDRSVSNLIDPSVSTGSRSEIMRCIHIGLLCVQENVADRPTMASVVLMLSSYSVTLPLPSQPAFFMHSSIDPEPPFLQDFDSGVTKSSDNASPQMSVNDVSITELHPR

SEQ ID NO: 1051 - DNA, 1983 bp, Vitis vinifera
  GSVIVT01005163001
atggctatgggttatttggaactaactttcttcctctcatgccttctcatacagcttgttccattcactgtagcccagtttttccctaaagaagaatgcatttcagacagaggtaactacaccaatgacagtacctatcaggcagacctcaatagcctcctgacctccttctcaaatacccaagttgagtatgggttttacaatgcctccgttggtgaggtgaacggaatcggactctgtagaggggatcgcacggtggatacatgtcatagttgtatcaataactccagccaggacattcgacgattatgtcccaactacaaggaggcagttttgtattacgatttttgcacgttacgatactctgaccgccccatatttggcacagaggagacttcgccttattaccctctgggaaacacccaaaatttctcggacatcgaacgcttcacacagcagcgggacgagttgattcatgacctccgaggaaaagccgcgtcgggtggtgctcttcgaaagtatgcaacaggggattcaacggttaatctagaaaccatatatgcacttgtccagtgcactcctgatttagacgagcaggaatgcgatgactgtatagccggccttagtagtcaagttgccgattttttaaagtatggacgaggagggaacgctaaggcaccaagctgtaactttaggttcgagacctatcggttctatgaccctctccctgatgcaccgccaccatctcctactaattcttctcgtcctctgccaaatgatgccactgctggagacggaaaaagtaacagaacgcgaactgtagttatcattgttatagcaactgttgtttctgtgatactcatctcctgcatctgcatctgcatctttttgagaatgagaaagccaaaagacaaagatgaaactgaggatgaaattttggaagtggaatccttgcaattcaaccttggttctattagaaatgcaacagataacttttctgattctaataagcttggacaaggaggatttggagctgtttataagggtacactttccaatggacaagatatagctgtgaaaaggttgtccaagggttctggacaaggagaactagaattcaaaaacgaggtcttgttagtagccaagcttcaacatagaaatttggctagactcctaggtttctgtttagagggaatagaaagacttctcatctatgagttcgtgcctaatgcaagtcttgatcactttctatttgatcctatcaagtgttcacaattatattgggaaacgcgttacaaaattatagtaggcattgctcgaggacttctatatctccatgaagattctcgacttcaaattattcatgatgatctcaaagctagtaacattttgctagatgaagaaatgaatcctaaaatttcagattttggtatggcaaggttgttttcactagatcaaactcaaggtgatacgaaaaggattgttggaacctatggatatatggctcctgagtatgcaatgcgtgggaacttctcagttaagtccgatgtctatagttttggtgtgttgattttggaaattgttagtagtcaaaagaatgctagttttggcaatgaggagaatatggaaggccttataagctttgcatggagaagttggagggaggggtcagcttcaaatttgatagatccttcaatgaactccggttcaagaagtggaattatgagatgcatacatattgggttgttatgcgttcaagaaaatgtagctgatagaccaaccatggcttcaattgttctcatgcttagtagttactctctcactctcccattaccttcacaacctggtttcttcatgcatagtagcacgaatccagatgcacccttgctacagggatccgattctggggtaatcaattcttctaataatgtttcagcacccgtgtctgtaaatgaggcttcgattactgatctccaccctcgt

SEQ ID NO: 1052 - protein, 661 aa, Vitis vinifera
  GSVIVT01005163001
MAMGYLELTFFLSCLLIQLVPFTVAQFFPKEECISDRGNYTNDSTYQADLNSLLTSFSNTQVEYGFYNASVGEVNGIGLCRGDRTVDTCHSCINNSSQDIRRLCPNYKEAVLYYDFCTLRYSDRPIFGTEETSPYYPLGNTQNFSDIERFTQQRDELIHDLRGKAASGGALRKYATGDSTVNLETIYALVQCTPDLDEQECDDCIAGLSSQVADFLKYGRGGNAKAPSCNFRFETYRFYDPLPDAPPPSPTNSSRPLPNDATAGDGKSNRTRTVVIIVIATVVSVILISCICICIFLRMRKPKDKDETEDEILEVESLQFNLGSIRNATDNFSDSNKLGQGGFGAVYKGTLSNGQDIAVKRLSKGSGQGELEFKNEVLLVAKLQHRNLARLLGFCLEGIERLLIYEFVPNASLDHFLFDPIKCSQLYWETRYKIIVGIARGLLYLHEDSRLQIIHDDLKASNILLDEEMNPKISDFGMARLFSLDQTQGDTKRIVGTYGYMAPEYAMRGNFSVKSDVYSFGVLILEIVSSQKNASFGNEENMEGLISFAWRSWREGSASNLIDPSMNSGSRSGIMRCIHIGLLCVQENVADRPTMASIVLMLSSYSLTLPLPSQPGFFMHSSTNPDAPLLQGSDSGVINSSNNVSAPVSVNEASITDLHPR

SEQ ID NO: 1053 - DNA, 1980 bp, Vitis vinifera
  GSVIVT01006872001
atgactatgagttatttggaactaactttcttcctctcatgccttctcatacagcttgttccattcactgtagcccagtatttccctaaagaagaatgcatttcagatagaggtgactacaccgataacagtacataccagacagacctcaatagcctcctgacctccttctcaaacacccaggttaagtatgggttttacaatttctctgttggtgaggtgaatggaatcgggctctgtagaggggatctcactccggatacatgtcgtagctgtatcaataactccagccaggacattcgacgattatgtcccaactacaaggaggcagttttgtattacgatcaatgcacgttgcgatactctaaccgctccatatttggcacagtagatacttcggatagttacgctctacaaaacacccaaaatgtctcagacatcgacctcttcacacagcagcgggacgacttgttgcttgacctccgagaaaaagctgcgtcaggtggtcttcttaaaaagtatgcaacaggcgaggcagtggctgatttcataaccatatatgcacttgttcagtgcactcctgatttagaagatcaggaatgcagtgactgtgtagccgaccttagtaaaagctattccgattttttaaagtataagcaaggagggagagttatggcaccaagctgtaactttaggttcgagacctatcggttctatgatactctccctgatgcaccgccgccatctcctgctaattcttctcctccaccaaatgatgccactgctggagacggaaaaagtaacagaacgcgaactgtagttatcattgttgcagcaactgttgtttctgtgatactcatctcctgcgtctgcatctgcatctttttgagaatgggaaagccaaaagacaaagatgaaactgaggatgaaattttggaagtggaatccttgcaattcaaccttggttctattagaaatgcaacagataacttttctgattctaataagcttggacaaggaggatttggagctgtttacaagggtacactttccaatggacaagatatagctgtgaaaaggttgtccaagggttctggacaaggagaactagaattcaaaaacgaggtcttgttagtagccaagcttcaacatagaaatttggctagactcctaggtttctgtttagagggaatagaaagacttctcatctatgagttcgtgcctaatgcaagtcttgatcactttctatttgatcctatcaagtgttcacaattatattgggaaaggcgttacaaaattatagtaggcattgctcgaggacttctatatctccatgaagattcccgacttcgaattattcatcgtgatctcaaagctagtaacattttgctagatgaagaaatgaatcctaaaatttcagattttggtatggcaaggttgttttcactagatcaaactcaaggtgatacgaaaaggattgttggaacctatggatatatggctcctgagtatgcaatacgtgggaacttctcagttaagtccgatgtctatagttttggtgtgttggttttggaaattgttagcggtcaaaagaacactagttttggtgatgaggagaatatggaaggccttataagctttgcatggagaagttggagggaggggtcagcttcaaatttgatagatccttcaatgaactccggttcaagaagtggaattatgagatgcatacatattgggttgttatgcgttcaagaaaatgtagctgatagaccaaccatggcttcaattgttctcatgcttagtagttactctctcactctcccattaccttcacaacctggtttcttcatgcacagtagcacgaacccagagacacccttgctacagggatccgattctggggtaatcaatgcttctaataatgtttcagcacgcgtgtccgtaaatgagacttcgattactgagctccgccctcgt

SEQ ID NO: 1054 - protein, 660 aa, Vitis vinifera
  GSVIVT01006872001
MTMSYLELTFFLSCLLIQLVPFTVAQYFPKEECISDRGDYTDNSTYQTDLNSLLTSFSNTQVKYGFYNFSVGEVNGIGLCRGDLTPDTCRSCINNSSQDIRRLCPNYKEAVLYYDQCTLRYSNRSIFGTVDTSDSYALQNTQNVSDIDLFTQQRDDLLLDLREKAASGGLLKKYATGEAVADFITIYALVQCTPDLEDQECSDCVADLSKSYSDFLKYKQGGRVMAPSCNFRFETYRFYDTLPDAPPPSPANSSPPPNDATAGDGKSNRTRTVVIIVAATVVSVILISCVCICIFLRMGKPKDKDETEDEILEVESLQFNLGSIRNATDNFSDSNKLGQGGFGAVYKGTLSNGQDIAVKRLSKGSGQGELEFKNEVLLVAKLQHRNLARLLGFCLEGIERLLIYEFVPNASLDHFLFDPIKCSQLYWERRYKIIVGIARGLLYLHEDSRLRIIHRDLKASNILLDEEMNPKISDFGMARLFSLDQTQGDTKRIVGTYGYMAPEYAIRGNFSVKSDVYSFGVLVLEIVSGQKNTSFGDEENMEGLISFAWRSWREGSASNLIDPSMNSGSRSGIMRCIHIGLLCVQENVADRPTMASIVLMLSSYSLTLPLPSQPGFFMHSSTNPETPLLQGSDSGVINASNNVSARVSVNETSITELRPR

SEQ ID NO: 1055 - DNA, 1998 bp, Solanum lycopersicum
  Solyc02g079990.2.1
atggcaaatcaacagaaattgcaaatttttcttatttttcatatttttcactgcctcatcatagctcagcctgatttactattctccgattgtggtctcaatggtaactacactcaaaatagtgcataccagagcaatcttaacacactcctttcctccctttcttcaaatatggatgaatatggtttctacaacacttccattggccgaaacaccgacatagtcagtgctattgtgctctgtagaggagatgtggagctgcaagaatgtcgcaattgtgtcaataacactgctcataagcttgtacggtcatgtccagaacagaaagaagcttttggtgggtatgatgactgtatgttacagtatacttctcgatcaatcattggtacctcgtcgaatgatcctctgctctacatgtgggattctggaaatgcctctaaacccgaagagtttaaccgggagctcaagaaattagtggatagattacgaggggaagctgcaaatggtgatcctcttcgcaaatatgccactggtagtgccacggatccaaatgatcagactatatatgcactcgtgcaatgtactcctgatttatctcctcaggattgctccgattgcttaacgaatgcttatggagctatggctacttgtccctgtaatggcaatagaggcagtagacaaataggacctaggtgcaacttccgttatcagagctatcgcttcttcaaacaggtggctgtccaatctcattctccaccaccaggtcggagcgcctttgcaggaaaggaggataaatctgctagaatagtcattatcattgttgtgtcaactgttgcaacgataatttttatgctttgtacttttgtcatcttgatgaagatgagaaagaggaagcttatgcacaaaattcagagtagacatgtggacgatattgatattactgcagaatccttgcagtatgatctctctacaattagagcagcaacagataacttctcaagttctaataagttgggagaaggtggatttggtcctgtgtacaagggtgtgctttcaaatggacaagaagtagcagtcaaaagattgtcagtagattcaggccaaggagatctagaattcaaaaacgaggtcttgttggttgcaaggcttcaacataggaatttggttagattgcaaggattttgtttcgatggaacagagagacttcttgtctatgaatttgttcctaatgcaagccttgaccaatttttatttgatccagataaacgtaagcaattgaattgggaaaagagatccaaaatcataggaggcgttgctaaggggatcctttatcttcatgaggattctaggcttcggatcattcatcgtgatctcaaagcgagtaatgttctactcgatgcagaaatgaatcctaaaatctcagactttggcatggcaaggttatttacgctggatgaaactcaaggcagcacaaccagaattgttgggacctatggatatatggcaccggagtatgcaatgcacgggcaattctcagtcaaatcggatgtttttagctttggagtgctagtccttgaaattataagtggccaaaagaatacttgtttcaaaaatggagaatcagtggaagacctactaagcaatgcttggatgaactggcgcgaagaaacaactacaaatttgatagaccccatgttgagggaaagctcaggaatggctcgtgacataatgagatgcattcacatagcattactgtgcgttcaagaaaatatttctgatagaccaaccatggctgcagtagttctcatgctcagtagcctatccttgaatcttcccctgccttcagggcctgcatactatacacacaacgatattacttcagggatctcacttactcaagaatacaattcaagatcatcaggacctagagaattagccaaaagtaaatctattagttcatcacataatgaggcatcgataactgagttatcccctggt

SEQ ID NO: 1056 - protein, 666 aa, Solanum lycopersicum
  Solyc02g079990.2.1
MANQQKLQIFLIFHIFHCLIIAQPDLLFSDCGLNGNYTQNSAYQSNLNTLLSSLSSNMDEYGFYNTSIGRNTDIVSAIVLCRGDVELQECRNCVNNTAHKLVRSCPEQKEAFGGYDDCMLQYTSRSIIGTSSNDPLLYMWDSGNASKPEEFNRELKKLVDRLRGEAANGDPLRKYATGSATDPNDQTIYALVQCTPDLSPQDCSDCLTNAYGAMATCPCNGNRGSRQIGPRCNFRYQSYRFFKQVAVQSHSPPPGRSAFAGKEDKSARIVIIIVVSTVATIIFMLCTFVILMKMRKRKLMHKIQSRHVDDIDITAESLQYDLSTIRAATDNFSSSNKLGEGGFGPVYKGVLSNGQEVAVKRLSVDSGQGDLEFKNEVLLVARLQHRNLVRLQGFCFDGTERLLVYEFVPNASLDQFLFDPDKRKQLNWEKRSKIIGGVAKGILYLHEDSRLRIIHRDLKASNVLLDAEMNPKISDFGMARLFTLDETQGSTTRIVGTYGYMAPEYAMHGQFSVKSDVFSFGVLVLEIISGQKNTCFKNGESVEDLLSNAWMNWREETTTNLIDPMLRESSGMARDIMRCIHIALLCVQENISDRPTMAAVVLMLSSLSLNLPLPSGPAYYTHNDITSGISLTQEYNSRSSGPRELAKSKSISSSHNEASITELSPG

SEQ ID NO: 1057 - DNA, 2028 bp, Solanum lycopersicum
  Solyc02g080070.2.1
atggtaattcaaaagtggttactctttctgtttctgcatttacatgttctcaatattgtagcccagctgcctcagttacgatttggttcatgtggtgagaatggtaactatactgagaatagtacctacaagaacaatctaaacacactcctcacatcccttccctcaaaaatagataactatggtttctacaatgcttccattggccaaaacaccgatagagccagcgttattgtgctgtgtagaggagatgtggagctagacgattgccgcgtttgtgtcgataatgttgttgaaaagattggacagttgtgtcctaaccaaaaagaagttttcggtggctatgatgaatgtatgttacagtattcaaatcaatccattatagaaactccatcattgtctgttcgatattttctttggaatgctgcgaatgcctcaaaccccgaggaatttaaccaggagctaagacaattattggaaaatttacgagaccgtgctgcacagggtggtcctcttcaaaaatatgctactggtaatacggcagcaggtcttcagcctatatatgcacttgtgcagtgtactcctgatttatctcgtcagaattgcttcaattgcttaactgatgcttatggaagcatgcctcaatgtccctgcctggggaagatcggtggaagaatcataggggttaggtgcaatttccgttatgaaatttcccgtttcttcaccgccgatgtgcccatggaagctccgccacctgctggaaatgataatagaacagttccaacagggacggaaaatattacacctccaacagggaaggatgataaaacatcacgaacaatcatcataatcgttgtgtcaactgttacaattgttattcttatgatttgtattgctgtcatcttgataaggaggcgaaagaggaagatggtgaaggaaattcagagtacatctgtggatgatactagtattgcagaatcttttcaatatgctttttcggcaattagagcagcaacagatgacttctcagatgctaataagctcggagaaggcggatttggtcctgtatacaagggtaagcttcaaaatggacaagaagtagcagtgaaaaggttatcagcagattcaggccaaggtgatctagaattcaaaaatgaggtcttgttggttgccaagcttcaacacaggaatttggttaggttgctgggattttgcctagaccgaacagagcggcttcttgtctatgagtttgttcccaatgcaagtcttgaccacttcttatttgattcagttaaacgtagacaattggattgggaaaggcgatccaaaatcataggagggattgctaaggggattctttatcttcatgaggattctaggcttcggatcattcaccgtgatctcaaagctagtaatgttctactagatgcagaaatgaatcctaaaatctcagattttggcatggcaaggctatttgaattagatgaaactcaaggcagcacaaacagaattgttgggacctatggatatatggcaccagagtatgcaatgcacgggcaattttccgtcaagtcagatgttttcagctttggagtactagtcttagaaattttaagtggccaaaaaaacacttgttttagaaatggagaatcggtggaagaccttctgagttttgcttggtcgagctggcgtaatggaacaactacaacttttatagatccaatgctgagggaaagcacaggactgattcgtgacataatgagaaacattcacatagctttattgtgtgttcaagaaagtgtggctgatagaccaaccatggcagctgttgttctcatgctcagtagtttctcgttgagtcttccaatgccttcagggccagcattctatatgtacagtaatgttaccgcagagacgtcgcttattcaagaatacaacacaagaatgacaaactctagtgaagtagccaaaagtaattctattggttcatcacgaaatgaggcgtccatatctgagttatatcctcgt

SEQ ID NO: 1058 - protein, 676 aa, Solanum lycopersicum
  Solyc02g080070.2.1
MVIQKWLLFLFLHLHVLNIVAQLPQLRFGSCGENGNYTENSTYKNNLNTLLTSLPSKIDNYGFYNASIGQNTDRASVIVLCRGDVELDDCRVCVDNVVEKIGQLCPNQKEVFGGYDECMLQYSNQSIIETPSLSVRYFLWNAANASNPEEFNQELRQLLENLRDRAAQGGPLQKYATGNTAAGLQPIYALVQCTPDLSRQNCFNCLTDAYGSMPQCPCLGKIGGRIIGVRCNFRYEISRFFTADVPMEAPPPAGNDNRTVPTGTENITPPTGKDDKTSRTIIIIVVSTVTIVILMICIAVILIRRRKRKMVKEIQSTSVDDTSIAESFQYAFSAIRAATDDFSDANKLGEGGFGPVYKGKLQNGQEVAVKRLSADSGQGDLEFKNEVLLVAKLQHRNLVRLLGFCLDRTERLLVYEFVPNASLDHFLFDSVKRRQLDWERRSKIIGGIAKGILYLHEDSRLRIIHRDLKASNVLLDAEMNPKISDFGMARLFELDETQGSTNRIVGTYGYMAPEYAMHGQFSVKSDVFSFGVLVLEILSGQKNTCFRNGESVEDLLSFAWSSWRNGTTTTFIDPMLRESTGLIRDIMRNIHIALLCVQESVADRPTMAAVVLMLSSFSLSLPMPSGPAFYMYSNVTAETSLIQEYNTRMTNSSEVAKSNSIGSSRNEASISELYPR

SEQ ID NO: 1059 - DNA, 2013 bp, Solanum lycopersicum
  Solyc02g080080.2.1
atggttattcaaaagtggttactctttctgtttctgcatttacatgttctcaatattgtagcccagctgcctcagttacaatttggttcatgtggtgagaatggtaactatactgagaatagtacctacaagaacaatctaaacacactcctcacttcccttccctcaaaaatagatggctatggtttctactatgattctattggtgaggtcagtggtattgtgctatgtagaggagatgtgaagctagacgattgccgcgtttgtgtctataacgctgctcaaaaacttgtacagctatgtcctacccaaaaagaagttcttggtggctatggtgaatgtttgttgctttactcgaataatcaatccattatagaaactccatcattctctgttcgatatttcttttggaatgctgcgaatgcctcaaaacccgaggaatttaaccaggaactgcataaattactggaaaatttacgaggccgtgctataaatggtggtccctttcgaaaatatgctagtggtaatgtgacaggtccagatgatcagactatatatgcacttgtgcagtgtactcctgatttaactcctcgtaattgcttcaattgcttaactgatatttataataacatgcctcaatgtccttgcctggggaagatcggtggaagaataattgggcctaggtgcaacttccgttatgaaatttcccgtttcttcgctgatgtgtcggtggaagctccgccacctacaggaaatgatgataaaacagctccaatggggaatggtaatgaaacggctccaacagggaatgataatacagctccaatagtgcaggataaaaaaaaagctcgactcgtcattattatcattgtgccaactgttatagttgttattcttactgtatgtatttctgtcatcttaatgaagaagcgaaagaggaagctggtggacataattctaggtacacttggggatgatactagcgatgtagaatcgttgcagtatgatttttctataattagagaagcaacagaaaacttctcaaatgctaataaattgggacagggaggatttggtcctgtgtataagggtaagcttcaaaatggacaagaagtagcagtgaaaagattgtcagcagattcaggccaaggtgatctagagttcaaaaacgaggtcttgttggttgccaggcttcaacacaggaatttggttagattactcggattttgccttgatggaacagagagacttcttgtctatgaatttgttcccaatgcaagccttgaccaatttttatttgatcaagttaaacgtagccaactggattgggaaaggcgatccaaaatcataggaggcatagctaggggaattgtttaccttcatgaggattctagacttcgcatcattcatcgtgatctcaaagctggtaatgttctacttgatgcagagatgaatcctaaaattgccgactttggcatggcaagactatttacattggatgaaactcaaggcaacacaaacagaattgttgggacttatgggtatatggctccagaatatgcaatgcaggggcaattttcagtgaaatcagatgtttatagctttggagtactagtcctggaaattataagcggtcaacgaaacatttgttccagaaaaggagattcagtggaagaccttctgagcgttgcttggttgaactggtgcgaagaaacagtttcaaatttgattgaccctattctgaggggaagctcaggccttgttggtgacatagtgagatacatccacattgctttattgtgcgttcaagaaaatgttgctgatagaccaaacatgggtgaagtacttctcatgctcagcagtcgctctttgagtcttccagttccacacaacccacagattttacactttggagatgtctatacaacaatttctgagtccagcaaaataacggaaagtaaatcaatatgttcttcaggaaatcaggatttgataactgagttgcatcctcga

SEQ ID NO: 1060 - protein, 671 aa, Solanum lycopersicum
  Solyc02g080080.2.1
MVIQKWLLFLFLHLHVLNIVAQLPQLQFGSCGENGNYTENSTYKNNLNTLLTSLPSKIDGYGFYYDSIGEVSGIVLCRGDVKLDDCRVCVYNAAQKLVQLCPTQKEVLGGYGECLLLYSNNQSIIETPSFSVRYFFWNAANASKPEEFNQELHKLLENLRGRAINGGPFRKYASGNVTGPDDQTIYALVQCTPDLTPRNCFNCLTDIYNNMPQCPCLGKIGGRIIGPRCNFRYEISRFFADVSVEAPPPTGNDDKTAPMGNGNETAPTGNDNTAPIVQDKKKARLVIIIIVPTVIVVILTVCISVILMKKRKRKLVDIILGTLGDDTSDVESLQYDFSIIREATENFSNANKLGQGGFGPVYKGKLQNGQEVAVKRLSADSGQGDLEFKNEVLLVARLQHRNLVRLLGFCLDGTERLLVYEFVPNASLDQFLFDQVKRSQLDWERRSKIIGGIARGIVYLHEDSRLRIIHRDLKAGNVLLDAEMNPKIADFGMARLFTLDETQGNTNRIVGTYGYMAPEYAMQGQFSVKSDVYSFGVLVLEIISGQRNICSRKGDSVEDLLSVAWLNWCEETVSNLIDPILRGSSGLVGDIVRYIHIALLCVQENVADRPNMGEVLLMLSSRSLSLPVPHNPQILHFGDVYTTISESSKITESKSICSSGNQDLITELHPR

SEQ ID NO: 1061 - DNA, 2568 bp, Solanum lycopersicum
  Solyc02g080010.2.1
atgggtttcttgaaatggctgatcgttctaatattccaattctacgtcaccgtagcacaacctaatttcacttttcaatcgccctgtgaaggtaatgtgacagagtaccctctaaatggtacataccacacaaaccttaacacacttctctcctctctttcacgtaacatagacagtgatggcttctataatgctaccgtaggccaagatcagaacagggttagtgccatcgcgcaatgtagagcagatgttgaactacaaacatgccgcagctgtataaataatgctactcgcttgattttagagaaatgtccttccaagaaatcagcctttggcatttatgatatgtgtctcataagatattcaaatgagtccttcataggcaccatgtccaccgacccccgatatacttattattacaacagggatttctcggaccccaaattgtttttcaaccagtatctgacacctgtattgacaagcttacgaactcgagcttcagcgggtggaaagcacaagtttgctgctaatgttttcgatgcccctgattttcaggaaatacatgcacttgtacagtgcacatccgatttatcagctcaaggctgctacgattgtttaagtgctgtctattcaagtttacctgactgtgaatgttatgcaaagagaggaaactatcatttgatgcccagctgcgttgttcggtatgaaccttactcattcttcaatgaatcattattgactgaagctccgccacccttattgtcacctccggagccagccttattgccaccaccaccagcaggaaaggatgacaaaaccgcacaaactgtcatcattattcttgtacccattgtcacaattgttattcttattggttgtatttctgttatcttgatgaggaggcgaaagaggaagttggtgaccagaagagagattgttgaaggtctatctatggaagatgatagtattgcagaatctttgcaatatgatttttcagcaattagtgcagcaacggataacttcttagatgctaataagttggggcaaggtggatttggtcctgtgtacaagggtaagcttccaaatggacaagaagtagcagtgaaaagattgtcaatagattcaagccaaggagatctagaattcaaaaacgaggtcttattggtggccaggcttgaacacaggaatttggttaggttactcggattttgctttgatggaacagagagacttctcgtctatgaatttgttcccaatgcaagccttgaccactttttatttgatccagttaaacgcagggaactggattgggaaaggagatccaaaatcattggaggcgttgctcgggggatcctttatcttcatgaggattctaggcttcggatcattcatcgtgatctcaaagctagtaatgttctactagatgcagaaatgaatcctaaaatcgctgactttggcatggcaaggttatttgcaatggatgaatctcaaggaatcacaaacaatattgctgggacgtatggatatatggctccagagtatgcaatgcaggggaaaatgtcagtcaaatcagatgtttttagctttggagtcttagtcctggaaattttaggtggccaaagaaacacttgtttcagaaatggagaatatgtgggcaacctcctaagctacgcttggaggaattggcgcgaaggaacaacatcaaatctagtagatcccatgttgaggggaagctcgggactggtttctgacataacgagatgcatccacatagccttattgtgcgttcaggaaaatgttgctgatagaccaactatggctgcagtagttctcatgctcagtagtctctctctggctcttccagtgccttcaaagcccggatattatatgcaaattgatgttagcccaaatatttcacctattcaaggatacaaatcaagagtaatatcagaatctaatcgaccagacaaaaataaatcaatttgcttatcaaaaaatgagatgtccataaaacacaaccataccaccaaaccccctttgcgattttttctctcttccgaccaaaaccccggccagaacctcggctggaacaaccccaaatcgccaccaaatttcgaaccagtgaataacaacaacaatgaccatgaatttcagcatggttttgcaactcaacaaccagcggaaatgacctttcagaccacccaaaaccaccaaaagcacatcacatcgcatcaccgcagaccgccagatcaatggaaaaaccccaccctcgtttcctcttttatttgctgcaacgagtcacaccgacaaggggctcaaagttccgatgaatcgaagctaaacaatgaaccaaactcggtgcctctcctctcccctctcccctttcacgattctcctccattttgcacgtatttcatcaaaactatggtgggcgacatctccttcaccctccccatcttcctcaacaacaactacgccggaattcaaccaaatccacctgaaattcgctgcctctcccagcaacaactgagcagcgagctccatctccgatttctgctggagaaaagg

SEQ ID NO: 1062 - protein, 856 aa, Solanum lycopersicum
  Solyc02g080010.2.1
MGFLKWLIVLIFQFYVTVAQPNFTFQSPCEGNVTEYPLNGTYHTNLNTLLSSLSRNIDSDGFYNATVGQDQNRVSAIAQCRADVELQTCRSCINNATRLILEKCPSKKSAFGIYDMCLIRYSNESFIGTMSTDPRYTYYYNRDFSDPKLFFNQYLTPVLTSLRTRASAGGKHKFAANVFDAPDFQEIHALVQCTSDLSAQGCYDCLSAVYSSLPDCECYAKRGNYHLMPSCVVRYEPYSFFNESLLTEAPPPLLSPPEPALLPPPPAGKDDKTAQTVIIILVPIVTIVILIGCISVILMRRRKRKLVTRREIVEGLSMEDDSIAESLQYDFSAISAATDNFLDANKLGQGGFGPVYKGKLPNGQEVAVKRLSIDSSQGDLEFKNEVLLVARLEHRNLVRLLGFCFDGTERLLVYEFVPNASLDHFLFDPVKRRELDWERRSKIIGGVARGILYLHEDSRLRIIHRDLKASNVLLDAEMNPKIADFGMARLFAMDESQGITNNIAGTYGYMAPEYAMQGKMSVKSDVFSFGVLVLEILGGQRNTCFRNGEYVGNLLSYAWRNWREGTTSNLVDPMLRGSSGLVSDITRCIHIALLCVQENVADRPTMAAVVLMLSSLSLALPVPSKPGYYMQIDVSPNISPIQGYKSRVISESNRPDKNKSICLSKNEMSIKHNHTTKPPLRFFLSSDQNPGQNLGWNNPKSPPNFEPVNNNNNDHEFQHGFATQQPAEMTFQTTQNHQKHITSHHRRPPDQWKNPTLVSSFICCNESHRQGAQSSDESKLNNEPNSVPLLSPLPFHDSPPFCTYFIKTMVGDISFTLPIFLNNNYAGIQPNPPEIRCLSQQQLSSELHLRFLLEKR

SEQ ID NO: 1063 - DNA, 2241 bp, Glycine max
  Glyma01g01730.1
atgttacctgtcattcccagaggacaatttataatgtctactatttctggtatgcagcttttctttctttgttgcttgtatctaataatagtaatatgtgaagccagcttcggaccaagttatgaatactccaaatactgtaataacagtaatggaaactacacagccaatagcatctaccaaaccaacctcaataccctcttatccaccctcacttcccacacagaaatcgactatggtttctacaatttctcgcatggccaaaactcagacaaagtatacgcaatagggttatgcagaggagatgttaagccagacgaatgtcgcagctgcctcaacaattctagagttagtctcacacggttgtgtccaaagcagttagaggcaatcaattgggaagagaagtgcatgttgcgctactccaaccgcgcaatttttcacaccatggatgcttctttttcgtatcatatgaacaacgtaaacaatgcaacggatgcggaagagttcaataaagtgttgggtgagttacttagaaatctgagtgacaaagctgcatcaggtgaccctcgtcgcaagtatgccgcggatactgcagtctttgcgaatctccaaaccatatacggtcttgtgcagtgtacgcctgatttgtcaaggcaagactgcggtaaatgcttgcattggagtttggcagatttcggaaatgttttcaaaaacaaagttggtgctgtagtgcttagaccaagttgtaatgttagatatgaaatctaccccttctacgatgaacctacaccatcagcatcgtttcaccatataattcttgaatatttctcattcttcttggcctttcacttgaactcccttcggaagatgatgaggcctcattggttgaaggagttggtgaaagagctggagttgaatcatttggagtcaaggcttcttcatctatttcttcaaagtacggggaaaaatcataagtgtcttctttctactcccaattccatgtgccttcttcatagaactcgacatctcggctcacaattgtctttccattgtttggattgtacaatttttgtgcctaccgttctcgttgttgttgctttgctcattttcattagcatatattttaggaggaggaaattagcaaggaaaaatcttctcgctggtagaaatgaagacgatgatgaaattgaattggctgaatcattgcaattcaacttcgacacaataaaagttgcaacaaataacttctctgactctaataaactcggagaaggcgggtttggagctgtttaccagggcaggctctctaatggacaagtgattgctgtcaaaaggttgtcaagcgattctggccaaggtggcgtggaatttaagaatgaagtccttttactggccaagcttcagcaccgaaatttagttaggctacttggttttagtttggaagggaaagaaaagctacttgtttatgaatatgttccaaataaaagccttgattacttcatatttgatccaacaaagaaagcacgactggattgggatagacgatacaaaatcattcaaggtattgctcgaggtcttctttatcttcacgaggattcacgattgcgcattatacatcgtgatctcaaagcaagcaatgttctcttagatgaagagatgattcctaaaatatcagattttggtatggcaagactgattgttgcaggtcaaacacaagaaaatacaagtagagttgttggaacctatggatatatggcaccagaatatataatgcatggacaattttcaataaaatcagatgtcttcagttttggtgtactagttcttgagattgtaagtggccaaaaaaaccatggtattcgtcatgggaagaatgtggaagatctactaaactttgcatggagaagctggcaagaggggacagttacaaatattatagatccaatattaaacaatagttcacagaatgaaatgataagatgcacccacattggtttactctgtgttcaagaaaatctagccaacagaccaaccatggctaacgttgcactcatgctaaatagttgttctatcactctcccagtgcctacaaaacctgctttttttatggatagtgcaactacaagccttccaaacatgtcatgggaagttaattcagggacaacacgatcgaatcagtccacaaccaaatcagctcacgactcagtaagtgaggcttcaatttctgagctataccctcgt

SEQ ID NO: 1064 - protein, 747 aa, Glycine max
  Glyma01g01730.1
MLPVIPRGQFIMSTISGMQLFFLCCLYLIIVICEASFGPSYEYSKYCNNSNGNYTANSIYQTNLNTLLSTLTSHTEIDYGFYNFSHGQNSDKVYAIGLCRGDVKPDECRSCLNNSRVSLTRLCPKQLEAINWEEKCMLRYSNRAIFHTMDASFSYHMNNVNNATDAEEFNKVLGELLRNLSDKAASGDPRRKYAADTAVFANLQTIYGLVQCTPDLSRQDCGKCLHWSLADFGNVFKNKVGAVVLRPSCNVRYEIYPFYDEPTPSASFHHIILEYFSFFLAFHLNSLRKMMRPHWLKELVKELELNHLESRLLHLFLQSTGKNHKCLLSTPNSMCLLHRTRHLGSQLSFHCLDCTIFVPTVLVVVALLIFISIYFRRRKLARKNLLAGRNEDDDEIELAESLQFNFDTIKVATNNFSDSNKLGEGGFGAVYQGRLSNGQVIAVKRLSSDSGQGGVEFKNEVLLLAKLQHRNLVRLLGFSLEGKEKLLVYEYVPNKSLDYFIFDPTKKARLDWDRRYKIIQGIARGLLYLHEDSRLRIIHRDLKASNVLLDEEMIPKISDFGMARLIVAGQTQENTSRVVGTYGYMAPEYIMHGQFSIKSDVFSFGVLVLEIVSGQKNHGIRHGKNVEDLLNFAWRSWQEGTVTNIIDPILNNSSQNEMIRCTHIGLLCVQENLANRPTMANVALMLNSCSITLPVPTKPAFFMDSATTSLPNMSWEVNSGTTRSNQSTTKSAHDSVSEASISELYPR

SEQ ID NO: 1065 - DNA, 2004 bp, Glycine max
  Glyma18g47250.1
atgtctactatttctggtatgccgcttttctttctttgttgcttcttcggaccaagttatgaatactccaaatactgtaataacagtaatggaaactacacagccaatagcatctaccaaaccaacctcaataccctcttatccaccctcacttcccacacagaaatcgactatggtttctacaatttctcgcatggccaaaactcagacaaagtatacgcaatagggttatgcagaggagatgttaagccagacgaatgtcgcagctgcctcaacaattctagagtgagtctcacacggttgtgtccaaagcagttcgaggcaatcaagtgggaagagaagtgcatgttgcgctactccaaccgcgcaatttttcacaccatggatgcttctttttcgtatcctatgagcaacataaacaatgcaacggatgcggaagagttcaataaagtgttgggtgagttacttagaaatctgagtgacaaagctgcatcaggtgactctcggcgcaagtatgccgcggatactgcagtctttgcgaatctccaaaccatatacggtcttgtgcagtgtacgcctgatttgtcaaggcaagactgcggtgactgcttgcattggagtttggcagatttcggaaatgttttcaaaaacaaagttggtgctgtagtgcttagaccaagttgtaatgttagatatgaaatctaccccttctacgatgaacctacaccatcagcatcgaagattctggtttttgcagaaaagggcaactcactgcgaactacaatcgccataattgtgcctaccgttctcgttgttgttgctttgctcattttcattagcatatattttaggaggaggaaattagcaaggaaaaatcttctcgctggtaggtctaagtattatttgattcatcaatactttctattttcaaccaagtcctattatgaaattgaattggctgaatcattgcaattcaacttggacacaataaaagttgcaacaaataacttctctgactctaataaactcggagaaggtgggtttggagctgtttaccagggcaggctctctaatggacaagtgattgctgtcaaaaggttgtcaagcgattctggccaaggtggcgtggaatttaagaatgaagtccttttactggccaagcttcagcaccgaaatttagttaggctacttggttttagtttggaagggaaagaaaagctacttgtttatgaatttgttccaaataaaagccttgattacttcatatttgatccaacaaagaaagcacgactggattgggatagacgatacaaaatcattcgaggtattgctcgaggtcttctttatcttcacgaggattcacgattgcgcattatacatcgtgatctcaaagcaagcaatgttctcttagatgaagagatgattcctaaaatatcagattttggtatggcaagactgattgttgcaggtcaaacacaagaaaatacaagtcgagttgttggaacctatggatatatggcaccagaatatataatgcatggacaattttcaataaaatcagatgtcttcagttttggtgtactagttcttgagattgtaagtggccaaaaaaaccatggtattcgtcatggggagaatgtggaagatctactaaactttgcatggagaagctggcaagaggggacagttacaaatattatagatccaatattaaacaatagttcacagaatgaaatgataagatgcacccacattggtttactctgtgttcaagaaaatctagccaacagaccaaccatggctaacgttgcactcatgctaaatagttgttctatcactctcccagtgcctacaaaacctgctttttttatggatagtgcaactacaagccttccaaacatgtcatgggaagttaattcagggacaacacgatcgaatcagtccacaaccaaatcagctcacgactcattaagtgaggcttcaatttctgagctataccctcgt

SEQ ID NO: 1066 - protein, 668 aa, Glycine max
  Glyma18g47250.1
MSTISGMPLFFLCCFFGPSYEYSKYCNNSNGNYTANSIYQTNLNTLLSTLTSHTEIDYGFYNFSHGQNSDKVYAIGLCRGDVKPDECRSCLNNSRVSLTRLCPKQFEAIKWEEKCMLRYSNRAIFHTMDASFSYPMSNINNATDAEEFNKVLGELLRNLSDKAASGDSRRKYAADTAVFANLQTIYGLVQCTPDLSRQDCGDCLHWSLADFGNVFKNKVGAVVLRPSCNVRYEIYPFYDEPTPSASKILVFAEKGNSLRTTIAIIVPTVLVVVALLIFISIYFRRRKLARKNLLAGRSKYYLIHQYFLFSTKSYYEIELAESLQFNLDTIKVATNNFSDSNKLGEGGFGAVYQGRLSNGQVIAVKRLSSDSGQGGVEFKNEVLLLAKLQHRNLVRLLGFSLEGKEKLLVYEFVPNKSLDYFIFDPTKKARLDWDRRYKIIRGIARGLLYLHEDSRLRIIHRDLKASNVLLDEEMIPKISDFGMARLIVAGQTQENTSRVVGTYGYMAPEYIMHGQFSIKSDVFSFGVLVLEIVSGQKNHGIRHGENVEDLLNFAWRSWQEGTVTNIIDPILNNSSQNEMIRCTHIGLLCVQENLANRPTMANVALMLNSCSITLPVPTKPAFFMDSATTSLPNMSWEVNSGTTRSNQSTTKSAHDSLSEASISELYPR

SEQ ID NO: 1067 - DNA, 2025 bp, Glycine max
  Glyma20g27460.1
atggcagacctttcttgcattcatcttttctttctttgttgtctatttctaaaatttatacctcaaggcaacgccagcatgtttcacactgcattctgtgataacaaggaagggaactacacagcgaatagcacctacaacaccaacctcaacacccttttatcaagtctctcttcccacacagaaattaactatggtttctacaacttctcatatggtcaaaacccagacaaagtaaacgcaattgggctatgcagaggagatgttgagccacatgagtgccgcagttgcctcaatgattccagagtcacaattaaacagttttgtccaaaccagaaaaaggcacttctgtggttgaacactagcaaatgcatgttgcgctactcaccccgctcgatatttggcatcatggaaattgaacctagccaatccttgatgaacataaacaatgtaacggaaccggataagttcagtcaagctctggcgaacttaatgagaaacctcaaaggtgtagccgcatcgggtgactctcgtcgtaagtatgccacggataatgtaactgcttcaagttttcagaccatatatggtatggcagagtgcacccctgacttgtctgagaaagactgcaatgactgcttggatggggctatctcaaaaatcccaacctgttgtcaggacaagataggtggtagagttcttagaccaagttgtaatattagatttgaaagcgcaagcttctacgaaaatacgcctattttaaacccagatgtaccaccaccatctccagcagtagcaattcctccctccatcaatagcacttccccaaaagaaagcagcaacacaatacgaattgtcattgccatagttgttcctactgttgttgttgttcccctcatttgtctctgcatatattcaaggaggtcgaaggcaagaaaaagttctttagttaaacaacatgaagatgatgatgaaattgaaattgctcagtcattgcaattcaactttgacacaataagagttgctacagaagacttctctgattctaataaacttggacagggtggatttggagcagtttacaggggcaggctctccgatggacagatgattgcagtcaaaagattgtcaagagaatccagccaaggagatacggaatttaagaatgaagtgcttttagtggccaagcttcagcaccgaaatttagttaggctacttggtttctgcttggaaggaaaagaaaggctactcatctatgaatatgttcccaataaaagccttgattatttcatatttgatccaaccaagaaagcacaattgaattgggaaatgcgatacaaaatcattacaggtgttgcgcgaggccttctctaccttcatgaagattctcatctgcgcattatacatcgtgatctgaaagcaagtaacatactcttaaacgaagagatgaatccaaagatagcagattttggcatggcaagactggttttaatggatcaaactcaagcaaatacaaatagaattgttggaacctatggatatatggcacctgagtatgcaatgcatggacaattttcaatgaaatcagatgtctttagttttggtgtactggttcttgagatcataagcggccataaaaacagtggcattcgtcatggggagaatgtagaggatctactgagcttcgcatggagaaactggagggaggggacagctgtgaaaattgtagatccgtcattaaacaacaattcacgaaatgaaatgttgagatgtatccatatcggtttgctttgtgttcaagaaaatttagctgacagaccaaccatgacgaccattatgctcatgcttaatagctactctctcagtcttccaattccttctaaacctgcattttatgtgagcagtagaactggaagcatttcagccacgcagtcatgggggtatagttcaggggaatcaagatcaagagaattaacaattaaatcagctcaagaagcagaaaatgagtttactgatccataccctcgc

SEQ ID NO: 1068 - protein, 675 aa, Glycine max
  Glyma20g27460.1
MADLSCIHLFFLCCLFLKFIPQGNASMFHTAFCDNKEGNYTANSTYNTNLNTLLSSLSSHTEINYGFYNFSYGQNPDKVNAIGLCRGDVEPHECRSCLNDSRVTIKQFCPNQKKALLWLNTSKCMLRYSPRSIFGIMEIEPSQSLMNINNVTEPDKFSQALANLMRNLKGVAASGDSRRKYATDNVTASSFQTIYGMAECTPDLSEKDCNDCLDGAISKIPTCCQDKIGGRVLRPSCNIRFESASFYENTPILNPDVPPPSPAVAIPPSINSTSPKESSNTIRIVIAIVVPTVVVVPLICLCIYSRRSKARKSSLVKQHEDDDEIEIAQSLQFNFDTIRVATEDFSDSNKLGQGGFGAVYRGRLSDGQMIAVKRLSRESSQGDTEFKNEVLLVAKLQHRNLVRLLGFCLEGKERLLIYEYVPNKSLDYFIFDPTKKAQLNWEMRYKIITGVARGLLYLHEDSHLRIIHRDLKASNILLNEEMNPKIADFGMARLVLMDQTQANTNRIVGTYGYMAPEYAMHGQFSMKSDVFSFGVLVLEIISGHKNSGIRHGENVEDLLSFAWRNWREGTAVKIVDPSLNNNSRNEMLRCIHIGLLCVQENLADRPTMTTIMLMLNSYSLSLPIPSKPAFYVSSRTGSISATQSWGYSSGESRSRELTIKSAQEAENEFTDPYPR

SEQ ID NO: 1069 - DNA, 1950 bp, Glycine max
  Glyma20g27510.1
atgatcgtacctatagcttccaatattctgattatcgagaggaagatcaggatggctggtgtttcttccatgcttcttttctttctatttgtaatattaatatctcaagtcagtgcccagttaagcgtaacctgtgattacagcaaggtcggaaattacacagcaaatagcacctataacaccaatctgaacacccttttatccactctctcttccaacacagaaattaattatggtttctacaacttctcacatggtcaaagcccagatagagtcaacgccattgggctctgcaggggagatgtggagccagataagtgccgcagttgcctcaactatgccagaagcaatctcacacaagattgtccaaatcagaaagaggcaattatacattttgacaattgcatgttgcgctactccaaccgcacaatatttggccaagtggaaaattttcctggtctctatatgtggaacttaaagaatgcaacggacgtggatgagttcaatcaagtgctcgcaaacttaatgaggaacctcaaaggagtagctgcatcgggtgactctcgtcgtaagtatgctacggatgatcaaactagtggaaattttgaaaccatatatggtcttgtgcagtgcacccctgatttgtctgagacacaatgcaatgactgcttggatgggactatctcagaaatcccaacttgctgtaatgataaggtcggtggtagagttattagacccagttgtaatattagatacgaagtctaccgcttctacgaacagacgactgtattggacccagagataccaccatcatcgccagcaccacctccgttcgccgacacttccccagaaccagaagttaaagaaaatgatgttgaggatgaaattaaaattgccgagtcattgcaatttaacttcaacacaatacaagttgctacagaagacttctctgattctaataaacttggacaaggtggatttggagctgtttacaggatgattgcagttaaaaggttgtcaagagattctggtcaaggagatacagaatttaagaatgaggtgcttttagtggccaagcttcagcaccgaaatttagttaggctacttggtttctgcttggaaagaaatgaaaggctacttgtctatgaatttgttcctaataaaagccttgattatttcatatttgcgttaaaactgatggatgtatatgcagatccaaacatgaaagcacaattggattggaatagtcgctacaaaatcattagaggtatagctcgaggccttctatacctccacgaagattctcgactgcgtattatacatcgtgatctcaaagcaagcaacattctcttagacgaagagatgagtccgaaaatagcagattttggcatggcaagactggttttagtggatcaaactcaaacaaatacaagtagaattgtcggaacctatggatatatggcaccagaatatgcaatgcatggacaattttcagtgaaatcagatgtcttcagttttggtgtactagttcttgagattttaagcggccaaaaaaacagtggctttcatcatggggagaatgttgaggatctactaagtttcgcatggagaagttggaaggaggggacagctataaatattgtagatccatcattaaacaacaattcacgaaatgaaatgatgagatgtatccatattggtttactttgtgttcaagaaaatttagcggacagaccaaccatggctaccattatgctcatgctaaatagctattctctaagtctcccaattcccgccaaacctgcattttatatgaacagtagaactggaagtcttccagacatgcagtcatgggagtacaactcaagggaaacaggatcaagtgaatcgataattaaatcagctcaagaatcagaaaatgaggcttcaataactgagctatacgctcgg

SEQ ID NO: 1070 - protein, 650 aa, Glycine max
  Glyma20g27510.1
MIVPIASNILIIERKIRMAGVSSMLLFFLFVILISQVSAQLSVTCDYSKVGNYTANSTYNTNLNTLLSTLSSNTEINYGFYNFSHGQSPDRVNAIGLCRGDVEPDKCRSCLNYARSNLTQDCPNQKEAIIHFDNCMLRYSNRTIFGQVENFPGLYMWNLKNATDVDEFNQVLANLMRNLKGVAASGDSRRKYATDDQTSGNFETIYGLVQCTPDLSETQCNDCLDGTISEIPTCCNDKVGGRVIRPSCNIRYEVYRFYEQTTVLDPEIPPSSPAPPPFADTSPEPEVKENDVEDEIKIAESLQFNFNTIQVATEDFSDSNKLGQGGFGAVYRMIAVKRLSRDSGQGDTEFKNEVLLVAKLQHRNLVRLLGFCLERNERLLVYEFVPNKSLDYFIFALKLMDVYADPNMKAQLDWNSRYKIIRGIARGLLYLHEDSRLRIIHRDLKASNILLDEEMSPKIADFGMARLVLVDQTQTNTSRIVGTYGYMAPEYAMHGQFSVKSDVFSFGVLVLEILSGQKNSGFHHGENVEDLLSFAWRSWKEGTAINIVDPSLNNNSRNEMMRCIHIGLLCVQENLADRPTMATIMLMLNSYSLSLPIPAKPAFYMNSRTGSLPDMQSWEYNSRETGSSESIIKSAQESENEASITELYAR

SEQ ID NO: 1071 - DNA, 1758 bp, Glycine max
  Glyma20g27560.1
atggtcggaaattacacagcaaatagcacctataacaccaatctgaacacccttttatccactctctcttccaacacagaaattaattacggtttctacaacttctcacacggtcaaagcccagacagagtcaacgccattgggctctgcaggggagatgtggagccagatgagtgccgcagttgcctcaactatgccagaagcaatctcacgcaggattgtccaaaccagaaagaggcaattatacattttgacaattgcatgttgcgctactccaaccgcacaatatttggccaagtggaaacttttcctggttattgtgtgcagaacttatccaatgtaacggacgaggatgagttcaagcaagcgattgtgaacttaatgaggaaactcaaagatgtagctgcatcgggtgattctcgtcgtaagtatgctacggataatgtaactactggaaattttgaaaccatatatggtcttgtgcagtgcacccctgatttgtctgagacacaatgcaattactgcttggacgagactatctcacaaatcccatattgttgtaatttaacgttctgtggtggagctgctagacccagttgtaatattagatttgaaaactaccgcttctacaaactgacgactgtattggacccagagataccaccatcatcgccagcaccacctcctttcgctgacacttccccagaaccagaagtacgagtaagtcaccgccaggaagttaaagaagatgaaattgaggatgaaattaaaattgccgagtcattgcaatttaacttcaacacaatacaagttgctaccgaagacttctctgattctaataaacttggacaaggtggatttggagctgtttacaggggtaggctctctaatgggcagatgattgcagttaaaaggttgtcaagagattctggccaaggagataccgaatttaaaaatgaggtgcttttagtggccaagcttcagcaccgaaatttagttaggctacttggtttctgcttggaaggaaatgaaaggcttcttgtctatgaatatgttcctaataaaagccttgattatttcatatttgatccaaacatgaaagcacaattggattgggaaagtcgttacaaaatcattcgaggtataactcgaggccttctataccttcatgaagactctcgactgcgtgttatacatcgtgatctcaaagcaagcaacattctcttagatgaagagatgcatccgaagatagcagattttggtatggcaagattgtttttggtggatcaaactcatgcaaatacaactagaattgtcggaacctgtggatatatggcaccagaatatgcaatgcatggacaattttcagtaaaatcagatgtcttcagttttggtgtactagttcttgagattttaagcggccaaaaaaacagtggcattcatcatggggagaatgttgaggatctactaagtttcgcatggagaagttggaaggagcagacagctataaatattgtagatccatcattaaacaacaattcacgaaatgaaatgatgagatgtatccatattggtttactttgtgttcaagaaaatttagcggacagaccaaccatggctaccattatgctcatgcttaatagctattctctaagtctcccaattcccaccaaacctgcattttataagaacagtagaaatagaagtcttccaggatcaagtgaatcgatgattaaatcagctcaagaatcagaaaat

SEQ ID NO: 1072 - protein, 587 aa, Glycine max
  Glyma20g27560.1
MVGNYTANSTYNTNLNTLLSTLSSNTEINYGFYNFSHGQSPDRVNAIGLCRGDVEPDECRSCLNYARSNLTQDCPNQKEAIIHFDNCMLRYSNRTIFGQVETFPGYCVQNLSNVTDEDEFKQAIVNLMRKLKDVAASGDSRRKYATDNVTTGNFETIYGLVQCTPDLSETQCNYCLDETISQIPYCCNLTFCGGAARPSCNIRFENYRFYKLTTVLDPEIPPSSPAPPPFADTSPEPEVRVSHRQEVKEDEIEDEIKIAESLQFNFNTIQVATEDFSDSNKLGQGGFGAVYRGRLSNGQMIAVKRLSRDSGQGDTEFKNEVLLVAKLQHRNLVRLLGFCLEGNERLLVYEYVPNKSLDYFIFDPNMKAQLDWESRYKIIRGITRGLLYLHEDSRLRVIHRDLKASNILLDEEMHPKIADFGMARLFLVDQTHANTTRIVGTCGYMAPEYAMHGQFSVKSDVFSFGVLVLEILSGQKNSGIHHGENVEDLLSFAWRSWKEQTAINIVDPSLNNNSRNEMMRCIHIGLLCVQENLADRPTMATIMLMLNSYSLSLPIPTKPAFYKNSRNRSLPGSSESMIKSAQESENE

SEQ ID NO: 1073 - DNA, 2073 bp, Glycine max
  Glyma20g27540.1
atggctggcgtttcttccatgcttcttttctttctatttgtaatattaatatctcaagccagtggtgcccttgtaggcgtaagatgtgattacagcaaggtcggaaattacacagcaaatagcatctataacaccaatctgaacacccttttatccactctctcttccaacacagaaattaattacggtttctacaacttctctcatggtcaaagcccagacagagtcaacgccattgggctctgcaggggagatgtggagccagatgagtgccgcagttgcctcaactatgccagaagcaatctcacacaagattgtccaaaccagaaagaagcaattatacaatatgacaattgcatgttgcgctactccaaccgcaaaatatttggcaatcaggaagttaaacctgattattgtctggtgaacttatccaatataagggacggggatgagtccaagcaagcgcttgcgaacttaatgaggaaactccaaggtgtagctgcatcgggtgactctcgtcgtaagtatgctacggatgatctaactactggaaattttgaaaccatatatggtcttgtgcagtgcacccctgatttgtctgagatacaatgcaatgactgcttggatggggctatctcactaatcccaacttgttgtaatttaacgttctgtggtgaaggtgttagacccagttgtaattcagcgtactgtggtggagttgttagacccagttgtaatattaaatttgaaaagtaccgcttctacaaccacacgactatgttggacccagagataccaccatcatggccagcaccacctcctttccccgacacttccccagaaccagaagaaagtggcaacacaatagtaactgtcatctccatagttgtgccaactgttgttgtcgttttgctcatttgtctctgcctatatttaaggaggaggaaggctaggaaaaatcttggtaggcaagtccaactatcaatttactgtgacctttttatttccaacttcttcctccatgttaaagaagatgaagttgaggatgaaattaaaattgccgagtcattgcaatttaacttcaacacaatacaagttgctacagaagacttctctgattctaataaacttggacaaggtggatttggagctgtttacaggggtaggctctctaatgggcagatgattgcagttaaaaggttgtcaagagattctggccaaggagataccgaatttaaaaatgaggtgcttttagtggccaagcttcagcaccgaaatttagttaggctacttggtttctgcttggaaggaaatgaaaggcttcttgtctatgaatatgttcctaataaaagccttgattatttcatatttgatccaaacatgaaagcacaattggattgggaaagtcgttacaaaatcattcgaggtataactcgaggccttctataccttcatgaagactctcgagtgcgtgttatacatcgtgatctcaaagcaagcaacattctcttagatgaagagatgaatccgaagatagcagattttggcatggcaagactgtttttggtggatcaaactcatgcaaatacaactagaattgtcggaacctgtggatatatggcaccagaatatgcaatgcatggacaattttcagtgaaatcagatgtcttcagttttggtgtactagttcttgagattttaagcggccaaaaaaacagtggcattcatcatggggagaatgttgaggatctactaagtttcgcatggagaagttggaaggagcagacagctataaatattgtagatccatcattaaacaacaattcacgaaatgaaatgatgagatgtatccatattggtttactttgtgttcaagaaaatttagcggacagaccaaccatggctaccattatgctcatgcttaatagctattctctaagtctcccaattcccaccaaacctgcattttataagaacagtagaaatagaagtcttccaggatcaagtgaatcgatgattaaatcagctcaagaatcagaaaatgaggcttcaataactgagctatacgctcgg

SEQ ID NO: 1074 - protein, 691 aa, Glycine max
  Glyma20g27540.1
MAGVSSMLLFFLFVILISQASGALVGVRCDYSKVGNYTANSIYNTNLNTLLSTLSSNTEINYGFYNFSHGQSPDRVNAIGLCRGDVEPDECRSCLNYARSNLTQDCPNQKEAIIQYDNCMLRYSNRKIFGNQEVKPDYCLVNLSNIRDGDESKQALANLMRKLQGVAASGDSRRKYATDDLTTGNFETIYGLVQCTPDLSEIQCNDCLDGAISLIPTCCNLTFCGEGVRPSCNSAYCGGVVRPSCNIKFEKYRFYNHTTMLDPEIPPSWPAPPPFPDTSPEPEESGNTIVTVISIVVPTVVVVLLICLCLYLRRRKARKNLGRQVQLSIYCDLFISNFFLHVKEDEVEDEIKIAESLQFNFNTIQVATEDFSDSNKLGQGGFGAVYRGRLSNGQMIAVKRLSRDSGQGDTEFKNEVLLVAKLQHRNLVRLLGFCLEGNERLLVYEYVPNKSLDYFIFDPNMKAQLDWESRYKIIRGITRGLLYLHEDSRVRVIHRDLKASNILLDEEMNPKIADFGMARLFLVDQTHANTTRIVGTCGYMAPEYAMHGQFSVKSDVFSFGVLVLEILSGQKNSGIHHGENVEDLLSFAWRSWKEQTAINIVDPSLNNNSRNEMMRCIHIGLLCVQENLADRPTMATIMLMLNSYSLSLPIPTKPAFYKNSRNRSLPGSSESMIKSAQESENEASITELYAR

SEQ ID NO: 1075 - DNA, 2040 bp, Glycine max
  Glyma20g27570.1
atgaagtggtttttgacacaatcacgttcaaggtcagattggcagataactgccgtcgctggctggagaagtagtccgcggtggccaccacagaaagaggcgattgcatggtttgacgcgtgcatgctacgctacacaatatatgaaaagaggaacccatcacgaaccatcattgtgatagtcgtactcctggcccttatgtacaattatttaggagtgagaagacgaagacgccacaaaactatccaaaaaattaattacggtttctacaacttctctcatggtcaaagcccagacagagtcaacgccattgggctctgcaggggagatgtggagccagatgagtgccgcagttgcctcaactatgccagaagcaatctcacacaagattgtccaaatcagaaagaggcaattatacaatatgacaattgcatgttgcgctactccaaccgcacaatatttggcaatctggaagttaaacctggttattgtgtgtggaacttatccaatgtaatggacggggatgagtccaagcaagcgcttgcgaacttaatgaggaaactcaaagatgtagctgcatcgggtgactctcgtcgtaagtatgctacggataatgtaactactggaaattttgaaaccatatatggtcttatgcagtgcacccctgatttgtctgagatacaatgcaatgactgcttggatggggctatctcacgaatcccacattgttgtaatataacgttctgtggtggaggtgttagacccagttgtaatatagcgtactgtggtggagttattagacccagttgtaatattagatttgaaaactaccgcttctacaaccacacgactatgttggacccagagataccaccatcatggccagcatcacctcctttcgcagacatttccccagaaccagaagaaagtggcaacacaatagttattgtcatctccatagttgtgccaactgttgttgtcgttttgctcatttgtctccgcctctatttaaggaggaggaaggctaggaaaaatcttggagttaaagaagatgaagttgaggatgaaattaaaattgccgagtcattgcaatttaacttcaacacaatacaagttgctacagaagacttctctgattctaataaacttggacaaggtggatttggagctgtttacaggggtaggctctctaatgggcagatgattgcagttaaaaggttgtcaagagattctggccaaggagataccgaatttaagaatgaggtgcttttagtggccaagcttcagcaccgaaatttagttaggctacatggtttctgcttggaaggaaatgaaaggctacttgtctatgaatttgttcctaataaaagccttgattatttcatatttgatccaaacatgaaagcacaattggattggaaaagtcgctacaaaatcattagaggtatagctcgaggccttctatacctccacgaagattctcgactgcgtattatacatcgtgatctcaaagcaagcaacattctcttagacgaagagatgagtccaaaaatagcagattttggcatggcaagactggttttagtggatcaaactcaagcaaatacaagtagaattgttggaacctatggatatatggcaccagaatatgcaatgcatggacaattttcagtgaaatcagatgtcttcagttttggtgtactagttcttgagattttaagcggccaaaataacagtggcattcatcatggggagaatgttgaggatctactaagtttcgcatggagaagttggaaggaggggacagctataaatattgtagatccatcattaaacaacaattcacgaaatgaaatgatgagatgtatccatattggtttactttgtgttcaagaaaatttagcggacagaccaaccatggctaccattatgctcatgcttgatagatattctctaagtctcccaattcccgccaaacctgcattttatatgaacagtagaactgaaagtcttccagacatgcagtcatgggaatacaac

SEQ ID NO: 1076 - protein, 680 aa, Glycine max
  Glyma20g27570.1
MKWFLTQSRSRSDWQITAVAGWRSSPRWPPQKEAIAWFDACMLRYTIYEKRNPSRTIIVIVVLLALMYNYLGVRRRRRHKTIQKINYGFYNFSHGQSPDRVNAIGLCRGDVEPDECRSCLNYARSNLTQDCPNQKEAIIQYDNCMLRYSNRTIFGNLEVKPGYCVWNLSNVMDGDESKQALANLMRKLKDVAASGDSRRKYATDNVTTGNFETIYGLMQCTPDLSEIQCNDCLDGAISRIPHCCNITFCGGGVRPSCNIAYCGGVIRPSCNIRFENYRFYNHTTMLDPEIPPSWPASPPFADISPEPEESGNTIVIVISIVVPTVVVVLLICLRLYLRRRKARKNLGVKEDEVEDEIKIAESLQFNFNTIQVATEDFSDSNKLGQGGFGAVYRGRLSNGQMIAVKRLSRDSGQGDTEFKNEVLLVAKLQHRNLVRLHGFCLEGNERLLVYEFVPNKSLDYFIFDPNMKAQLDWKSRYKIIRGIARGLLYLHEDSRLRIIHRDLKASNILLDEEMSPKIADFGMARLVLVDQTQANTSRIVGTYGYMAPEYAMHGQFSVKSDVFSFGVLVLEILSGQNNSGIHHGENVEDLLSFAWRSWKEGTAINIVDPSLNNNSRNEMMRCIHIGLLCVQENLADRPTMATIMLMLDRYSLSLPIPAKPAFYMNSRTESLPDMQSWEYN

SEQ ID NO: 1077 - DNA, 3468 bp, Glycine max
  Glyma10g39980.1
atggctgccatttcttgcaaacttttctttcattgttgtttatttctaaaattcatatatgaagccaacgctcagtcagccgaatgcgatgacagcatagggaactacacagccaatagcacttataacaccaacctaaacacccttttaaccactctctcttcccacacagaaattaactatggtttctacaacttttcatatggccaaaacactgacaaagtaaacgcaattgggctgtgtagaggagatgttgagccagatgagtgccgcagttgcctcaacgatgccagaggcaatctcacacagcgttgtccaaaccagaaaaaggcaattatatattatgacaattgcatgttacgctactccaacaccacaatttttggcgtcatggaaacttctcctgctcttttcctggggaacacagtcaatgcaacggacgtggaacagtttaatcaagtgctccaaaccttgatgagcaatctaacggacagagctgcatcaggtgactctcgtcgtaagtatgctacagacgatacaactgcggcaagttttcaaagaatatacggtttggtgcagtgcacacctgatttgtctgggctagactgcagtagctgcttggttggagctatagaaaatatccaagattgttgtagtggtaagagaggaggtagagttattagacccagttgtaatgtgagatttgaactcggacccttctacggacaaacgacaacaatagacccagtcccagaggtatcaccacctcctcctccgcccaccaataacacttcccaacaagttaaaggagaagaagatgcaattgaagatgatgatgaaattaaaattgctgagtcattacaattcaacttggacacaatacgagttgctacagaagacttctctgaatctaataaactaggacaaggtggatttggagctgtttattggatgattgcagtcaaaaggttgtcaagagattctgggcagggggatacggaatttaaaaatgaagtgcttttagtggccaagcttcagcaccgaaatttagttaggcttcttggtttctgcttggaaggaagagaaaggctactcgtctatgaatatgttcataataaaagccttgattatttcatattcgattcaaccatgaaagcacaactggattgggaaagacgctacaaaatcattagaggtattgctcgaggccttctctaccttcacgaagattctcgactgcgtattatccatcgtgatctcaaagcaagcaacattctcttagatgaagagatgaatcctaagatagcagattttggcatggcaagactggtattagtggatcaaactcaagcaaatacaagtagaattgtgggaacctatgatttgagagatgttccatttccttcctccacactccacagccgtggttttgaatggaaattcagactttatgttgcaggtgtgaggacaattacaatggctgctgtttctttaaggctcctttgctttcttttttttctctgtttcacaataacatcacaagccgcgcagacatgtgataacgacacagggaactacacagtaaacagcacgtatcacaacaacctcaacaccctcttatccagtttctcttcccacaaagaaatcaattacggtttctacaatttctctcatggccaagacccagacagagtatacgccattgggctctgcagaggagaccaaaagcctgatgattgcctcaaatgcctcaacaattccagagtctctctcgcaaaggagtgtccaaaccagaaacatgcgattgattggggtatagagtgcatgttgcgctactccaaccgctccatatttagcctcatggaaactcaacctatggtggaactcgtgtacacgttggatgtaaagggttcagtggaacaattcaacgaggcgctgcagagcttgatgaggaatctaacacgcacagctgcatcaggtgactctcgtctcaagtatgctacggctagcacacctgctccgagttttcaaaccatatttggttatacgcagtgcacccctgatttgtcatcggaagattgcaccaagtgcttggaagaagctatttcaaaaattccagagtgttgtagtggcaaggctggtggcaatgttttaaaacccagttgtagaattagatttgacccctacgtcttctatggaccaacattaaaattagactcagatgcaccatcagtgtccaccaacaaaacttcttcttcaccaggaaagagcaacaacacatcaagaactatcatcgccatagcagtgccagttgccagtgttgttttagcgctcagtcttttctgcatctatctaacagtgaggaagccaagaaaaaaaactgaaattaaaagagaagaagaagatagtcatgaagatgaaattacaatttctgagtcattgcaattcaactttgacaccattcgagttgctacaaatgaattcgacgattctaataaacttggacaaggcgggtttggagctgtttacagaggtcggctttccaatggacaagtaattgctgtcaaaaggttgtcaagggattctgggcaaggaaatatggaattcaagaatgaagtgcttttactggtcaagcttcaacaccgaaatttagttagactacttgggttctgcgtggaagggagagaaaggctgcttgtctatgaatttgttcctaataagagccttgattacttcatatttgatccagtgaagaaaacacgattggattggcaaatgcgctacaaaatcattagaggtattgctcgaggaattctctacctccatgaggattctcgactgcgaattatacatagagaccttaaagcaagcaacattctcttggatgaagagatgcatcctaagatatcagattttgggatggcaagattggttcacttggatcaaacacaagcaaatacaaatagagttgttggaacctatggatatatggcacctgagtatgcaatacatggtcaattttcagcaaaatcagatgtttttagtttcggtgtattggttcttgagattgtaagtggcaaaagaaacagtggtaatcgtcgtggggagaacgtggaggatctattgagctttgcatggcgaaactggagaaatggaacaactgcaaatattgtagatcccacattaaacgacggttctcaagatgaaatgatgagatgcatccacattgggttattatgtgttcaaaaaaatgtggctgccagaccaaccatggcttctgttgtactcatgcttaatagttattctctcactctctcagtgccttcagaacctgcatttgttgtggatagtagaactagaagccttccagacacactatcatcagagtataattcaagggaaacaagatcaaataaatcaactgaatattcggtagacgaggcttcaattacggagccatatcctcgc

SEQ ID NO: 1078 - protein, 1156 aa, Glycine max
  Glyma10g39980.1
MAAISCKLFFHCCLFLKFIYEANAQSAECDDSIGNYTANSTYNTNLNTLLTTLSSHTEINYGFYNFSYGQNTDKVNAIGLCRGDVEPDECRSCLNDARGNLTQRCPNQKKAIIYYDNCMLRYSNTTIFGVMETSPALFLGNTVNATDVEQFNQVLQTLMSNLTDRAASGDSRRKYATDDTTAASFQRIYGLVQCTPDLSGLDCSSCLVGAIENIQDCCSGKRGGRVIRPSCNVRFELGPFYGQTTTIDPVPEVSPPPPPPTNNTSQQVKGEEDAIEDDDEIKIAESLQFNLDTIRVATEDFSESNKLGQGGFGAVYWMIAVKRLSRDSGQGDTEFKNEVLLVAKLQHRNLVRLLGFCLEGRERLLVYEYVHNKSLDYFIFDSTMKAQLDWERRYKIIRGIARGLLYLHEDSRLRIIHRDLKASNILLDEEMNPKIADFGMARLVLVDQTQANTSRIVGTYDLRDVPFPSSTLHSRGFEWKFRLYVAGVRTITMAAVSLRLLCFLFFLCFTITSQAAQTCDNDTGNYTVNSTYHNNLNTLLSSFSSHKEINYGFYNFSHGQDPDRVYAIGLCRGDQKPDDCLKCLNNSRVSLAKECPNQKHAIDWGIECMLRYSNRSIFSLMETQPMVELVYTLDVKGSVEQFNEALQSLMRNLTRTAASGDSRLKYATASTPAPSFQTIFGYTQCTPDLSSEDCTKCLEEAISKIPECCSGKAGGNVLKPSCRIRFDPYVFYGPTLKLDSDAPSVSTNKTSSSPGKSNNTSRTIIAIAVPVASVVLALSLFCIYLTVRKPRKKTEIKREEEDSHEDEITISESLQFNFDTIRVATNEFDDSNKLGQGGFGAVYRGRLSNGQVIAVKRLSRDSGQGNMEFKNEVLLLVKLQHRNLVRLLGFCVEGRERLLVYEFVPNKSLDYFIFDPVKKTRLDWQMRYKIIRGIARGILYLHEDSRLRIIHRDLKASNILLDEEMHPKISDFGMARLVHLDQTQANTNRVVGTYGYMAPEYAIHGQFSAKSDVFSFGVLVLEIVSGKRNSGNRRGENVEDLLSFAWRNWRNGTTANIVDPTLNDGSQDEMMRCIHIGLLCVQKNVAARPTMASVVLMLNSYSLTLSVPSEPAFVVDSRTRSLPDTLSSEYNSRETRSNKSTEYSVDEASITEPYPR

SEQ ID NO: 1079 - DNA, 2007 bp, Glycine max
  Glyma20g27410.1
atggctggtgtttcttttgggctcctttcctttattttatgtctctttatcataattacatcacaagccaatgggcaaggcacaattgcttttgagctcagtgtccaggaatgtgataataccagaggcaactacacaataaacagcacctaccacaccaacctcaacaccctcttatccagtttctcttcccacgcagaaatcaactacggtttctacaatctctcatatggtcaaggcacagacaaagtatacgccattgggctctgtacaggtgatcaaaaccaggttgactgcatcggatgcctcaacgttgccataggcgatctcacacagctttgtccaaaccagaaagaggctattcactgcagaggagagtgcttgctacgctactctaaccgccccatatttggcaccgtgcaaaataaaccaattcgtatactccccttgacaaaaaacgtaacgggttcggtggatctgttcaacgcagtggtcgagagctggatgacgaatttaactcgcaaagctgcatcgggtgactctcgtcgtaaatatgctacgggctttacctttgctccgaatattcaaaccataaatggtcaaacgcagtgcacgcctgatttgtcatcggaagaatgcactaagtgcttgatggaatctatggtaaggatcacacaatgttgtagtggaaatgctggaggcaatgttttaaaacccagttgtagatttagatttgaccccctcacttactacggaccaacacagacattagacccagattcaccgccaccggcgatggccccgccaccatcaccgtctaccaacaaaacttcttcttcacaatcacaagcaagtgcaggaaagagcaagacagcacgaactatcactgccataacagtcccagttgctagtgttgttttagcgcttggtcttttctgcatttttctagcagtgagaaagccaacaaaaaaaagcgaaattaaaagagaagaagatagtcatgaagatgaaattaccattgatgagtcattgcaattcaattttgacaccattcgagttgctacaaatgaattcgatgattctaataaacttggagaaggcgggtttggagcggtttacagcggccggctttccaatggacaagtaattgctgtcaaaaggttgtcaagggattctaggcagggagatatggaattcaagaatgaagtgcttttaatggccaagcttcaacaccgaaatttagttaggctacttggtttctgtttggaaggaagagaaaggttgcttgtctatgaatatgttcctaataaaagccttgattgcttcatatttgatccaataaagaaaacacaattgaattggcaaaggcggtacaaaatcattgaaggtattgctcgaggcattctctacctccacgaggattctcgattacgaattatacatagagacctcaaagcaagtaacattctcttggacgaagagatgcatcctaagatatcagattttgggatcgcaagattggttcaggtggatcagacacaagcatatacaaataaaattgttggaacctatggatatatggcacctgagtatgcaatatatggtcagttttcagcaaaatcagatgtttttagttttggtgtattggttcttgagattgtaagtggccaaaaaaacactggtattcgtcgtggggagaacgtggaggatctattgaatttggcatggcgaaactggaagaatggaacagctacaaatattgtagacccctcattaaacgacggttctcaaaatgaaataatgagatgcattcacattgcattattatgtgttcaagaaaatgtggctaagagaccaaccatggcttctattgaactcatgtttaatggcaattctctcactctcccggtgccttcagaacctgcgtttggtgtggatagtaaatccacaaataaatcaattgaatattcagtagatgattcttcaattacagagccatatcctcgc

SEQ ID NO: 1080 - protein, 669 aa, Glycine max
  Glyma20g27410.1
MAGVSFGLLSFILCLFIIITSQANGQGTIAFELSVQECDNTRGNYTINSTYHTNLNTLLSSFSSHAEINYGFYNLSYGQGTDKVYAIGLCTGDQNQVDCIGCLNVAIGDLTQLCPNQKEAIHCRGECLLRYSNRPIFGTVQNKPIRILPLTKNVTGSVDLFNAVVESWMTNLTRKAASGDSRRKYATGFTFAPNIQTINGQTQCTPDLSSEECTKCLMESMVRITQCCSGNAGGNVLKPSCRFRFDPLTYYGPTQTLDPDSPPPAMAPPPSPSTNKTSSSQSQASAGKSKTARTITAITVPVASVVLALGLFCIFLAVRKPTKKSEIKREEDSHEDEITIDESLQFNFDTIRVATNEFDDSNKLGEGGFGAVYSGRLSNGQVIAVKRLSRDSRQGDMEFKNEVLLMAKLQHRNLVRLLGFCLEGRERLLVYEYVPNKSLDCFIFDPIKKTQLNWQRRYKIIEGIARGILYLHEDSRLRIIHRDLKASNILLDEEMHPKISDFGIARLVQVDQTQAYTNKIVGTYGYMAPEYAIYGQFSAKSDVFSFGVLVLEIVSGQKNTGIRRGENVEDLLNLAWRNWKNGTATNIVDPSLNDGSQNEIMRCIHIALLCVQENVAKRPTMASIELMFNGNSLTLPVPSEPAFGVDSKSTNKSIEYSVDDSSITEPYPR

SEQ ID NO: 1081 - DNA, 1959 bp, Glycine max
  Glyma20g27440.1
atggcctctgtttctttcagcctcctttgttgtctctttgtcataatcatatcacaagccagctcccagacaccctgtgataacagcaaaggcaactacacgatccatagcacgtatcacaacaacctcaacaccctcttatccagtttctcttcccacacagaaatcaagtatgggttctacaatttctcatatggccaaggcacagacaaagtatacgccattggtctctgcagaggcgatcttaagcccgatgagtgcctcagaatcctcaacgataccagagtctctctcacaaaggactgtccaaaccaaaaagaggctattatgtggactgttgagtgcatgttgcgctacactaaccgctccatattgggtgtcatggaaaaccaacctacgaatcataactactacgataagaatgtaacaggttcggtgaaccaattcaatgatgccctcgagagcttgatgaggaatctaacacgcacagctgcatcaggtgattctcgcagtaagtatgctacagctagtgcaaaagctccaaattttcaaaccatatacgctcaagcacagtgcacgcctgatatatcgtctgaagattgcaccaagtgtttggaggaagctatctcaataattccagagtgttgcagtggcaaggctggaggtaatgttgtaaaacccagttgtagaattagatttgacccttacatcttctacggacctacgctgaagttagacccagatgcaccaccaacgaccccactacaatcaccatccaccaacaacacttcttcccaaggaaaaagcaacacgtcacgaactatcatcgccatagtagtgccagttggtagtgttgttttggtgctcagtcttttctgcatctatctaagactctggaagccaaggaaaaaaattgaaattaaaagagaagaagataaggatgaagatgaaattacatttgctgagtcattgcaatttaactttgacaccattcgagttgctacaaacgaattcgatgattgtaataaacttggacaaggcggttttggagctgtttacaaaggtcagctttccaatggacaagtgattgctgtcaaaaggttgtcaagggattctgggcagggagatatggaattcgagaatgaagtgcttttagtggctaagcttcagcaccgaaatttagttaggctacttggtttctccctggaaggaagagaaaggctacttgtctatgaatttgttccaaataaaagccttgattacttcatatttgatccaataaagaaaatacaattgaattggcaaaaacgctacaaaatcattggaggtattgctcgaggaattctctaccttcatgaggattctcgattgcgaattatacatcgagacctcaaagcaagcaacattctcttagatgaacaaatgcatcctaagatatcagattttgggatggcaagattgattcgcgtggatcaaactcaaggaaatacaagtagaattgttggaacctatggatatatggcacctgagtatgcaatatatggccagttttcagcaaaatcagatgtttttagttttggtgtattggttcttgagattgtaagtggccaaaaaaactctggtattcgtcgtggggagaacgtggaggatctattgacctttgtatggcgaaattggagggaaggaacagctacaaatattgtagatcccacattaaatgatggttcgagaaatgaaataatgagatgcatccacattggattattatgtgttcaagaaaatgacgctggcagaccaaccatgacttctgttgtgctcatgctaaacagctactctctcagtctccctgtaccttcagaacctgcatttgttgtggatagtagaactagaagccttccatcatcagaactcacggagcataactcaagccaaacaagatcaagtgaatcaactcagaat

SEQ ID NO: 1082 - protein, 654 aa, Glycine max
  Glyma20g27440.1
MASVSFSLLCCLFVIIISQASSQTPCDNSKGNYTIHSTYHNNLNTLLSSFSSHTEIKYGFYNFSYGQGTDKVYAIGLCRGDLKPDECLRILNDTRVSLTKDCPNQKEAIMWTVECMLRYTNRSILGVMENQPTNHNYYDKNVTGSVNQFNDALESLMRNLTRTAASGDSRSKYATASAKAPNFQTIYAQAQCTPDISSEDCTKCLEEAISIIPECCSGKAGGNVVKPSCRIRFDPYIFYGPTLKLDPDAPPTTPLQSPSTNNTSSQGKSNTSRTIIAIVVPVGSVVLVLSLFCIYLRLWKPRKKIEIKREEDKDEDEITFAESLQFNFDTIRVATNEFDDCNKLGQGGFGAVYKGQLSNGQVIAVKRLSRDSGQGDMEFENEVLLVAKLQHRNLVRLLGFSLEGRERLLVYEFVPNKSLDYFIFDPIKKIQLNWQKRYKIIGGIARGILYLHEDSRLRIIHRDLKASNILLDEQMHPKISDFGMARLIRVDQTQGNTSRIVGTYGYMAPEYAIYGQFSAKSDVFSFGVLVLEIVSGQKNSGIRRGENVEDLLTFVWRNWREGTATNIVDPTLNDGSRNEIMRCIHIGLLCVQENDAGRPTMTSVVLMLNSYSLSLPVPSEPAFVVDSRTRSLPSSELTEHNSSQTRSSESTQNS

SEQ ID NO: 1083 - DNA, 1941 bp, Glycine max
  Glyma20g27550.1
ctcctttcctttctttgttgtctctccattataatcatatcacaggccagcgcccagacaaactgtgataacgacaaaggcaactacacaatcaatagcacctaccacagcaatctcaacactctcttatccaatttctcttcccacacagatatctactatggtttctacaatttctcgtatggccaagacccagacaaagtatacgccattgggctctgcagaggcgatcaaaacccggatcagtgcctcaaatgcctcaatgagtccagagtctctctggcagatgaatgtccaaaccagaaagaggcaattaattggagaggagagtgcatgctacgctactctaaccgctccatatttggccgaatggaaaatcaacctacgtctcgaatcgtttacctgaagaatgtaacgggctcagtggatgaattcaatgatgtgctggagagcttgatgaggaatttatcaagcacggcagcatcaggtgactctcgtcgtaagtatgctacaggcagcaaacctgctccagattttcaaaccacatacggttatacacagtgcacgcctgatttgtcatccgaagattgcactacgtgcttgggtgaagctatttcagatatcccaaattattttaatggcaaggctggtggcaacgttttaaaacccagttgtagaattagattcgacccctactcctactatggaccaacattgaaattagacccagatgcatcaccaactatgaccaacaacacttcttcttcacaagggaagggcaacacatcacgaattatcattgccatagtagttccagttgctagtgttgttttggtgctcattcttttttgcatctatctaagagcgaggaagtcaagaaaacaaaatgaaaaaaaaatatcattgcaattcgactttgacactatacgagttgctacaaatgaatttgctgattgtaataaaattggacaaggcgggtttggagctgtttacagaggtcagctttccaacggacaagagattgcagtaaaaaggttgtcaagggattctgggcaaggagatatggaatttaagaatgaagtgcttttagtggccaagcttcaacacagaaatttagttaggctacttgggttctgtctggaaggaacagaaagacttcttgtctatgaatttgttcctaataaaagccttgattacttcatatttgatccaataaagaaagcacaattggattggcaaaggcgttacaaaatcattggaggtattgctcgaggtcttctctacctccatgaagattctagactgcgtattatacatcgtgacctcaaagcaagcaacattctcttggatgaagagatgcatcctaagatatctgattttgggatggcaagattggttcacatggatcagactcaggaaaatacaagtagaattgttgggacctatggatatatggcacctgagtatgcaatatatggtcaattttcagcaaaatcagatgtttttagttttggtgtactggttcttgagataataagtggccataaaaacagtggtgttcgacgtggggagaatgtggaggatctattgtgctttgcatggcgaaactggagggatggaacaactaccaacattgtagatcccacattaactgacggtttgcgaaatgaaataatgagatgtatccacattgggttattatgtgttcaagaaaatgtggctgccagaccaaccatggcttctgttgcactcatgcttaatagctattctctaactctaccggtgccttcagaaccagcatttgttggggatggtagaactagaagccttccagacatgcagtcctcatcagagcataattcaaggcaaacaattgaatcagcaaatcaatcagctcaaaattcggtaaacgaggcttcaattactgagctatatcctcgc

SEQ ID NO: 1084 - protein, 647 aa, Glycine max
  Glyma20g27550.1
LLSFLCCLSIIIISQASAQTNCDNDKGNYTINSTYHSNLNTLLSNFSSHTDIYYGFYNFSYGQDPDKVYAIGLCRGDQNPDQCLKCLNESRVSLADECPNQKEAINWRGECMLRYSNRSIFGRMENQPTSRIVYLKNVTGSVDEFNDVLESLMRNLSSTAASGDSRRKYATGSKPAPDFQTTYGYTQCTPDLSSEDCTTCLGEAISDIPNYFNGKAGGNVLKPSCRIRFDPYSYYGPTLKLDPDASPTMTNNTSSSQGKGNTSRIIIAIVVPVASVVLVLILFCIYLRARKSRKQNEKKISLQFDFDTIRVATNEFADCNKIGQGGFGAVYRGQLSNGQEIAVKRLSRDSGQGDMEFKNEVLLVAKLQHRNLVRLLGFCLEGTERLLVYEFVPNKSLDYFIFDPIKKAQLDWQRRYKIIGGIARGLLYLHEDSRLRIIHRDLKASNILLDEEMHPKISDFGMARLVHMDQTQENTSRIVGTYGYMAPEYAIYGQFSAKSDVFSFGVLVLEIISGHKNSGVRRGENVEDLLCFAWRNWRDGTTTNIVDPTLTDGLRNEIMRCIHIGLLCVQENVAARPTMASVALMLNSYSLTLPVPSEPAFVGDGRTRSLPDMQSSSEHNSRQTIESANQSAQNSVNEASITELYPR

SEQ ID NO: 1085 - DNA, 1884 bp, Glycine max
  Glyma20g27590.1
atggctgcagtttcttttagactccttttctttctttgttgtctctcggtcataatcatatcacgagccagcgctcagacatactgtgataaccacaaaggcaactacacaataaacagcacctatcacaacaacctcaacaccctcttatccactttctcttcccacacagatatctactatggtttctacaatttctcgtatggccaagacccagacaaagtatacgccattgggctctgcagaggcgatcaaaaccaggatgattgcctcgcgtgcctcgacgatgccagagccaacttcacacagctttgtccaaaccagaaagaggcaattaattgggatggagagtgcatgttacgctactctaaccgctcaatatttggcatcatggaaaatgaaccttttgtggaaaccgtgttaacgatgaatgtaacgggtccagtggaccaattcaatgaagcgctgcagagcctgatgaggaatctaacaagcacagctgcatcaggtgactctcgtcgtaagtatggtacagctagtacacatgctccaaattttcaaaccatatacggttatgcacagtgcacgcctgatttgtccttggaagattgcactaattgcttgggtgaagctatcgcagaaatcccaaggtgttgtagtggcaaggctggaggcaatgttttgaaacccagttgtagaattagatttgacccctacaacttcttcggacctacgatccctctaccatcaccgtccccaaattcacaagggaaactgggtccccattcaggtgaggttaaaggagaagatagtcacgaagatgaaattacatttgctgagtcattgcaattcaattttgataccattcgagctgctacaaatgaattcgctgattctaataaacttggacaaggcgggtttggagctgtttacagaggtcagctttctaatggacaagagattgctgtcaaaaggttgtcaagggattctgggcaaggaaatatggaatttaagaatgaagtgcttttagtggccaagcttcagcaccgaaatttagttaagctacttggtttctgcctggaaggaagagaaaggctacttatctatgaatttgttcctaataaaagccttgattacttcatatttgatcccataaagaaagcacaactggattggcaaaggcgctacaatatcattggaggtattgctcgaggcattctttacctccatgaggattctcgacttcgtattatacatcgtgacctcaaagcaagcaacattctcttagatgaagaaatgaatcctaagatatcagattttggaatggcaagattggttcacatggatgagactcaaggaaatacaagtagaattgttggaacttatggatatatggcacccgagtatgtattatatggtcagttttcagcaaaatcagatgtttttagttttggtgtattggttcttgagattataagtggccaaaaaaacagcggcattcgtcatggggagaacgtggagcatctattgagctttgcatggcgaaactggagggatggaacaactacagatattatagatcccacattaaatgatggttcgcgaaatgaaataatgagatgcatccacattggattattatgtgctcaagaaaatgtgactgccaggccaaccatggcttctgttgtgctcatgcttaatagctattctctcactctcccgttaccttcagaaactgcatttgttttagatagtaacattagaagcttcccagacatgcttttatcagagcataattcaagggaaacaagatcaagtgaaacagcaattaaatcaactcaaaaatcgataaatgaggcatcaattactgagctataccctcgc

SEQ ID NO: 1086 - protein, 628 aa, Glycine max
  Glyma20g27590.1
MAAVSFRLLFFLCCLSVIIISRASAQTYCDNHKGNYTINSTYHNNLNTLLSTFSSHTDIYYGFYNFSYGQDPDKVYAIGLCRGDQNQDDCLACLDDARANFTQLCPNQKEAINWDGECMLRYSNRSIFGIMENEPFVETVLTMNVTGPVDQFNEALQSLMRNLTSTAASGDSRRKYGTASTHAPNFQTIYGYAQCTPDLSLEDCTNCLGEAIAEIPRCCSGKAGGNVLKPSCRIRFDPYNFFGPTIPLPSPSPNSQGKLGPHSGEVKGEDSHEDEITFAESLQFNFDTIRAATNEFADSNKLGQGGFGAVYRGQLSNGQEIAVKRLSRDSGQGNMEFKNEVLLVAKLQHRNLVKLLGFCLEGRERLLIYEFVPNKSLDYFIFDPIKKAQLDWQRRYNIIGGIARGILYLHEDSRLRIIHRDLKASNILLDEEMNPKISDFGMARLVHMDETQGNTSRIVGTYGYMAPEYVLYGQFSAKSDVFSFGVLVLEIISGQKNSGIRHGENVEHLLSFAWRNWRDGTTTDIIDPTLNDGSRNEIMRCIHIGLLCAQENVTARPTMASVVLMLNSYSLTLPLPSETAFVLDSNIRSFPDMLLSEHNSRETRSSETAIKSTQKSINEASITELYPR

SEQ ID NO: 1087 - DNA, 2313 bp, Glycine max
  Glyma10g39910.1
atggggatggcaccttcaagactgatttcccttctctttctccttcttacactcatatcttataccaccgctcagccaagcttcctgtaccatttctgcacgaatgataaaggcaactacactgcaaacagttcctaccagaccaacctcaatacccttttgtccactttgtcttcttccaacacacaaattgattctggcttctacaatttctccgagggccaaaactctgacaaagttaacgcaattgggatgtgtagaggtgatgttaagccagatgcatgtcgtagttgcttaaatgactcaagagtccttctcacacaacgttgtccaaaccagaaagaggccattgggtggtatgacgattgcatgctacgctactcgaatcgctcaatatttgagacaatggaacctaaccctacttactttctgtggacacaaagcaatgcaactgatatggatcagttcaatgaggctcttaggggcttagtggatggtctcagaagcaaagctgcatctggtgattcacttaagaagtatgctgcaggaagtgcagctggtccaagctttcaaactatatttgcacttctacaatgcacacctgatttatcagaacaacagtgcaataattgcttggttagagctataacagatatctcaagttgttgtgctggcaggacaagtggcagaattggaaaaccaagctgcaatcttaggtttgatacatcccctttctatgactctgcagctgatgcctctcctccgttgtcgccaccacaagcgccttctcctcctcctccttcagataccaatactgctccctctgaaggaaagagcaacacaacacaaattgttgttgcggtagttgtgccaactgttgtcatccttgtgctggtcatctccgtttgcattttcctaagagcaaggaagcaaaggaaaaatgttgacaatgacaatgaaattgacgatgaaattgaacctactgagacactgcaattcaactttgacatcataagaatggctacaaataacttttctgagacaaatatgctaggaagaggaggattcggacctgtttacaagggtaagctttccaggggacaagaagttgctgtcaaaagattgtctatgaattcaggacaaggagatgtagaatttaaaaatgaagtgcagttagtggccaagcttcaacaccgaaatttagtcagactacttggttttagtttggaaagaaaagaaaggttactggtctacgagtttgttcccaataaaagccttgattacttcatatttgatccaattaagcgtgcacatttagactgggaaaggcggtataaaatcataggcggcattgccaaaggccttctttatcttcatgaggattcgagactgaggattattcatcgtgatcttaaagcaagcaacattctcttggatgctgaaatgaatcctaagatatcggattttggtatggcaagattgtttcttgtggatcaaactcaaggaaacacaagtaaaattgttggaacttatggatatatggcacccgaatatataagtcaaggacaattctctgtgaagtcagacgttttcagttttggtgtactggttttagagatagtaagtggccagaaaaatagtggatttcaacatggagaccatgtagaggatctaataagctttgcctggaaaaactggagggagggaacagcatcaaatctcatagacccgacattgaatacaggttcaagaaacgaaatgatgagatgcatccacattggtttactgtgtgttcagggaaatttagctgacagaccaaccatggcttctgttgcactcatgcttaatagctactctcacacaatgcctgtgccttcagagcctgcgttttttatgcacagcagaggcttgtcagatattcagtcgagggagtataattcaggggcaacagaatcaaaaagcaaatctgtcaaagcatactcaaaggagatcgatgttaagccagatgaatgcagcaaatgtttgaatgattccaaagtccttctcacgcaccggtgtccaagccagaaggaggcaatcgtggggtatgacgattgcatgttacgctactccaacggatcaatattcaacactaaggaaactgttcctgaataccctctgagtaactttaataatgcaacagatgttgaagagttcaatcgagtgcttaggaacttgctagatagccttataggccaaatgattcagtaccaggctgacttgtcagaacaagattgcagtgcatgcttggttgatgctataaaaggaattcct

SEQ ID NO: 1088 - protein, 771 aa, Glycine max
  Glyma10g39910.1
MGMAPSRLISLLFLLLTLISYTTAQPSFLYHFCTNDKGNYTANSSYQTNLNTLLSTLSSSNTQIDSGFYNFSEGQNSDKVNAIGMCRGDVKPDACRSCLNDSRVLLTQRCPNQKEAIGWYDDCMLRYSNRSIFETMEPNPTYFLWTQSNATDMDQFNEALRGLVDGLRSKAASGDSLKKYAAGSAAGPSFQTIFALLQCTPDLSEQQCNNCLVRAITDISSCCAGRTSGRIGKPSCNLRFDTSPFYDSAADASPPLSPPQAPSPPPPSDTNTAPSEGKSNTTQIVVAVVVPTVVILVLVISVCIFLRARKQRKNVDNDNEIDDEIEPTETLQFNFDIIRMATNNFSETNMLGRGGFGPVYKGKLSRGQEVAVKRLSMNSGQGDVEFKNEVQLVAKLQHRNLVRLLGFSLERKERLLVYEFVPNKSLDYFIFDPIKRAHLDWERRYKIIGGIAKGLLYLHEDSRLRIIHRDLKASNILLDAEMNPKISDFGMARLFLVDQTQGNTSKIVGTYGYMAPEYISQGQFSVKSDVFSFGVLVLEIVSGQKNSGFQHGDHVEDLISFAWKNWREGTASNLIDPTLNTGSRNEMMRCIHIGLLCVQGNLADRPTMASVALMLNSYSHTMPVPSEPAFFMHSRGLSDIQSREYNSGATESKSKSVKAYSKEIDVKPDECSKCLNDSKVLLTHRCPSQKEAIVGYDDCMLRYSNGSIFNTKETVPEYPLSNFNNATDVEEFNRVLRNLLDSLIGQMIQYQADLSEQDCSACLVDAIKGIP

SEQ ID NO: 1089 - DNA, 2085 bp, Glycine max
  Glyma20g27480.1
atgtttagattagtaacattagtgcatggtccattaacgggagcttccatcaatctttctctttgttacatgccattcattcacaatttcaggatggctgctccggccatagtttctaaaactttgctcttatttcttattctccatgccattctcatgtctctggccacatcacagccaaacttcgtaaaacattactgttttgaccaaaatggtaactacactgctaatagtacgtttcaggccaacctcaataccttgttgtccaacctctcttccaacactgaaatcgactatggcttctacaatttctcaaatggccaaaacactgacaaagtcaacgttattgggatgtgtagaggagatcttaagccagaagcttgccgtagttgcctcaacaattcaagaatccttctcacacaactttgtccaaaccagaaggaggcaattgggtggtatgatcagtgcatgttgcgctactctacccgctcaatatttggaattatggaatctgatcctttgtataatatacggaacaaccaaaatgcaacaaatgtggatcagtataatgaagttgtcggggaccttctgagaagtctaggaaacagagctgctgccggtgattctcaacttaagtatgctcaagcaaacaaaacaggtccaagctttcaaactatatttgctcatgtgcaatgcacacctgatttgacagacttggaatgcaatcagtgcttgtttggaaaattaatatcatatatcccaaattgctgtgctggaaaagtacgtggcagaatttttacaccgagttgtaatcttagatttgataccaccccatactttgatcctattcctaccacggacgtccctcattcgtcgataccgcaagcatttccttctcctgctccatcagccatgctcatcaaaggcaagagcaactcatggaaaactgccatcgcaataattgtgccaattgtctccattctgatactcttcacctttatgtgcttctttttgagacgaaggaagccaacgaagtattttaaaagtgaatctgtagctgactatgaaattgaaccaactgagaccttacaattagacttccaaaccatcatagacgcaacaaataactttgcagatgtaaataagcttggagaaggtggatttggaccagtctacaagggcaggcttcccaatggcgaagaagttgctatcaaacggttgtccaaggattctggccaaggagatatagaatttaaaaatgaactgctattagtagcaaagctgcaacaccgaaatttagcaagggtattgggcttttgtttggaaacaggagaaaggatactggtgtacgagtttcttcccaatagaagccttgactactttatatttgatccaatcaaacgtttaaatttggattgggaaaggcgttacaagattatacaaggtattgctagaggtcttctttatcttcatgaagattctagattgcgcattattcatcgcgatctcaaagcaagcaacatactcttggacgatgaaatgaatcctaagatatcagattttggcatggcaagactgtttgatgcagatcaaactcttggaaatacacgtagagttgttggaacctatggatatatggcaccggaatatgcaatgcatgggcatttttctgtgaagtcagatgtttttagttttggcgtactagttcttgagatagtcactggacacaaaaatggtgatatccataagagcggttatgtagaacatctaataagctttgtatggacgaactggagggaagggactgccttaaatatagtagatcaaacactgcacaataattcaagagacgaaataatgagatgcatccatattggattactttgtgttgaagataacgtagccaatagaccaaccatggcaacagttgtaatcatgtttaacagtaactctctcgttcttcctataccctcacaacctgcatattctacgaatgtcaaaggtccatcaagatcaaatgaatcaagaaataacttcaagcaagcatcatcaaatgaagtctccattagtgatctagatccccgc

SEQ ID NO: 1090 - protein, 695 aa, Glycine max
  Glyma20g27480.1
MFRLVTLVHGPLTGASINLSLCYMPFIHNFRMAAPAIVSKTLLLFLILHAILMSLATSQPNFVKHYCFDQNGNYTANSTFQANLNTLLSNLSSNTEIDYGFYNFSNGQNTDKVNVIGMCRGDLKPEACRSCLNNSRILLTQLCPNQKEAIGWYDQCMLRYSTRSIFGIMESDPLYNIRNNQNATNVDQYNEVVGDLLRSLGNRAAAGDSQLKYAQANKTGPSFQTIFAHVQCTPDLTDLECNQCLFGKLISYIPNCCAGKVRGRIFTPSCNLRFDTTPYFDPIPTTDVPHSSIPQAFPSPAPSAMLIKGKSNSWKTAIAIIVPIVSILILFTFMCFFLRRRKPTKYFKSESVADYEIEPTETLQLDFQTIIDATNNFADVNKLGEGGFGPVYKGRLPNGEEVAIKRLSKDSGQGDIEFKNELLLVAKLQHRNLARVLGFCLETGERILVYEFLPNRSLDYFIFDPIKRLNLDWERRYKIIQGIARGLLYLHEDSRLRIIHRDLKASNILLDDEMNPKISDFGMARLFDADQTLGNTRRVVGTYGYMAPEYAMHGHFSVKSDVFSFGVLVLEIVTGHKNGDIHKSGYVEHLISFVWTNWREGTALNIVDQTLHNNSRDEIMRCIHIGLLCVEDNVANRPTMATVVIMFNSNSLVLPIPSQPAYSTNVKGPSRSNESRNNFKQASSNEVSISDLDPR

SEQ ID NO: 1091 - DNA, 2025 bp, Glycine max
  Glyma20g27620.1
atggccatggtttcaagaatgcctatattcctttgtatccttgtcatactcatatccatatctcaatctaacgcccaaccaggattcttataccacttctgtatcaatgacaagggtaattacagtgctaacagcacctaccagaataacctcaacacccttttgtccaacctctcttccaacacacagattgactatggcttctacaatttttcttatggccaagaaagtgacagagtaaacgcaattgggctctgcagaggagatgttaagccagatgcttgccgcatctgctttaatgattccaaagtgcttctcacgcaactgtgtccaaatcagaaggaggcaatagggtggtatgacaattgcatgttacgctactccaatcgctcaatatttaacaccatggaagccttacctagtttctccatgcggaaccatggtaacacaacagatgttgatcaattcaatcaagtgctgaggaccttgctatatagcctcgtaggccaaggttcatcaggggactcccggcataagtttgctgcagcaaatgtttcaggaccaggctttgaaactatatatggtcttgtgcagtgtacacctgacttgtcagaacaagaatgcacttcatgcttggttgatgctatctcagaaattccacgatgttgtgatagcaagaaaggtggtagagttgtaagacccagctgtaacttcagatatgagacataccccttttacactcctaccaatgttgcaataccacaagcaccagcaccaaaggtgtctgctcttcctccttcatcaacagatacattgtccccagaagggaagagcaacacatctctaattgtaatagcaatagtcgtgccaatcattgcctttgtcatactagtaattcttatactcatctatttaagaatgaggaggtcaagggaacacatcgaagttgaacttgaaaatgatgatgaaattagatcagcggagacattgcaattggacttctccacaatcgtggctgctaccaacaacttttctgatgcaaatgagctaggacaaggaggatttggacctgtttataagggtacgctctccaatggaaaggaagttgcagtcaaaaggttgtctaggaattctctccaaggtgacatagagtttaagaatgaagttctattagtagccaagcttcagcacagaaatttagttaagctactaggattttgtttggaaagaagtgaaaggctactggtgtatgaatttgtccccaataaaagccttgatttcttcatatttgatcaaaacagacgagcacaattggattgggaaaagcgatacaaaatcataggaggcattgctaggggccttgtataccttcatgaggattcacgattgaggattattcaccgtgatctcaaagcaagcaacattctcttggatgcagagatgcatcctaagatatcagattttggtatggcaagattatttgaagtggatcaaactcagggaaatacaagtagaattgttggaacctttggatatatggcaccagagtatgcaatgcatggacaattctcagtgaaatctgatgtttttagttttggtgtgctgattctcgagattgtaagtggccagaaaaatagttgggtatgtaaaggggagaatgcaggggatctactaacctttacatggcaaaactggaggggagggacagcctcaaacattgttgatcccacaattactgatggttcgagaaatgaaataatgagatgtatccacattgcgttgctttgtgttcaggaaaatgtggctgatagaccaaccatggcttctgttgtacttatgcttaacagctactctgttacgcttccattgccctcactgcctgctttcttcattgatagtagaagttttccagccattcaatcagaagagtataatccaatggcagcaggagcatcagatgaatcaaatgctcgatctgtccaagaatcaataaacgaggcttccattactgagccatttcctcgc

SEQ ID NO: 1092 - protein, 675 aa, Glycine max
  Glyma20g27620.1
MAMVSRMPIFLCILVILISISQSNAQPGFLYHFCINDKGNYSANSTYQNNLNTLLSNLSSNTQIDYGFYNFSYGQESDRVNAIGLCRGDVKPDACRICFNDSKVLLTQLCPNQKEAIGWYDNCMLRYSNRSIFNTMEALPSFSMRNHGNTTDVDQFNQVLRTLLYSLVGQGSSGDSRHKFAAANVSGPGFETIYGLVQCTPDLSEQECTSCLVDAISEIPRCCDSKKGGRVVRPSCNFRYETYPFYTPTNVAIPQAPAPKVSALPPSSTDTLSPEGKSNTSLIVIAIVVPIIAFVILVILILIYLRMRRSREHIEVELENDDEIRSAETLQLDFSTIVAATNNFSDANELGQGGFGPVYKGTLSNGKEVAVKRLSRNSLQGDIEFKNEVLLVAKLQHRNLVKLLGFCLERSERLLVYEFVPNKSLDFFIFDQNRRAQLDWEKRYKIIGGIARGLVYLHEDSRLRIIHRDLKASNILLDAEMHPKISDFGMARLFEVDQTQGNTSRIVGTFGYMAPEYAMHGQFSVKSDVFSFGVLILEIVSGQKNSWVCKGENAGDLLTFTWQNWRGGTASNIVDPTITDGSRNEIMRCIHIALLCVQENVADRPTMASVVLMLNSYSVTLPLPSLPAFFIDSRSFPAIQSEEYNPMAAGASDESNARSVQESINEASITEPFPR

SEQ ID NO: 1093 - DNA, 2106 bp, Glycine max
  Glyma20g27580.1
atgggcaacctagtccggaggaggagcactacaatgtccccggttccttccatgatgctgttttcattcatttctttccttgccattctcaaatctgaagcccaggatcagctaaatttcgtgtaccatgaatgtaacaaccacttcggaaacttcacccctgcaggtgtctacggcagcaacctgaataccctcttgtccaaagtgtattcccacgaagaaatcgacaacggctactacaatttctcgtatggccaaaaccctaacaaagcttacgccatcggtttctgcagaggagatgttaagccagataagtgccgtcgctgcctggataagtccgcggtccttctcagagagcggtgcccattacagaaagaggccattgcatggtttgacgcgtgcatgctacgctacacaaaccactcaatatttggcgtcatggtaactcaacctaacaacatcttgtgcaacacaaataacgtgtcgacgaaggtgctggaacagtttgatcaagctgtggacgacttgttgagcaagttgagtaacatgacggtggacggcggtggctcccgccgcaatagcgagttctttgcggaaggagatgctccagttcaatcaagcaacaccaccatatatgctctacttcagtgcacacctgatatttcgaaacaaaactgtactgaatgcttgcagagtgctttgtcagaaatttcgacattttgtgatggaaagatgggtggtcaatatctagggccaagctgttctgttagatatgagacctacctcttctttgagcccatagtcgatgcaccagctccagcaccacagcctgccactgatcaggttaccacgcccattggagaagaaaagaggaacccatcacgaaccatcattgcgatagtcgtgccaatggttgtcgttatcgtactcctggccattatgtacaattatttaggagcgagaagacgaagacgcaacaaacctatccaaaatgaaggtgaaggtgatgatgatgaaggggaacttgctaatgacattaaaacagatgatcagttgttgcaatttgactttgcaaccatcaaatttgcaacaaatgacttctctgacgcaaataagcttggccaaggtggatttggaattgtttataagggtacgctttctgatggacaagaaattgcaattaaaagattgtctatcaattctaaccaaggagaaacagaatttaagaatgaaattttgctaacagggaggcttcagcaccgaaacttagttagactacttggattttgttttgcaagaagagaaaggttattgatatatgagttcgttcccaataaaagccttgattatttcatatttgatccaaacaaacgtgtaaatttgaattgggagatacgctacaaaatcataagaggcattgctcgaggtcttctttatcttcatgaagattcacgattaaacgttgttcatcgtgatctgaaaacaagtaacattttgttagatggagaattgaatcctaaaatatcagattttggcatggcaagattatttgagatcaatcaaactgaagccagtacaactacaattgttgggacctttggatatatggctcctgaatacattaaacatggacagttttctatcaagtcagatgtctttagttttggcgttatgattctggaaatagtatgcggccaaagaaacagtcagattcgtgatagcgaagaaaacgcacaggatttattaagctttgcatggaacaattggaggggagggacagtttcaaatattgtagatcccacattaaaggattattcttgggatgaaataaggagatgtattcacattggattactgtgtgtacaggaagatatagctgatagaccaactatgaataccgttttattaatgcttcatagcagctctttcccacttgctgaaccttctgaacctgcgtttttaatgcgccgtaaaagttctttgcctatgattatgttgtctggcagtgagcaatattcagaggtaacaagatcaagtgattcaggaagtcaatatgctcaaggatcatcaatagttaagactccaaccactgagccatatcctcgt

SEQ ID NO: 1094 - protein, 702 aa, Glycine max
  Glyma20g27580.1
MGNLVRRRSTTMSPVPSMMLFSFISFLAILKSEAQDQLNFVYHECNNHFGNFTPAGVYGSNLNTLLSKVYSHEEIDNGYYNFSYGQNPNKAYAIGFCRGDVKPDKCRRCLDKSAVLLRERCPLQKEAIAWFDACMLRYTNHSIFGVMVTQPNNILCNTNNVSTKVLEQFDQAVDDLLSKLSNMTVDGGGSRRNSEFFAEGDAPVQSSNTTIYALLQCTPDISKQNCTECLQSALSEISTFCDGKMGGQYLGPSCSVRYETYLFFEPIVDAPAPAPQPATDQVTTPIGEEKRNPSRTIIAIVVPMVVVIVLLAIMYNYLGARRRRRNKPIQNEGEGDDDEGELANDIKTDDQLLQFDFATIKFATNDFSDANKLGQGGFGIVYKGTLSDGQEIAIKRLSINSNQGETEFKNEILLTGRLQHRNLVRLLGFCFARRERLLIYEFVPNKSLDYFIFDPNKRVNLNWEIRYKIIRGIARGLLYLHEDSRLNVVHRDLKTSNILLDGELNPKISDFGMARLFEINQTEASTTTIVGTFGYMAPEYIKHGQFSIKSDVFSFGVMILEIVCGQRNSQIRDSEENAQDLLSFAWNNWRGGTVSNIVDPTLKDYSWDEIRRCIHIGLLCVQEDIADRPTMNTVLLMLHSSSFPLAEPSEPAFLMRRKSSLPMIMLSGSEQYSEVTRSSDSGSQYAQGSSIVKTPTTEPYPR

SEQ ID NO: 1095 - DNA, 2964 bp, Glycine max
  Glyma20g27600.1
atggctgctatggccatagtttctaaaactttgctcttatttgttattctccttgtccttctcaatatgtctctagccacagcacagccaaacttcgtaaaatattactgtattgacaaaaatggcaactacactgctaacagcaccttccacgccaatctcaacacccttttgtccaacctctcttccaacactgaaattgactatggcttctacaatttctccaatggccaaaactctgacaaagtcaacgttattgggatgtgtagaggagatcttaagccagaatcttgccgaagttgcctcaagaattcaagaatccttctcacacagctttgcccaaaccagaaggaggcaattgggtggtatgatcagtgcatgttgcgctactctacccgctcaatatttggaattatggaatctgatccttggtatttgatatggaacaacagaaatgcaacaaatgaggatcagtataatgaagttgtcggggaccttctgaaaagtctaggaaacggagctgaagcaggtgattctcaccgtgaatctgaagctgaatatgaaattgaaccaactgagacattacaattggacttccaaaccattatagacgcaacaaataactttgcagatgcaaataaggttggacaaggtggatttggaccagtctacaaggtatggaggaactggaggaaagagactgccttaagtattgtagatcaaacactgagcaattattctagaaatgaaataatgagatgcattcatattggattactgtgtgttcaagaaaacttagtcaacagaccaaccatggcaaccgttgtaaacatgtttagcagtaactctctcactcttccagtaccctctcaacctgcatattctatgaatgctagagatccatcggatacaagattagatgaatcaagaaacaactgcatgcaagcatcatcaaatgaggcttccattaccaacaacgaccagctacaattcgtgtaccattattgcaacaacgagtacggaaacattaccaccgaaacctactcagacaaccggaataaccttttgtccaatatgtattatgacaaagaaaatgactacggcttctacaattcctcctatggacaagaccctgacaaagtttacgccatcggtttctgcagaggcgatgcaaatctagataagtgccgtagttgcctggaaaagtccgcagtccttctcagagagcggtgtccagtacagaaagaggggatcgggtggtttgacgagtgcatgttacgctacaccaaccactcaatatttggtgtcatggtaactcaacctaacaacatcatgtgcaacacaaaaaacgccccaaaggatcctagatcggctgctggttttgatcaagtggtccacaacctgttgaacgaactgagaaacaggacgacgacagtggcagacccagaaagtgattccagtcgaagtcgcaagttcttcgctgaaggagatgctccggttcaatcaagcaatgtgaccatacatgctctgattcagtgcacacctgatatttctagtcaaaactgtactcgatgcttggagcacgctatgacgaatattttatattgtgatggaaaaaggggtggtcgatatctaggaccaagctgttctgttagatatgagatctatcccttttttgagcccatagtccaccatgcaccaccaccacaacctgccactcaggttaccacgaccactgggaaagaaaagagcaacccatcacgaactatcattgctatagttgtgccagtcgttgccgttgtcgtactcctggtggcctttacctacaattatttaggagcgagaagacgaagacaaaaaccttttcaaagtgaaggaggcgaaggtgaacttgataatgacattaaaatagacgagttgttgcaatttgactttgcaaccatcaaatttgcaactaataacttctctgatgcaaataagcttggccaaggtggatttggaattgtttataagggtacgctctctgatggacaagaaatagcaattaaaagattgtctatcaattctaaccaaggagaaacagaatttaagaatgaaattctgctaacagggaagcttcaacaccgaaacttagttagactgcttggcttttgtttttcaagaagagaaaggttattgatatatgaattcgttcccaataaaagccttgattatttcatatttgatccaaacaatcgtgtgaatttgaattgggaaagacgctataatattataaggggtattgctcgaggtcttctttaccttcatgaagattctcgattacaagttgttcatcgtgatctcaaaacaagtaacattttgttagatgaagagttgaaccctaaaatatcagattttggcatggcaagattatttgagatcaatcaaactcaagccagtacaaatacaattgtcgggacctttggatatatggctcctgagtacattaaatatggacagttttcagtcaagtcagatgtctttagttttggcgtaatgattctggaaattgtatgcggacaaagaaacagtgagattcgtggtagcgaggaaaatgcacaagatctattaagctttgcatggaaaaattggaggggagggacagtttcaaatattgtagatgacacattaaaggattattcttggaatgaaataaggagatgcattcacattggattactgtgtgtacaggaagatatagctgatagaccaactatgaataccgttttactgatgcttaacagtgactctttcccacttgctaaaccttctgaacctgcatttttaatgcgtgataagagttctttgcctacggctatgctgtctggtgggcaacattcagaggtaacaaggtcaggttattcaggaagtcaatctgctcaagaatcatcaattatggctccaatcaccgagccatatcctcgt

SEQ ID NO: 1096 - protein, 988 aa, Glycine max
  Glyma20g27600.1
MAAMAIVSKTLLLFVILLVLLNMSLATAQPNFVKYYCIDKNGNYTANSTFHANLNTLLSNLSSNTEIDYGFYNFSNGQNSDKVNVIGMCRGDLKPESCRSCLKNSRILLTQLCPNQKEAIGWYDQCMLRYSTRSIFGIMESDPWYLIWNNRNATNEDQYNEVVGDLLKSLGNGAEAGDSHRESEAEYEIEPTETLQLDFQTIIDATNNFADANKVGQGGFGPVYKVWRNWRKETALSIVDQTLSNYSRNEIMRCIHIGLLCVQENLVNRPTMATVVNMFSSNSLTLPVPSQPAYSMNARDPSDTRLDESRNNCMQASSNEASITNNDQLQFVYHYCNNEYGNITTETYSDNRNNLLSNMYYDKENDYGFYNSSYGQDPDKVYAIGFCRGDANLDKCRSCLEKSAVLLRERCPVQKEGIGWFDECMLRYTNHSIFGVMVTQPNNIMCNTKNAPKDPRSAAGFDQVVHNLLNELRNRTTTVADPESDSSRSRKFFAEGDAPVQSSNVTIHALIQCTPDISSQNCTRCLEHAMTNILYCDGKRGGRYLGPSCSVRYEIYPFFEPIVHHAPPPQPATQVTTTTGKEKSNPSRTIIAIVVPVVAVVVLLVAFTYNYLGARRRRQKPFQSEGGEGELDNDIKIDELLQFDFATIKFATNNFSDANKLGQGGFGIVYKGTLSDGQEIAIKRLSINSNQGETEFKNEILLTGKLQHRNLVRLLGFCFSRRERLLIYEFVPNKSLDYFIFDPNNRVNLNWERRYNIIRGIARGLLYLHEDSRLQVVHRDLKTSNILLDEELNPKISDFGMARLFEINQTQASTNTIVGTFGYMAPEYIKYGQFSVKSDVFSFGVMILEIVCGQRNSEIRGSEENAQDLLSFAWKNWRGGTVSNIVDDTLKDYSWNEIRRCIHIGLLCVQEDIADRPTMNTVLLMLNSDSFPLAKPSEPAFLMRDKSSLPTAMLSGGQHSEVTRSGYSGSQSAQESSIMAPITEPYPR

SEQ ID NO: 1097 - DNA, 1992 bp, Citrus clementina
  clementine0.9_004373m
atggcctcttccagattgcgtatctatgtttttctctttgtaatacactattttgctctcacaattgcccagctagaacttcagtaccatgagtgttatatcaacaacggtaactacatcaccaacagtacttacgaggcaaatctcaatcgcctactcaattctctcacggaaaaccctcgcataaactatggattttacaatgtctcctatggccaaaatcctgataaagtttacgcgattgcactttgtagaccggacatggagcctagcagttgtagtgattgtataaatgtggcgagaaaaaatctgacgtctttatgtcccaacaaagtcacggccatcggaggatatgatgatagagggtacaataattgtatgctgcgttatgctaactacgacatatttggcttaatggaaaatgctccttattttttcgtttatgctgaaagtaacatcacggaaaatctaattgagttcaatcagacgcggcagaggttgttggaaaggctatttagtgaagctgcagcccgtccttctccaaataagtatgccaccggaaaagaagcagtttcggacattgtaacaatgtatgcacttgtgcagtgtacgcctgacctatccgaagctgattgcaaggaatgcctgcatgatactactaaactaatgtcaaaatgttgtgatagaagacaagggggaagagtcattaacccaagctgtagttttagatatgagactaacaaattcttcaagccttcgattgcaggaccaccgggctcccctgatccagtaacaccggaaccaccacccagaaaaaagaaccacactatacttataactgtcattgtctcggttgtcgcttctgtgatacttattacaggcatctgcatctttttgagagtgaggaaattaaagttggaagatgaaaatgtggaagaaaccattgcaaagtcattgcagtttgactttgaaaccataagagttgcaacagataacttctctgatgctaataagcttgggcaaggtggatttggtgctgtgtacaagggaatgcttttgaatggggaaacaatagctgtgaagagactgtctaagaattctaaacaaggagaaatagagtttaagaatgaggtcctattgctggccaggcttcagcacaggaatttagtgaggctcctaggcttttgtttggaacgcaaagaaaggattttagtctacgagtttgtgcctaatgccagccttgatcacttcatattcgatccaataaaccgtgaacatatgacctgggaaaagcgttacaaaataatcgaaggcattgctcgagggcttctttaccttcatgaagattctagacttcggattattcaccgtgatctcaaagctagcaacattctgttagactcagagatgaatcctaaaatttcagattttggcatggcaagattattcgaaatggatcaaacccatagtgatacaaacagagtcgtggggacctttgggtatatggctccagagtatgtgatgcatgggcgcttctcagtaaagtcagacatctttagctttggggttctggttttggaaattgtgagtggtcagaagagaagtagttttggcactgaagaggaaacagaggatcttctaacctatgcatggagaaactggaatgaaggggcagctttaaatctgatggatccaaccatgacgggtggctcaacaagtgaaatgatgaaatgcatccacattgggttgctatgcgttcaggagaatgtatcaaatagaccaggcatggctttagttgttaacatgcttaatggcgacactgttactataccagcaccatcaaaacctgcattttttatgaagtgttcggtcattccagagacgtcatcacctttagacgtcatcaccggatcaactgaatccggtggacagggaattggaaatgtcccattatcaaaaaatgaagcttcaatcaccgagctgtctcctaga

SEQ ID NO: 1098 - protein, 664 aa, Citrus clementina
  clementine0.9_004373m
MASSRLRIYVFLFVIHYFALTIAQLELQYHECYINNGNYITNSTYEANLNRLLNSLTENPRINYGFYNVSYGQNPDKVYAIALCRPDMEPSSCSDCINVARKNLTSLCPNKVTAIGGYDDRGYNNCMLRYANYDIFGLMENAPYFFVYAESNITENLIEFNQTRQRLLERLFSEAAARPSPNKYATGKEAVSDIVTMYALVQCTPDLSEADCKECLHDTTKLMSKCCDRRQGGRVINPSCSFRYETNKFFKPSIAGPPGSPDPVTPEPPPRKKNHTILITVIVSVVASVILITGICIFLRVRKLKLEDENVEETIAKSLQFDFETIRVATDNFSDANKLGQGGFGAVYKGMLLNGETIAVKRLSKNSKQGEIEFKNEVLLLARLQHRNLVRLLGFCLERKERILVYEFVPNASLDHFIFDPINREHMTWEKRYKIIEGIARGLLYLHEDSRLRIIHRDLKASNILLDSEMNPKISDFGMARLFEMDQTHSDTNRVVGTFGYMAPEYVMHGRFSVKSDIFSFGVLVLEIVSGQKRSSFGTEEETEDLLTYAWRNWNEGAALNLMDPTMTGGSTSEMMKCIHIGLLCVQENVSNRPGMALVVNMLNGDTVTIPAPSKPAFFMKCSVIPETSSPLDVITGSTESGGQGIGNVPLSKNEASITELSPR

SEQ ID NO: 1099 - DNA, 2043 bp, Populus trichocarpa
  POPTR_0017s09250.1
atggcttcttccagattgtttttttctctctgtcttctgttcgtggaagttctggctctagctaaggcacagcagccagtagaccagcctaagatgtcatatcacgactgtgtaggaaagggcaactacaccacgaacagtacttaccaggcaaatctcaatcaactcctcacctctatctacaccaacactgaaataaacaatggcttttacaacttttccaacggccaagacgcggacacagtctattcaattgcactttgtagaccggatatcagtcctgatgcctgccgcagttgcataagaaatgctagtgattccctggtaagactctgtccaaacttcgtggaggcaattggagggttagatgattgtatggtacgctacacaaaccgctccatatttaatcgcatggagaaaggaccttatttttgggtgtatgatgatcgagttaatgtctctgatgtagtcgggttcaatcagtcacggatgaccttgttagataggctgagagatgaagcagcagcaggggattctcgttacaagtatgcaatggatcaaatagctgccccagccccaaactttcaaacaatatatgcacttgtacagtgtactcctgatttatctgcttcggaatgcagggattgcctgtataatgcttcaggacttattccaaagtgttgtgatgcaagacaaggaggaagagttatttatccaagctgtaattttaggtatgaaatagaccgtttctatgacccttcgattaattcaatcccgccaccaccagattcaacttcgactaatacagttccatcaccaccagcttcaacttcacaaggaaagaagggcatgaagagaaatgtcctcatcatcatttccatggttccgatagctgtttctgtgattcttatagtttgcgtctgcatcttcttaagagctaggaggaagcagaagggggaagaggaagaggaagaggaagctaaagatttaaatgaaatggaagatgtagaattgctccaacttgattttggcactgtcagagaagcaacaggtaacttctctgaggataataaacttggacaaggaggatttggtgccgtgtacaagggcactctgacgagtggacaagatatagctgtaaagagattgtctaggacatcaggacaaggagagatagaattcaagaatgaggtcatgttagttgccaagcttcagcatcggaatttggttagactcctgggtttctgctatgagaaagaagaaaggattcttgtctatgagtttctccccaactcgagcctcaacaacttgatatttgatccagtcaagcgtgtacttctagattgggaaaccctctacgaaatcatagatggcattgcaagggggcttctttacctacatgaagactctcgactacggattattcatcgtgatctcaaagctgctaacattctgctagatgagaacatgaatccaaaaatctcagattttggaatggcaagaatgtttgctatggatcaagctcaagatagcacgagtagagtagttgggaccttcgggtatatggctccagaatatgttatccgtggacatttctcagttaaatcagatgtatatagctttggtgtcttagttttagaaattgttagtggtcgaaagattggtggcaggggcataggagacgaaggagaggaccttctaacctattcatggagaaaatggaatgatgggacacctttagacataatagatcctaccttgaatgatggtccaagaaatgaaattatgagatgcatcatcatcggattactctgtgttcaggaaaaagaagccctcagaccaactatggctcaagtttctatgatgcttagtagctactctgtcactctcgcagcaccctcaaaacctgcattttttatgcacagagaagactcgtttccgtcaccggtgaatgcttcaaggttaattgagtcggatgaatccagaactagatcttcccggtggtctaacaatgaggtttccatcactgagctggaccctcga

SEQ ID NO: 1100 - protein, 681 aa, Populus trichocarpa
  POPTR_0017s09250.1
MASSRLFFSLCLLFVEVLALAKAQQPVDQPKMSYHDCVGKGNYTTNSTYQANLNQLLTSIYTNTEINNGFYNFSNGQDADTVYSIALCRPDISPDACRSCIRNASDSLVRLCPNFVEAIGGLDDCMVRYTNRSIFNRMEKGPYFWVYDDRVNVSDVVGFNQSRMTLLDRLRDEAAAGDSRYKYAMDQIAAPAPNFQTIYALVQCTPDLSASECRDCLYNASGLIPKCCDARQGGRVIYPSCNFRYEIDRFYDPSINSIPPPPDSTSTNTVPSPPASTSQGKKGMKRNVLIIISMVPIAVSVILIVCVCIFLRARRKQKGEEEEEEEAKDLNEMEDVELLQLDFGTVREATGNFSEDNKLGQGGFGAVYKGTLTSGQDIAVKRLSRTSGQGEIEFKNEVMLVAKLQHRNLVRLLGFCYEKEERILVYEFLPNSSLNNLIFDPVKRVLLDWETLYEIIDGIARGLLYLHEDSRLRIIHRDLKAANILLDENMNPKISDFGMARMFAMDQAQDSTSRVVGTFGYMAPEYVIRGHFSVKSDVYSFGVLVLEIVSGRKIGGRGIGDEGEDLLTYSWRKWNDGTPLDIIDPTLNDGPRNEIMRCIIIGLLCVQEKEALRPTMAQVSMMLSSYSVTLAAPSKPAFFMHREDSFPSPVNASRLIESDESRTRSSRWSNNEVSITELDPR

SEQ ID NO: 1101 - DNA, 1953 bp, Populus trichocarpa
  POPTR_0004s02550.1
atggcttttttgcaaatgcttttccttctttgtcccattttcatgcattttattgttcccattactgctcagcctgaaatcaactttcaactttgtgtagcagagaacggtaactacacagaaaatagcacctaccaggctaatctcaagtacctactcaactctgtttacagtaacacagaaatcgattacgggttttacaatttctcttacggagaaagttctgacaaggtttatgcaattggactctgtcgaggagatgtcaagcctgatgcttgccgcgactgcctcaattattctagccgggtactaactgcacgctgtccaactgaaaaggaggctatcataggtttcgacagttgtatattacgatacgcaagccgttccatatttggcctcaatgaagttgccccatactttttcgtgtacagcttaacaaatgtctcagacgaaaaaggattcaacaggtctttgaatagcttgttggatagcctacaagatgaagctgcagctggtgattctcgtcgtaagtatgcaacgcgaaaaatcagtgcaccaaactttcagactatatatgcactttcgcagtgcactcctgatttgtcacagacagaatgcagttcctgcctccgaaatgcttccgcacgtgttggacaatgttgtcaggaaaggcaaggaggaagagtcatttatccaagctgtaattttaggtacgagattaaccaattctatgaaatcccaattggtgaagacccatctcctcctccatcgaaaggaaaaaacaatacagtcatcatcgtcatcattctttcagttgttatttctgtcatggtgattcttatcatcagcttctacacgttttcaggaaagaggaaatcaagagagaaagttaaaagtggatcagtggatgatgaaattaccagagtggaatccttgcaatataacttagaaatcattcaccttgcaacagaaaatttttctgaagttaataagcttggacagggtggatttggttctgtgtacaagggtacccttcccaacggacaatatatagccgtgaagagactatctagggattccacacaaggagagcaagaattcaagaatgaagtcctgctggtggccaaacttcagcacaagaatttggtcaggctcctaggctattgctttgaacaagaggaaaggcttcttatctacgagtttatgcctaactcaagcctcaacaacttcattttcgatcaaaccaagcgttcacaattggactgggaacgacgttacaagatcatagaaggcatttctcgaggacttctttaccttcatgaagattctcgtctccggatcattcaccgtgacctgaaacctagtaacattttgttagatgcagaaatgaatgctaagatatcagactttggcatggcaaggctgtttgcaggggatcaaacccaagaaagtacaagcagagttgttggaacctttggatacatgcctccagagtatgtaatgcgcggacacttctctgtcaaatcggatatctttagctttggtgtgcttgttttggaaattgtaagtggtagaaaaagaacttttatcaatgagggggaggtggaagaccttctgacatatacgtgggaaaattggaatagcggaccaaatttagataagctgatagatgcgacattaagggctggctcaagaaatgaaatgttgagatgtatccacgttggtttactatgtgtgcaggaaaatgcacttgatagaccaaacatggcttcagttgttatcatgctaagttcttactccgtcactcttccagtacctcagaagcctgcattttttgctcgcggtacggtactgcctgggacatcatcaacttggaccgagtctgatcaatcccggagtgcatctgtcccattttcaatcaatgaggcttcaatctctgagctctaccctcgg

SEQ ID NO: 1102 - protein, 651 aa, Populus trichocarpa
  POPTR_0004s02550.1
MAFLQMLFLLCPIFMHFIVPITAQPEINFQLCVAENGNYTENSTYQANLKYLLNSVYSNTEIDYGFYNFSYGESSDKVYAIGLCRGDVKPDACRDCLNYSSRVLTARCPTEKEAIIGFDSCILRYASRSIFGLNEVAPYFFVYSLTNVSDEKGFNRSLNSLLDSLQDEAAAGDSRRKYATRKISAPNFQTIYALSQCTPDLSQTECSSCLRNASARVGQCCQERQGGRVIYPSCNFRYEINQFYEIPIGEDPSPPPSKGKNNTVIIVIILSVVISVMVILIISFYTFSGKRKSREKVKSGSVDDEITRVESLQYNLEIIHLATENFSEVNKLGQGGFGSVYKGTLPNGQYIAVKRLSRDSTQGEQEFKNEVLLVAKLQHKNLVRLLGYCFEQEERLLIYEFMPNSSLNNFIFDQTKRSQLDWERRYKIIEGISRGLLYLHEDSRLRIIHRDLKPSNILLDAEMNAKISDFGMARLFAGDQTQESTSRVVGTFGYMPPEYVMRGHFSVKSDIFSFGVLVLEIVSGRKRTFINEGEVEDLLTYTWENWNSGPNLDKLIDATLRAGSRNEMLRCIHVGLLCVQENALDRPNMASVVIMLSSYSVTLPVPQKPAFFARGTVLPGTSSTWTESDQSRSASVPFSINEASISELYPR

SEQ ID NO: 1103 - DNA, 2070 bp, Vitis vinifera
  GSVIVT01006683001
atggagatgagaatggattttcccagactggttttcttcgcttataccattctcataccacaccttgttgctgtaacagtagcccagcctgacctggtctaccacaattgttcagaaaatgttggtacttacagcaataacagcacctaccagtcaaacctcaacacccttctctctacactgttctcatacaaagaaatcaactatggcttttacaatttctccttcggccaaagccccaacgaggttaacgcaattgccctctgcagaggagacatcacacaagataagtgccacagttgcctcaacgactccaggcttcagctcccgcagcgctgtccctaccagaatgaagcaataggagggtatgatgaatgcatgttacgatactccaatcggtccatattcaggactctggaaattttgcctagtttttatgtttcaaacccgaacaacgtctccaatgaagatgtgttcaatcaggcgctgaagaccttgttggacagcctccgaagcaaagctgcttcgggcaattcgctgctcaaatttgcgacaggagaagcgactggcactggtgataaaaggatatacgggtttatgcagtgcactcctgatctaaatgagtcgtcttgcagcatttgtttagaaggggctattaatgatgttccagcatgttgcggtaacaaggaaggaggacgaatttttaagcccagttgcagcctcaggtttgaaacattccgtttctatgattttacagcggctaacacgcctccacctgcaacatggccaccttcctcaccttctccttcggataaccttaccccaccctccccagccattcaatttcaaaattctgcagtcgatgaatgtggtgttaaattgactttttcaggaaagaagagtaacacatcccggaccctcatcctcatagtcgttcccacggttattatttcagtgttattgatcagcttcatctgcttctttttaaaaaagaggaggccaagggggcagtttctaagttttgagggtgaaactagaaccctggaatccttgcaatttcagttcagcaccattagagttgcaacagacaacttctctgatgctaataagcttggagaaggtggattcggctctgtttacaagggtaggctttccgatgggcaagaaatagctgttaagaggctgtctgctggttctaaacaaggagaactagaattcaaaaatgaggtgctgttaatggcgaagcttcaacatagaaatttggttaggctactgggtttttgcttggaaagatccgaaagacttctcatctatgagtttatgcctaacttaagcctccatggcttcatatttgatccaattaagcagacacaattgaattgggaaaagcgttacaaaatcataggaggcatcgctcgagggcttctttatcttcatgaagattctcgacttcgaattattcaccgtgatctcaaagcaagcaacattctattagatgcagagatgaaccctaaaatttctgattttgggatagctagattatttgcagttgatcaaactcaagagaatacaagtagaattatgggaacctatggatatatggccccagaatatgtattgcatgggaaattctcagttaagtcggacgtatatagcttgggtgtgttgattctggagattataagcggtcaaaagaataattgtttccatgttggcgagaacaccgagtatcttctgacccacgcctggatttcttggagggaaggaacagcaagcagtatgatagatccaacattacgggatggctcaacaagcgaaataatgagatgtatccacattgggttgctatgtgttcaagaaaatgtggctgatcgaccaacaatggcttcagtaatgctcatgctaaatagctactctctcagtctcccaataccttcacaccctgcatcttttttacgtagtaacattgaccaaaacatttcttcggggctggagcataattcaaggtcgactgattctgatctttcccgaagtagtagtccgattaattctcaatacatacgacttgaa

SEQ ID NO: 1104 - protein, 690 aa, Vitis vinifera
  GSVIVT01006683001
MEMRMDFPRLVFFAYTILIPHLVAVTVAQPDLVYHNCSENVGTYSNNSTYQSNLNTLLSTLFSYKEINYGFYNFSFGQSPNEVNAIALCRGDITQDKCHSCLNDSRLQLPQRCPYQNEAIGGYDECMLRYSNRSIFRTLEILPSFYVSNPNNVSNEDVFNQALKTLLDSLRSKAASGNSLLKFATGEATGTGDKRIYGFMQCTPDLNESSCSICLEGAINDVPACCGNKEGGRIFKPSCSLRFETFRFYDFTAANTPPPATWPPSSPSPSDNLTPPSPAIQFQNSAVDECGVKLTFSGKKSNTSRTLILIVVPTVIISVLLISFICFFLKKRRPRGQFLSFEGETRTLESLQFQFSTIRVATDNFSDANKLGEGGFGSVYKGRLSDGQEIAVKRLSAGSKQGELEFKNEVLLMAKLQHRNLVRLLGFCLERSERLLIYEFMPNLSLHGFIFDPIKQTQLNWEKRYKIIGGIARGLLYLHEDSRLRIIHRDLKASNILLDAEMNPKISDFGIARLFAVDQTQENTSRIMGTYGYMAPEYVLHGKFSVKSDVYSLGVLILEIISGQKNNCFHVGENTEYLLTHAWISWREGTASSMIDPTLRDGSTSEIMRCIHIGLLCVQENVADRPTMASVMLMLNSYSLSLPIPSHPASFLRSNIDQNISSGLEHNSRSTDSDLSRSSSPINSQYIRLE

SEQ ID NO: 1105 - DNA, 2019 bp, Populus trichocarpa
  POPTR_0004s02500.1
atgaagtctctcaatttcttcatagctctactctccttgcttagccttgctactatcactaaatcacaggacccttcttatctctatcgttcatgcagtaacgagacaacttacacgagaaacagcacttaccaagccaatttaaatctccttctttcttcacttgtgtccaatgcaacccgcaataatcttaatggattctacaactcctctttagggctggaccctgatgatgtttatggcctgtttctttgccgtggcgacgttaacaaaaatgcttgccagaattgtgtcgccttggctgccaaagaggcaatccaacgttgcccagttgaaaaagtggtcgttttatggtacgatttgtgcttcttgcgctactcaaacagggcttttttcgctaccatggaccaagacccaggagtgaccttgtataacactcagaatatcgcatacgaacctgaacgttttaaccgactagtggctacctccatgaatgatacagccactcaggctacaagtgctacttcaggagctaaaaagtttgcagctaaagaagtatattttaatgagtttctaaacttgtacagccttgttcagtgcacaccggacttgtcaagctcggattgtaatcgatgtcttaggatagctatttctagtttgaccagttgttgtggccaaagggcaggagcaagagtcctgtatccaagttgtaatattcggtatgaaacctatgagttttataatacaacagcagtggcggcagagtcgccacctcctcctccgcccgtgattcgtgctcctccgccctctccagtgtcgggatcaaaaggaaaagtccgtgtctcaacagttgtaattattgccattgtcgttcctgttggtgtttctattgcgcttttctgcctgggtttcggtttcctgagaagaaggggaagaaagaacagagattcggtgaaagaaaaggatgttggagatgagatttcaactgaggagtccttgcaatttgatttgagtactatagaagctgccacaaacaatttctcccccgacaacaagttaggcgaaggagggtttggtgaggtttacaagggaacatttcctaatggacaacacatagctgtgaagaggctatcaaaatattctggacatggtgcagcagaatttaagaatgagatcgtattggtagccaagcttcagcatagaaatctagttaggctattgggctattgcctggaaggggaagagaagttactaatatatgaatttgttcccaataaaagcctcgactacttcctatttgatcctgcaaaacaaggactgttggattggttaagtcgttacaaaatcataggggggattgctcgaggtctcctttatcttcacgaagattcccgtctccgaattatccaccgtgatcttaaagcaagcaatgttttgttggatggggaaatgaatccccggattgcagattttggtgtggcaaagatttttggagtcgatcaaagtcaaggaattacaagccgaatcgctggaacatttggttacatgtctccggagtacgcaatgcacggacagtactccgttaagtcagacgtgtatagtttcggtgtcttgatactcgagattatcagtggcaaaaagaacagcagtttctatcaatcagacaatggcatggaccttctaagatatgcatggcagcaatggaaaaatggggcagcactggaactagtggatccaagcttaggagattcttactccagaaatgagatcactagatgcctccatattgccttactgtgtgtccaagaagatccaaacgatagacccacattgacatcagtagttctcatgctcactagtttctcgatatcgctaccattgcctcgagagccatcaagctttgagcaaagcatgaccatctcaagcttgccattaacagagctggagtctgaccaatctaatatcaagtcgaagcctttgtccgtgaatgatgtgtctatcacagaactatatcctcgt

SEQ ID NO: 1106 - protein, 673 aa, Populus trichocarpa
  POPTR_0004s02500.1
MKSLNFFIALLSLLSLATITKSQDPSYLYRSCSNETTYTRNSTYQANLNLLLSSLVSNATRNNLNGFYNSSLGLDPDDVYGLFLCRGDVNKNACQNCVALAAKEAIQRCPVEKVVVLWYDLCFLRYSNRAFFATMDQDPGVTLYNTQNIAYEPERFNRLVATSMNDTATQATSATSGAKKFAAKEVYFNEFLNLYSLVQCTPDLSSSDCNRCLRIAISSLTSCCGQRAGARVLYPSCNIRYETYEFYNTTAVAAESPPPPPPVIRAPPPSPVSGSKGKVRVSTVVIIAIVVPVGVSIALFCLGFGFLRRRGRKNRDSVKEKDVGDEISTEESLQFDLSTIEAATNNFSPDNKLGEGGFGEVYKGTFPNGQHIAVKRLSKYSGHGAAEFKNEIVLVAKLQHRNLVRLLGYCLEGEEKLLIYEFVPNKSLDYFLFDPAKQGLLDWLSRYKIIGGIARGLLYLHEDSRLRIIHRDLKASNVLLDGEMNPRIADFGVAKIFGVDQSQGITSRIAGTFGYMSPEYAMHGQYSVKSDVYSFGVLILEIISGKKNSSFYQSDNGMDLLRYAWQQWKNGAALELVDPSLGDSYSRNEITRCLHIALLCVQEDPNDRPTLTSVVLMLTSFSISLPLPREPSSFEQSMTISSLPLTELESDQSNIKSKPLSVNDVSITELYPR

SEQ ID NO: 1107 - DNA, 2049 bp, Populus trichocarpa
  POPTR_0004s02530.1
atggcccattctatttggctttcggttttctatacggttatcttgttcattcctttaatcgcagcccaacaatttgaatatcgataccatatgtgtacgaatgattctacttatactacgaatagttctttcccattaaacctcaatgcctctctctcttctctctacgaaaatgcctctcgtagcaatgattttagcagcatcagtgtcggtcagaattctgatagagtgtatgcgctcttcctgtgcagaggagataactcccctgagttatgtcagggttgcatcaagaccacccgtgaagatatcatgattcgctgcccgaattacaaagaagcaattatttggtatgataggtgcatgctacgttactctaaccgttctatattctctgtaaaagaggaatggccgaaagcatggatgtggaatgtgaatgatattggagatgttacgggtcaaaatcaatttaatgccaatttgggaggcttgatggaccagcttattactcgcgctgcgtcttctagtaatttgtttgcaatgggagacacaaatggaacagcatttaacagaatatatggaatggtacaatgcactccagatatatctccatctcaatgcagaatatgcttatctggttgcgtcagcgatattcctaggtgctgtaatggaaagcaagggggtaatgttctcacaccaagttgcagtatgaggtttgaaacttaccctttctacactgctccgccagccccaccccctcctgcaagttccccatctccgccaacaccaccagcaacctctttaaatcccagtggagaaaggaaggcttcatcacggacaattgtatacatttcagttcccgctggtgcttttgtggtcctattgttctccttatgctactgttatgcgcaccagaaagcaaggaaggaatacaacgctattcaagagggaaatgttggggatgaaatcacttcggtccaatcattacaatttcaattgggaaccattgaagctgctacaaacaattttgctgaagagaacaagattggtaagggtggatttggcgatgtctacaggggaacacttcctaatggacaacacatagctgtgaagaggctatcaaaaaattctggacaaggtgcagcagaatttaagaatgaggtggtattggtagccaggcttcagcatagaaatctagtcaggctattgggctattgcctggaaggggaagagaagatactgatctatgaatttgttccaaacaagagcctcgactacttcctatttgatcctgcaaaacaaggactgttgaattggtcaagtcgttacaaaatcataggggggattgctcgaggtcttatttatcttcatgaagattcccgtctccgaatcatccaccgtgatcttaaagcaagcaatgttttgttggatggggaaatgaaccccaagattgcagattttggtatggccaagatttttggaggggatcaaagtcaaggaaataccaacaaaatcgctggaacatttggttacatgcctccagagtacgcaatgcacggacagttctccgttaagtcggacgtgtatagtttcggtgtcttgatactcgagattattagtggcaaaaagaacagcagtttctatcaatcagacaatggcctggaccttgtgagctatgcatggaaacaatggaaaaatggggcagtactggaactaatggattcaagcttcggagattcttactccagaaatgagatcactagatgcgtccatattggcttattgtgtgttcaagaagatccaaacgatagacccacgttgtcaacaatagttctcatgctcactagtttctctgtaacgctaccattgcctcgagagccggcatactttgggcaaagcaggaccgtcccgacgtttccaacaacagagctggagtctgaccgatctacttccaagtcgaagcctttgtccgtgaatgatatgtctatcacagaactgttggggattccgtctcccccatgcgcggaccgggggtgtactgatatttgctca

SEQ ID NO: 1108 - protein, 683 aa, Populus trichocarpa
  POPTR_0004s02530.1
MAHSIWLSVFYTVILFIPLIAAQQFEYRYHMCTNDSTYTTNSSFPLNLNASLSSLYENASRSNDFSSISVGQNSDRVYALFLCRGDNSPELCQGCIKTTREDIMIRCPNYKEAIIWYDRCMLRYSNRSIFSVKEEWPKAWMWNVNDIGDVTGQNQFNANLGGLMDQLITRAASSSNLFAMGDTNGTAFNRIYGMVQCTPDISPSQCRICLSGCVSDIPRCCNGKQGGNVLTPSCSMRFETYPFYTAPPAPPPPASSPSPPTPPATSLNPSGERKASSRTIVYISVPAGAFVVLLFSLCYCYAHQKARKEYNAIQEGNVGDEITSVQSLQFQLGTIEAATNNFAEENKIGKGGFGDVYRGTLPNGQHIAVKRLSKNSGQGAAEFKNEVVLVARLQHRNLVRLLGYCLEGEEKILIYEFVPNKSLDYFLFDPAKQGLLNWSSRYKIIGGIARGLIYLHEDSRLRIIHRDLKASNVLLDGEMNPKIADFGMAKIFGGDQSQGNTNKIAGTFGYMPPEYAMHGQFSVKSDVYSFGVLILEIISGKKNSSFYQSDNGLDLVSYAWKQWKNGAVLELMDSSFGDSYSRNEITRCVHIGLLCVQEDPNDRPTLSTIVLMLTSFSVTLPLPREPAYFGQSRTVPTFPTTELESDRSTSKSKPLSVNDMSITELLGIPSPPCADRGCTDICS

SEQ ID NO: 1109 - DNA, 1515 bp, Populus trichocarpa
  POPTR_0138s00200.1
atgaaccagcttattactcgcgctgcgtcttctagtaatttgtttgcaatgggagacacaaatggaacagcatttaccagaatatatggaatggtacaatgcactcccgatatatctccatctcaatgcagaatatgcttatctggttgcgtgagctttattcctacgtgctgcaatggaaagcaaggtggtaatgttctcacaccaagttgcagtatgaggtttgaaacttacgctttctacactgctccgccatccccaccccctcctgcaagttccccatctccgccaccaccaccagcaacctctttaaatcccagtggagaaaggaaggcttcatcacggacaattgtatacatttcagttcccactagtgcctttgtggtgctattgttctccttatgctactgttatgtgcacaagaaagcaaggaaggaatacaacgctattcaagagggaaatgttggggatgaaatcacttcggtccaatcattacaatttcaattgggaaccattgaagctgctacaaataattttgctgaagagaacaagatcggtaagggtggatttggcgatgtctacaggggaacacttcctaatggacaacacatagctgtgaagaggctatcaaaaaattctggacaaggtgcagcagaatttaagaatgaggtggtattggtagccaggcttcagcatagaaatctagtcaggctattgggctattgcctggaaggggaagagaagatactgatctatgaatttgttccaaacaagagcctcgactacttcctatttgatcctgcaaaacaaggactgttgaattggtcaagtcgttacaaaatcatagggggaattgctcgaggtcttctttatcttcatgaagattcccgtctccgaatcatccaccgtgatcttaaagcaagcaatgttttgttggatggagaaatgaaccccaagattgcagattttggtatggccaagatttttggaggggatcaaagtcaaggaaataccagcaaaatcgctggaacatttggttacatgcctccagagtacgcaatgcacggacagttctccgttaagtcggacgtgtatagtttcggtgtcttgatactcgagattattagtggcaaaaagaacagcagtttctatcaatcagacaatggcctggaccttgtgagctatgcatggaaacaatggaaaaatggggcagtactggaactaatggattcaagcttcggagattcttactccagaaatgagatcactagatgcgtccatattggcttattgtgtgttcaagaagatccaaacgatagacccacgttgtcaacaatagttctcatgctcactagtttctctgtaacgctaccattgcctcgagagccggcatactttgggcaaagcaggaccgtcccgaagtttccaacaacagagctggagtctgaccgatctacttccaagtcgaagcctttgtccgtgaatgatatgtctatcacagaactatatcctcgt

SEQ ID NO: 1110 - protein, 505 aa, Populus trichocarpa
  POPTR_0138s00200.1
MNQLITRAASSSNLFAMGDTNGTAFTRIYGMVQCTPDISPSQCRICLSGCVSFIPTCCNGKQGGNVLTPSCSMRFETYAFYTAPPSPPPPASSPSPPPPPATSLNPSGERKASSRTIVYISVPTSAFVVLLFSLCYCYVHKKARKEYNAIQEGNVGDEITSVQSLQFQLGTIEAATNNFAEENKIGKGGFGDVYRGTLPNGQHIAVKRLSKNSGQGAAEFKNEVVLVARLQHRNLVRLLGYCLEGEEKILIYEFVPNKSLDYFLFDPAKQGLLNWSSRYKIIGGIARGLLYLHEDSRLRIIHRDLKASNVLLDGEMNPKIADFGMAKIFGGDQSQGNTSKIAGTFGYMPPEYAMHGQFSVKSDVYSFGVLILEIISGKKNSSFYQSDNGLDLVSYAWKQWKNGAVLELMDSSFGDSYSRNEITRCVHIGLLCVQEDPNDRPTLSTIVLMLTSFSVTLPLPREPAYFGQSRTVPKFPTTELESDRSTSKSKPLSVNDMSITELYPR

SEQ ID NO: 1111 - DNA, 2022 bp, Citrus clementina
  clementine0.9_004200m
atgccgcccttgaaattcttcatggtctttccgtttctcatatatcttttaagctcccagttcagttttacagctgcagttgacccggaatacgtttatcatttttgctcaacaacagcaaatttcaccagaaacagcacctatgaaaaaaacctcaatcttctcctctcttctattccgactaacgccagccgtggaaatggattctccagcggatttttcaacgctacagctggtcaagacccaaacagggtctacggtctctttctctgccgcggggatcaaaccaccaccggttgtcaagactgtgccacctacgctgcaagaaatgtacttcagctttgcccagtcagcaaagaaacaatactatggtacgctgagtgccttttacgttactcggatcagtctatcttttctaccatggccacagctcccactgtctctttgttgaatacacaaaatgttacggaccaaggcaggttgaacgagctagtggggactcagatgagccaagttgtaactcaggctgtgaataataccaaaaggtttgcaacgagaaaagcaaatttcacaacctttcaaacactctacagtcttgcgcaatgtacaccggacctgtcaagttcggattgtaacgcatgtcttcgaggagctgtggcacggttgccaagttgttgcagtggaaagcaaggaggaagagtgttgtttccgagttgtaacgtacggtatgaattgtaccctttttacaatgaaccagccacagcgccgccagcacctgctccggttcttctttctcctccacctcctggttcggtaacgacgtctcgagggaaaagtggaatctcatcatcaacaattatcgccattgttgctccaattgctgtcactgcagtgctttttattttgggcttctgcttcctacgaaggaaagcaaaaaagaagtataatgctgtaccggaaagtaatgctgataacgatcttacaactctagaatccttgcaatttgatttcgagacaattgaagttgccacaaacaaattctcaactgataacaagttgggtgaaggtggatttggtgaggtttataagggtgtacttcctagtggacaagaaatagctgtgaaaaggctatcaaaaagctcaggacagggtgcagaagaatttaagaatgaggttgttttggttgccaagcttcaacacagaaatctggttaggctgctgggattttgcttggagggcgaagaaaagatacttatctacgaatttgtgccaaacaaaagccttgactattttctttatgaccctgaaaaacaaggacaattggattggtcaagacgttacaagataattggagggattgctcgaggaattctttaccttcatgaagattctcggctcagaattatacatcgtgacttgaaagctagtaatatactcttagatgcagagatgaatccgaaaatttcagattttggcatggcaaggatatttggagttgatcaaacccaaggaaatactagcagaatagttgggacatatggttacatggccccagaatatgctatgcatgggcaattttctgtgaaatcagatgtatatagttttggtgtcctagttttggagattataactggcaagaagaacagcaacttttatcaaacagatggtgctgcagatcttttgagttatgcttggaaacaatggagggatggaactcctttgcagttgttggatacaaatctgacagattcttactcaagaaatgaagtgattagatgcatccaattgggcttattatgcgtccaggaagatccagctgagaggccatcaatggcaacaatagttctcatgctcaatagttactctgtcacacttccgttgcctcaacagcctgcatttttcataggcagtcgaactgagaggggcttgcccacaaaagaatttgagtgctctgataaatctacaagcaagtcgattccatggtctgttgatgaagcgtcaattactgaagtatacccccgt

SEQ ID NO: 1112 - protein, 674 aa, Citrus clementina
  clementine0.9_004200m
MPPLKFFMVFPFLIYLLSSQFSFTAAVDPEYVYHFCSTTANFTRNSTYEKNLNLLLSSIPTNASRGNGFSSGFFNATAGQDPNRVYGLFLCRGDQTTTGCQDCATYAARNVLQLCPVSKETILWYAECLLRYSDQSIFSTMATAPTVSLLNTQNVTDQGRLNELVGTQMSQVVTQAVNNTKRFATRKANFTTFQTLYSLAQCTPDLSSSDCNACLRGAVARLPSCCSGKQGGRVLFPSCNVRYELYPFYNEPATAPPAPAPVLLSPPPPGSVTTSRGKSGISSSTIIAIVAPIAVTAVLFILGFCFLRRKAKKKYNAVPESNADNDLTTLESLQFDFETIEVATNKFSTDNKLGEGGFGEVYKGVLPSGQEIAVKRLSKSSGQGAEEFKNEVVLVAKLQHRNLVRLLGFCLEGEEKILIYEFVPNKSLDYFLYDPEKQGQLDWSRRYKIIGGIARGILYLHEDSRLRIIHRDLKASNILLDAEMNPKISDFGMARIFGVDQTQGNTSRIVGTYGYMAPEYAMHGQFSVKSDVYSFGVLVLEIITGKKNSNFYQTDGAADLLSYAWKQWRDGTPLQLLDTNLTDSYSRNEVIRCIQLGLLCVQEDPAERPSMATIVLMLNSYSVTLPLPQQPAFFIGSRTERGLPTKEFECSDKSTSKSIPWSVDEASITEVYPR

SEQ ID NO: 1113 - DNA, 2022 bp, Citrus clementina
  clementine0.9_004201m
atgactcccttgatattcttcgtgttgtttctgtttgtgatctatctttcaagcttccaattcagttttacagctgcagctgacccaacatacgtttatcatttctgttcagacacggcaaatttcaccagaaacagcacctttgaatcaaacctcaatcgtctcctcacttctcttcccactaacgccagccgtgggaatggattctccaggggtttcttcaacgccaccgctggccaagacccaaacagggtctacagcctctttctctgccgcggtgatcaaaccaccgacatctgccaaaactgtgtcacttttgctaccagagatgtaattcggctttgcccagttagcaaagaccccatagtatggtacgatgagtgccttttacgttactcaaataagtatattttttctaccatcgagacgacgcgcactgtctatttgtggaatactcaaaacgcaacagaccctgtcaagtttaacgatctagtggggtctttgatgagtgaagctgcatcccaggcagtgaatgatcccaaaaatttcgctacaaaaatggcaaatttcacatcctttcaaaacctttacgcacttgcacagtgtacacaagacctgtcaagttctgattgtaacaaatgtcttcgaggagcgattgcccagttgccgacttgttgtggtggaaagcaaggaggacgagtgttgactccgagttgcattgtccggtatgaactgtaccccttttacaatgaaccagcgacaccggcaccggcacctactccagttcttctttctcctccacctcctagttcggtgatcaggcctcgtgggaaaagcggaatctcatcatcaacaattattgccatcgtggctccaattgctgtcgcagcagtgctttttgttgcgtgcttatgcttcctaagaaggagagcaaaaaagaaatataatgctgtgccggaagaaaatgctgataacgatcttacaattctagaatccttgcaatttgatttcgagacaattgaagttgccacaaacaaattctcaactgataacaagttgggtgaaggtggatttggtgaggtttataagggtgtgcttcctagtggacaagaaatagccgtgaaaaggctatcagcaagctcaggacaaggtgcacaagaatttaagaatgaggtcgttttggttgccaagcttcaacacagaaatttggttaggctactgggattttgcttggagggagaagaaaagatacttgtctacgaatttgtgccaaacaaaagccttgactattttctttatgaccctgaaaaacaaggacaattggattggtcaaggcgctacaagataattggagggattgctcgaggaattctttaccttcacgaagattctcgactcagaattatacatcgtgacttgaaagctagcaatatactcttagatgcagagatgaatccaaaaatttcagattttggcatggcaagaatatttggagttgatcaaactcaaggaaatactagcagaatagcggggacatttggttacatggccccagaatatgctatgcatgggcaattttctgtgaaatcagatgtatatggttttggtgtcctagtcctggagattataactggcaagaagaacagcagcttttatcaaacagatggtgctagagatcttttgagctatgcttggaaacaatggagggatggaacacctttgcagttgttggatccaaatctgacagattctcactcaagaaatgaagtgattagatgcatccaattgggcttattatgtgtccaggaagatccagctgagaggccatcaatggcaacaatagttctcatgctcaatagttactctgtcacacttccgtcgcctcaacagcctgcatttttcataggcagtcgaactgagaggagcttgcccacaaaagaatttgagttctctgataaatctacaaacaagtcgatgccatggtctgttgatgaagcatcaattactgaagtatacccccgt

SEQ ID NO: 1114 - protein, 674 aa, Citrus clementina
  clementine0.9_004201m
MTPLIFFVLFLFVIYLSSFQFSFTAAADPTYVYHFCSDTANFTRNSTFESNLNRLLTSLPTNASRGNGFSRGFFNATAGQDPNRVYSLFLCRGDQTTDICQNCVTFATRDVIRLCPVSKDPIVWYDECLLRYSNKYIFSTIETTRTVYLWNTQNATDPVKFNDLVGSLMSEAASQAVNDPKNFATKMANFTSFQNLYALAQCTQDLSSSDCNKCLRGAIAQLPTCCGGKQGGRVLTPSCIVRYELYPFYNEPATPAPAPTPVLLSPPPPSSVIRPRGKSGISSSTIIAIVAPIAVAAVLFVACLCFLRRRAKKKYNAVPEENADNDLTILESLQFDFETIEVATNKFSTDNKLGEGGFGEVYKGVLPSGQEIAVKRLSASSGQGAQEFKNEVVLVAKLQHRNLVRLLGFCLEGEEKILVYEFVPNKSLDYFLYDPEKQGQLDWSRRYKIIGGIARGILYLHEDSRLRIIHRDLKASNILLDAEMNPKISDFGMARIFGVDQTQGNTSRIAGTFGYMAPEYAMHGQFSVKSDVYGFGVLVLEIITGKKNSSFYQTDGARDLLSYAWKQWRDGTPLQLLDPNLTDSHSRNEVIRCIQLGLLCVQEDPAERPSMATIVLMLNSYSVTLPSPQQPAFFIGSRTERSLPTKEFEFSDKSTNKSMPWSVDEASITEVYPR

SEQ ID NO: 1115 - DNA, 1257 bp, Populus trichocarpa
  POPTR_0017s09230.1
atgaaggttaaaagcagcgtgaaattactgtgcgtttttgaacgatatatttttctttatgcaggaaaaggcggtgtctcaacagttttaattatagccattttgatcccagttactgtttctcttgtgcttttctgcctgggtttctgtttcttgagtagaagggcgaagagcaataaaaattctgcacaggaaaatgatgttggaaatgagattacaaacgtggagtcattacaattcgatttgagttctatacaagatgccacaaaccatttctccgctgataacaagttaggtgaaggtggatttggtgaggtttacaagggaacacttcctaatggacaagcaatagctgtgaagaggctatcgaaaggctcaggacaaggtgcagcggaatttaagaatgaggttatcttggtagctaagcttcaacacaggaatttagtgaggttgctaggattttgcttggaaggagaagaaaaaattcttgtctatgaatttgtgccaaacaaaagcctcgactactttgtatttgacccagagaagcaagggctactggattggtctaaacgatacaaaataataggaggaattgctcgaggaattctttatctacacgaggactctaggctaagagttatacatcgtgaccttaaagccagtaatattttgcttgatggagatatgaacgccaaagtttcagatttcggcatggctaggattttcggagttgatcaaactcaaggatgtaccaacagaattgttggaacatatggttatatgtctccagaatatgcaatgcatgggcagttctccgtcaagtctgatgcttatagctttggtgtcttaattcttgaaattatatctggaaagaagaacagttctttctatcaaactggcggtgctgcagaccttgcgagctatgcatggaaacattggagagatgggacaccattggaagtgatggatccaactctggcggatacgtattcaagaaatgaggtaatgagatgcatccacattggattgttatgtgttcaggaagatccagcttccaggcccacaatggcaacagttgttctcctgctcaatagttactcgattaccttaccattacctcaagagcctgcattttttctccatagtagaacagatcaagggtcaattccaagcaaggaattttttgcagataaatctaagagcaattctgtgccatattctggcgatgaaggttcaattactgaagtatatcctcga

SEQ ID NO: 1116 - protein, 419 aa, Populus trichocarpa
  POPTR_0017s09230.1
MKVKSSVKLLCVFERYIFLYAGKGGVSTVLIIAILIPVTVSLVLFCLGFCFLSRRAKSNKNSAQENDVGNEITNVESLQFDLSSIQDATNHFSADNKLGEGGFGEVYKGTLPNGQAIAVKRLSKGSGQGAAEFKNEVILVAKLQHRNLVRLLGFCLEGEEKILVYEFVPNKSLDYFVFDPEKQGLLDWSKRYKIIGGIARGILYLHEDSRLRVIHRDLKASNILLDGDMNAKVSDFGMARIFGVDQTQGCTNRIVGTYGYMSPEYAMHGQFSVKSDAYSFGVLILEIISGKKNSSFYQTGGAADLASYAWKHWRDGTPLEVMDPTLADTYSRNEVMRCIHIGLLCVQEDPASRPTMATVVLLLNSYSITLPLPQEPAFFLHSRTDQGSIPSKEFFADKSKSNSVPYSGDEGSITEVYPR

SEQ ID NO: 1117 - DNA, 2046 bp, Eucalyptus grandis
  Eucgr.D00611.1
atgaattcttgccttaccatctgcctctctctctccttcttcatcaaaattttcggtactggagctgcccctaattacatatatcatgattgcccaaacacctccctcttcagccccaactccacctaccgttccaacctccacacactcctctcttccctttcctccgccgccacccacagcaccgacggcttcgcgaacgctactgctggccaaaaccctcccgatcgggcctacgggctcttcctttgccgcggcgaccttgacatcgccacttgcagcatctgcgtggccactggaaagcaggagatcctccgaagatgccccaaccggcgggtctctgttatctggtacgacgagtgcatgttgcggtactcgaaccagtccatcttctcagtcatggagcaatcgccatctccccttttgtacgacgagaacgtcatggacccaatccggttcatgcaggtcctattagaaaccctcaacaacgtcgcggtgagggcttcagctggtgggtcagggaagaaggtcgccgtggcggaggcaaacatcacgagcatgcagaagctgtacgcacttgcacagtgcacgccggacttgacggcatcagactgtggcacatgcctccagttcggtatcgctaatctacctcaggggaagcaagggggtagcttgctcactccgagctgcaatgtgaggtaccagctctacgccttttataacacctcggctctgccggcaccggcaccagcaccagcaacagcacctccacgacctgctccggcgactggacctaaaggcaaaagaaataaagctactgtaataatcattgccgtcgcggttcctgttggcataggcgtggtgcttctcttccttgcttgttgtttcagtcagagtaaagcgaccaagacgtacaatgccgtccaaggagatcaaagcagtacgggatatgccttgcgccgtatacttggatggaatgatgaaattgtgaaggcgggatgcgtaaatggaattacaaaagccgagtccctgcagtatgatttagccaccgtacaagccgccacagacaatttctctcatcaaaacaagttgggtgagggtggattcggtgaagttttccagggtaggctaccaaatggacaaaaaatagctgtgaagagattatctaaaagctcaagacaaggtattggagaattcaaaaatgaggttgttttggtatcgaagcttcaacatcgaaaccttgtgcggctgctcgggttttgcttagatggacaagaaaagttacttatctatgagtttgtgccgaacaaaagcctcgattactttttattcgagcctgataagagagggaaattggattggtcaagacgttacaagataatatctggaatcgctcgaggaatgctctatctacatgaagattctagactccgaatcattcatcgtgatctaaaacctagcaatatcttgttagacaatgatatgaacccgaagatttcagattttggcatggctaggattttcggagtagatcaaactcgggcaaacactaagaaaatcgttgggacctttggttacttgtctcctgagtatgcaatgcgtggacaaatttcagcaaaatccgatgtctatagtttcggtgtcctaatcctagagatcattagtggcatgaagaacaactgctccttccaattagatgaaggcgaaaatcttgccagctatgcgtggaagcattggagagccggtacaccactcgaagtgttagacccgttcattggcgactcatattcaatagatgaagtagttagatgcctccacattggcttgctaggtgttcaggaagatccagcttatagacccaccatggcaagcatagtccttatgttgagcagccactctgttaagcttccacagcctcgacgaccggccttcttccttcgaaggagcaccgagagacagttgaaagagcatgagtcggaccaatctgccagtaggtctatgtctttgtcgaccaatgaaatgtcgattactgagctgtaccctcgg

SEQ ID NO: 1118 - protein, 682 aa, Eucalyptus grandis
  Eucgr.D00611.1
MNSCLTICLSLSFFIKIFGTGAAPNYIYHDCPNTSLFSPNSTYRSNLHTLLSSLSSAATHSTDGFANATAGQNPPDRAYGLFLCRGDLDIATCSICVATGKQEILRRCPNRRVSVIWYDECMLRYSNQSIFSVMEQSPSPLLYDENVMDPIRFMQVLLETLNNVAVRASAGGSGKKVAVAEANITSMQKLYALAQCTPDLTASDCGTCLQFGIANLPQGKQGGSLLTPSCNVRYQLYAFYNTSALPAPAPAPATAPPRPAPATGPKGKRNKATVIIIAVAVPVGIGVVLLFLACCFSQSKATKTYNAVQGDQSSTGYALRRILGWNDEIVKAGCVNGITKAESLQYDLATVQAATDNFSHQNKLGEGGFGEVFQGRLPNGQKIAVKRLSKSSRQGIGEFKNEVVLVSKLQHRNLVRLLGFCLDGQEKLLIYEFVPNKSLDYFLFEPDKRGKLDWSRRYKIISGIARGMLYLHEDSRLRIIHRDLKPSNILLDNDMNPKISDFGMARIFGVDQTRANTKKIVGTFGYLSPEYAMRGQISAKSDVYSFGVLILEIISGMKNNCSFQLDEGENLASYAWKHWRAGTPLEVLDPFIGDSYSIDEVVRCLHIGLLGVQEDPAYRPTMASIVLMLSSHSVKLPQPRRPAFFLRRSTERQLKEHESDQSASRSMSLSTNEMSITELYPR

SEQ ID NO: 1119 - DNA, 1728 bp, Eucalyptus grandis
  Eucgr.D00611.2
atgaattcttgccttaccatctgcctctctctctccttcttcatcaaaattttcggtactggagctgcccctaattacatatatcatgattgcccaaacacctccctcttcagccccaactccacctaccgttccaacctccacacactcctctcttccctttcctccgccgccacccacagcaccgacggcttcgcgaacgctactgctggccaaaaccctcccgatcgggcctacgggctcttcctttgccgcggcgaccttgacatcgccacttgcagcatctgcgtggccactggaaagcaggagatcctccgaagatgccccaaccggcgggtctctgttatctggtacgacgagtgcatgttgcggtactcgaaccagtccatcttctcagtcatggagcaatcgccatctccccttttgtacgacgagaacgtcatggacccaatccggttcatgcaggtcctattagaaaccctcaacaacgtcgcggtgagggcttcagctggtgggtcagggaagaaggtcgccgtggcggaggcaaacatcacgagcatgcagaagctgtacgcacttgcacagtgcacgccggacttgacggcatcagactgtggcacatgcctccagttcggtatcgctaatctacctcaggggaagcaagggggtagcttgctcactccgagctgcaatgtgaggtaccagctctacgccttttataacacctcggctctgccggcaccggcaccagcaccagcaacagcacctccacgacctgctccggcgactggacctaaaggcaaaagaaataaagctactgtaataatcattgccgtcgcggttcctgttggcataggcgtggtgcttctcttccttgcttgttgtttcagtcagagtaaagcgaccaagacgtacaatgccgtccaaggagatcaaagcagtacgggatatgccttgcgccgtatacttggatggaatgatgaaattgtgaaggcgggatgcgtaaatggaattacaaaagccgagtccctgcagtatgatttagccaccgtacaagccgccacagacaatttctctcatcaaaacaagttgggtgagggtggattcggtgaagttttccagggtaggctaccaaatggacaaaaaatagctgtgaagagattatctaaaagctcaagacaaggtattggagaattcaaaaatgaggttgttttggtatcgaagcttcaacatcgaaaccttgtgcggctgctcgggttttgcttagatggacaagaaaagttacttatctatgagtttgtgccgaacaaaagcctcgattactttttattcgagcctgataagagagggaaattggattggtcaagacgttacaagataatatctggaatcgctcgaggaatgctctatctacatgaagattctagactccgaatcattcatcgtgatctaaaacctagcaatatcttgttagacaatgatatgaacccgaagatttcagattttggcatggctaggattttcggagtagatcaaactcgggcaaacactaagaaaatcgttgggacctttggttacttgtctcctgagtatgcaatgcgtggacaaatttcagcaaaatccgatgtctatagtttcggtgtcctaatcctagagatcattagtggcatgaagaacaactgctccttccaattagatgaaggcgaaaatcttgccagctatgtaagc

SEQ ID NO: 1120 - protein, 576 aa, Eucalyptus grandis
  Eucgr.D00611.2
MNSCLTICLSLSFFIKIFGTGAAPNYIYHDCPNTSLFSPNSTYRSNLHTLLSSLSSAATHSTDGFANATAGQNPPDRAYGLFLCRGDLDIATCSICVATGKQEILRRCPNRRVSVIWYDECMLRYSNQSIFSVMEQSPSPLLYDENVMDPIRFMQVLLETLNNVAVRASAGGSGKKVAVAEANITSMQKLYALAQCTPDLTASDCGTCLQFGIANLPQGKQGGSLLTPSCNVRYQLYAFYNTSALPAPAPAPATAPPRPAPATGPKGKRNKATVIIIAVAVPVGIGVVLLFLACCFSQSKATKTYNAVQGDQSSTGYALRRILGWNDEIVKAGCVNGITKAESLQYDLATVQAATDNFSHQNKLGEGGFGEVFQGRLPNGQKIAVKRLSKSSRQGIGEFKNEVVLVSKLQHRNLVRLLGFCLDGQEKLLIYEFVPNKSLDYFLFEPDKRGKLDWSRRYKIISGIARGMLYLHEDSRLRIIHRDLKPSNILLDNDMNPKISDFGMARIFGVDQTRANTKKIVGTFGYLSPEYAMRGQISAKSDVYSFGVLILEIISGMKNNCSFQLDEGENLASYVS

SEQ ID NO: 1121 - DNA, 1944 bp, Eucalyptus grandis
  Eucgr.E02998.1
atgaattttcgcttcatcatctccctcgccctcttctttctcaattttctcagcaatcatcactgctacactaccgaagccgcaccaacttatctacagtatgactgctcggacaccacgctctacgctcccaaatccacctaccaatccaacctcaacaccctcctcttttccctctcctctgccgccaccaacagcggcgagggcttcactaataccaccgctgggaaggacgctcccgaccgtgcgtatgggctcttcctctgccgcggcgatgtcagcactgccacgtgcagcgagtgtgtggctaccggatcaaaagacatccttcgccgatgcccggacaggaaaatctctgtgatctggtacgacgagtgcatgttgaagtactcagaccagtccatttactcggtgatggagaatgatcctatatacacgataccagacaccgggaacgtcgccggcccagatcggttcgtgcagctgctaggagagaccatgaacgacgttgtgctgagggcttcggggagtgaatcggggaagaagtttgctgtcgcagaggcgaacttcacaagctcacagaagctgtacacgcttgcgcagtgcacgccggacttgacggtgtccgactgtaacacatgcctccgggctgcggtcgcagctctacctcagggggagcaaggtggaaggtcgttcacttcaagctgcacggtgaggttcgagatgtacctcttttataatgcctcggcagtgccgccactgccccagcttccttctcctcctcctgctccgctgaatagagccaaaggtacgcaaagcaataaatctaccaggataattgttgccatggccattccggttggcgttgctataatagttctctttgttgcttgttatttgccccggagtaaaacaacaaagacgtatgaagtcgcccatgcagaaggcggtgcaagtgaaattacaactgcagagtccttgcaataccatttagctactatacaagctgccacaaacaatttttctcatcaaaacaagttgggacagggtggatttggtgaagttttccggggtaggcttctgaatggacaagaaatagctgtgaagaggctatctaaaagctcaggacaaggtgttggagaattcaagaatgaggttgttttggtagcaaagctgcaacatcgaaaccttgtgtggctacgcgggttttgcttagagggagaagagaaaatacttgtttatgagtttgttccaaacagaagtcttgactactttttatttgatcctgataagagaaggcaattgaattggtcaagacgaatgctctatctgcacgaagattctaggttacgtatcattcatcatgacctaaaaccaagcaatattctgttagacagtgatatgaacccgaagatttcagattttggcatggctaggactttcggagttgatcaaactcaggcaaaaactaatagaatcgcggggacctttggttacttgtctcctgagtatgcaatgcgtgggcaaatctcagcgaagtccgatgtctatagttttggtgtcctaatcctagagatcattagcggcaagaagaatagcggcttctcccaatcagacggggcgtggaagcattggagagccggtacactgcttgaagtgttagatgcgttcactggcgactcatattcaatcgatgaagtgcttagatgcctccacattggtttactgggtgttcaagaagatccagctgatagacccacaatggcaagaatagtccttatgttcagcagccactctgttaagcttccacagcctcgaagaccgaccttcttccttcaaaggagcacggaaagacagctgaaagagctcaagtcggacgaatccaccagcgggtctatgccgtggtcgatcaatgaaatgtcggttagtgaagtgcaccctcgg

SEQ ID NO: 1122 - protein, 648 aa, Eucalyptus grandis
  Eucgr.E02998.1
MNFRFIISLALFFLNFLSNHHCYTTEAAPTYLQYDCSDTTLYAPKSTYQSNLNTLLFSLSSAATNSGEGFTNTTAGKDAPDRAYGLFLCRGDVSTATCSECVATGSKDILRRCPDRKISVIWYDECMLKYSDQSIYSVMENDPIYTIPDTGNVAGPDRFVQLLGETMNDVVLRASGSESGKKFAVAEANFTSSQKLYTLAQCTPDLTVSDCNTCLRAAVAALPQGEQGGRSFTSSCTVRFEMYLFYNASAVPPLPQLPSPPPAPLNRAKGTQSNKSTRIIVAMAIPVGVAIIVLFVACYLPRSKTTKTYEVAHAEGGASEITTAESLQYHLATIQAATNNFSHQNKLGQGGFGEVFRGRLLNGQEIAVKRLSKSSGQGVGEFKNEVVLVAKLQHRNLVWLRGFCLEGEEKILVYEFVPNRSLDYFLFDPDKRRQLNWSRRMLYLHEDSRLRIIHHDLKPSNILLDSDMNPKISDFGMARTFGVDQTQAKTNRIAGTFGYLSPEYAMRGQISAKSDVYSFGVLILEIISGKKNSGFSQSDGAWKHWRAGTLLEVLDAFTGDSYSIDEVLRCLHIGLLGVQEDPADRPTMARIVLMFSSHSVKLPQPRRPTFFLQRSTERQLKELKSDESTSGSMPWSINEMSVSEVHPR

SEQ ID NO: 1123 - DNA, 1995 bp, Eucalyptus grandis
  Eucgr.E03762.1
atgaattcttgcttcaccatcttcatctccctttcctttttcttcttttccttcaaccacattttcagtactgaggctgcaccggaatatctggatcatgattgcccaaacgccaccctcttcacttccaactccacctacaaatccaacctcaatatcctcctctctgccctctcctccgccgccaacaacagcaccaatgggttcgccaatgccaccgccggccaaaaccctccagaccgggcctacgggctcttcctctgccgcggtgaccttgacaccaccgcgtgcagcgactgcgtggctgccggaaaacatgatatcctccaaaaatgccccaaccagcgagtctctgtaatctggtacgctgagtgcatgttgcggtactcaaaccagttcatcttctcggtcatggagcaagagccgtctctcactttgtacaacaccgggaacgttaccgactcaacccagttcatgcagctcctgcgaggaacgctgaacgacatcgtcacgagggcttcaactggcgggtcagagaagaaggtcgcggcggcacaggcgaacaacacgagcttgcagaagttgtacgcactcacgcaatgcactccggacttgacagcgtcagactgtgacacgtgtctccagtacgcgatcggtaatctggttcaggggaagcaaggcgggcggacgctcactccgagctgcaacgtgaggtacgagctctaccctttttataacgcctcagccctgccagcaccggtgcctccgcctcctgctcccactccagttaccagtcctaaagggaaaagcaataaaactacagtgattgtcatcgctgtcgctgtcgctgtcgctgttggcgtaggcgtggtgcttctcttcctcgcttgttgtttcaggcggaggaaagcggccaagacgcatgaagccgtccaaggagatcaaagcggcgcgagtgaaatttcaaacgccgactccttgcagtatgatttagccactatacaaaccgccacagacaatttctctcatcaaaacaagttgggtgagggcggatttggcaaagttttccagggtaggcttcccaatggacaacaaatagctgtgaagagactatctcaaagctcaggacaaggtgctcaagaatttaagaatgaagtcctattggtagcgaagcttcaacatcggaaccttgtgcggctgctcgggttctgcttggagggcgaagaaaaactgcttgtttatgagtttgtgccaaacaaaagtctcgactactgtctatttgatcctaaaaagagcaaggaattggattggtcgagacgttacaagatagtatgtgggattgctcgaggaatgctctatttacatgaggactctcgacttcggatcattcatcgcgatctaaaagcaagcaatattttgttggacaatgaaatgaacccaaagatttcagattttggcatggcaaggattgttggagtcgaccaaacacaagcaaataccaataaaattgtggggacttttggttacatgtcacctgagtatgcgatgcatgggcaattctctgtgaagtccgatgtttatagtttcggtgtcctacttcttgagctcgttagtggtaagaagaatagtttcttctttgacaaagatggaggcgaagatctcgctagctatgcctggaaaaattggagagatggtaagccattggaagtgttagatccaaccattggagacttgtattcaagggatgaagttcttaggtgcctccacattggtctactttgtgttcaagaagatccaatggatagacccacgatggcaagcgtagtcctcatgttgagcagctactctgtttctcttgcacagcccctacaaccggcgttcttcctccgtagcaggacagagagaccaatgacaaatctcgaatcggaccaatccaccagcaggtccatggcaatgtcgatcaatgagatgtcagttaccgaagtatacccccgg

SEQ ID NO: 1124 - protein, 665 aa, Eucalyptus grandis
  Eucgr.E03762.1
MNSCFTIFISLSFFFFSFNHIFSTEAAPEYLDHDCPNATLFTSNSTYKSNLNILLSALSSAANNSTNGFANATAGQNPPDRAYGLFLCRGDLDTTACSDCVAAGKHDILQKCPNQRVSVIWYAECMLRYSNQFIFSVMEQEPSLTLYNTGNVTDSTQFMQLLRGTLNDIVTRASTGGSEKKVAAAQANNTSLQKLYALTQCTPDLTASDCDTCLQYAIGNLVQGKQGGRTLTPSCNVRYELYPFYNASALPAPVPPPPAPTPVTSPKGKSNKTTVIVIAVAVAVAVGVGVVLLFLACCFRRRKAAKTHEAVQGDQSGASEISNADSLQYDLATIQTATDNFSHQNKLGEGGFGKVFQGRLPNGQQIAVKRLSQSSGQGAQEFKNEVLLVAKLQHRNLVRLLGFCLEGEEKLLVYEFVPNKSLDYCLFDPKKSKELDWSRRYKIVCGIARGMLYLHEDSRLRIIHRDLKASNILLDNEMNPKISDFGMARIVGVDQTQANTNKIVGTFGYMSPEYAMHGQFSVKSDVYSFGVLLLELVSGKKNSFFFDKDGGEDLASYAWKNWRDGKPLEVLDPTIGDLYSRDEVLRCLHIGLLCVQEDPMDRPTMASVVLMLSSYSVSLAQPLQPAFFLRSRTERPMTNLESDQSTSRSMAMSINEMSVTEVYPR

SEQ ID NO: 1125 - DNA, 2184 bp, Eucalyptus grandis
  Eucgr.E03765.1
atggtttttacaattacagtttcttgtgcagccggtaccgtccatgctgcaattattggtcaaacgggacgactctgcggagtcatcacgatcaaagtatctcggagagcagaccatgctcttcttcttcctataattcgtgcccgttctcgtgccgcaagtccaatcagttcatcaagcttgctaatcatgaattcttggttcaccaactccgtctttctcctcttcttcttcatcaaaattttcagtactgaagctgcacccaattatctatttcatgattgcccaaacaccaccctcttcaatcccaattccacctaccagtccaacctcaacaccctcctctcttccctctcctccgccgccaccaacagcaccagtggcttcgccaacaccaacgccggccaaaaccctcccgaccgggcctacgggctcttcttatgccgcggcgatgtcaacaatgcaacgtgcagcgactgcgtggccaccggaaaaacggaaattctccaaaggtgccccaaccagcgagtctccgtaatctggtatgacgagtgcatgttgcggtattcgaaccagtccatctactcggtcatggagagttcgccgtctcctatcttgtacaacaccgcgaaggtcaccgacgaaacccggttcatggatctcctgggaaaaaccctgaacgaagctgccacgagggcttcggctggcgggttggagaagaaggtcgcggtggcggaggcaaacttcacgagcttgcagaagctgtacgcattagcgcaatgcacgcccgacttgatggcgtcagactgcggcacgtgcctccagtctgggatccctaagctacctctggggcagcaaggcgggagggtgctcactccgagctgcaacgcgaggtatgagttctaccccttttataacaccacggttctgcaggcaccggcttctccgcctcccgctgcggcacctccgcctcccgctcctgtgaccggacctaaaggcaaaagcaataaaactactgtgataatcattgccatcgctgttcctgttggcgtgggcgtggtgctgctcttcctcgcttgctgtttgaggcagaggaaagtgaccaagccgtacgaagtcgtccgagaagatcaaagcagcgtaaatgacattacaaacgccgagtccttgcagtacgattttgccaccataaagaccgccacagacaatttctctcaccaaaacaagttgggtgagggaggattcggggaagttttccagggtaggcttcctaatggacaacaaatagctgtgaagagactatctcaaggttcgggacaaggtgctgcagaatttaagaatgaagtcctactggtagcgaagcttcaacatcggaaccttgtgcggatgctcgggttctgcttggagggtgaagaaaaactgcttgtctatgaatttgtgccaaacaaaagtctcgacaactttttatttgatcctgaaaaaagcaagcaattgaattggtcgagacgttacaagatagtatgtgggattgctcgaggaatgctctatttacatgaggactctcgacttcggatcattcatcgggatctaaaagcaagcaatatcttattggatagtgaaatgattccaaagatttcggattttggcatggcaagaattgttgtagtcgatcagacacaggcaaataccaataaaattgttgggacttttggttacatgtcacccgagtatgcaatgcatggacaattctccgcaaagtccgatgtctatagttttggtgttctacttcttgagctcattagtggtaagaagaatagttccttctaccaattagacgacaacgaagatctcgctagctatgtttggaaaaattggagagacggtacgccgttggaagtgttagatccagccgttggagactcatattcaagagatgaagttcttagatgcctccacattggtttactatgtgttcaggaagatccaatggatagacccacaatggcaaacattgtcttgatgttgaacagctactctgttagccttgcattgccccagcaaccggccttgtttttccggagcaggacagagacatcgatgaaagaactcaaatcggaccaatcagccagcaggtctgcaccagtgtcgatcaatgagatgtcagtcactgaggtttacccccgt

SEQ ID NO: 1126 - protein, 728 aa, Eucalyptus grandis
  Eucgr.E03765.1
MVFTITVSCAAGTVHAAIIGQTGRLCGVITIKVSRRADHALLLPIIRARSRAASPISSSSLLIMNSWFTNSVFLLFFFIKIFSTEAAPNYLFHDCPNTTLFNPNSTYQSNLNTLLSSLSSAATNSTSGFANTNAGQNPPDRAYGLFLCRGDVNNATCSDCVATGKTEILQRCPNQRVSVIWYDECMLRYSNQSIYSVMESSPSPILYNTAKVTDETRFMDLLGKTLNEAATRASAGGLEKKVAVAEANFTSLQKLYALAQCTPDLMASDCGTCLQSGIPKLPLGQQGGRVLTPSCNARYEFYPFYNTTVLQAPASPPPAAAPPPPAPVTGPKGKSNKTTVIIIAIAVPVGVGVVLLFLACCLRQRKVTKPYEVVREDQSSVNDITNAESLQYDFATIKTATDNFSHQNKLGEGGFGEVFQGRLPNGQQIAVKRLSQGSGQGAAEFKNEVLLVAKLQHRNLVRMLGFCLEGEEKLLVYEFVPNKSLDNFLFDPEKSKQLNWSRRYKIVCGIARGMLYLHEDSRLRIIHRDLKASNILLDSEMIPKISDFGMARIVVVDQTQANTNKIVGTFGYMSPEYAMHGQFSAKSDVYSFGVLLLELISGKKNSSFYQLDDNEDLASYVWKNWRDGTPLEVLDPAVGDSYSRDEVLRCLHIGLLCVQEDPMDRPTMANIVLMLNSYSVSLALPQQPALFFRSRTETSMKELKSDQSASRSAPVSINEMSVTEVYPR

SEQ ID NO: 1127 - DNA, 1998 bp, Eucalyptus grandis
  Eucgr.E03766.1
atgagttcttgcttctccctctccctctccctctccctctccctcctcttcttcttcatcaatttttcgggtacagaatctgcacctacttatctatggcattactgcaacgccaccctctactctaccaactccacctaccaatccaacctcaacaccctgctctctaacctctccgccgctgccgctgccaccaacaacaccgacggcttcgccaacgccaccgccggccaaaaccctcccgatcgggcctacgggctcttcctctgccgcggagacgtcagcaccgccacgtgcagcgagtgcgtgaccaccggaacacaggatatcctccaaagatgccccaaccagcgagtctctacgatctggtacgacgaatgcatgctgaggtactccaaccggtccatctacggggtcatggaacaagtacctggtctcacgatgtacaacaccgggaacatctccgacccaacccggttcgtgcaagtcctgggacagaccacggacgacgtcgccacaaaggcgtccgacggtgggtcagtgaaaaaagtcgcggtcgaggaggcgaatttcacgagcttgcagaagctgtacacccttgcgcagtgcacgccggacttgactgcgtcggactgcaacacatgccttcgcgcggcgattgcgggccttccccaggacaagcaaggtgggaggacgctcaatccgagctgcagcgtgaggtttgagctataccccttttacaatgcctcggctttggcggcaccggcccctccgccatcccaggttccgtctcctcctcctgcccctaaaggcaaaagcaataaaactactgtgataatcattgccgtcgctgttcctgttggcgtgggcgtggtgcttctcttcctcgcttgttgtttgaggcggaggaaagtgaccaagccgtacgaagtcgtccaagaagatcaaagcagcgtaaatgacattgcaaacgccgagtccttgcagtatgattttgccaccatacaggccgccacagacaatttctctcaccaaaacaagttgggtgagggtggattcggggaagttttccagggtaggcttaataatggacaccaaatagctgtgaagagactatctcaaggctcgggacaaggtgttggagaatttaagaacgaagttctactggtagcgaagcttcaacatcggaaccttgtgcggatgcttgggttctgcttggagggtgaagaaaaactgcttgtctatgagtttgtgccgaacaaaagtctcgactactttttatttgatcctgaaaagagcaagcaattggattggtcgagacgttacaagatagtatgtgggattgctcgaggaatgctctatttacatgaggactctcgacttcggatcattcatcgggatctaaaagcaagcaatatcttgttggatagtgaaatgattccaaagatttcagattttggcatggcaagaattgttgtagtggatcaaacacaagcaaataccaataaaattgtggggacttttggttatatgtcacctgagtatgcaatgcatgggcagttctctgtgaagtccgatgtatatagtttcggtgttctacttcttgagctcattagtggtaagaagaatagtttcttctaccaatcagacgggggcgaagatctcgctagccatgtctggaaaaattggagagacggtacgccattggaagtgttagatctagccgttggagactcgtattcaagagatgaagttcttagatgcctccacattggtttactatgtgttcaggaagatccaatggatagacccacaatggcaaacatagtcttgatgttgaacagctactctgttagtcttgcactgccccaacaaccagccttctttctccggagcaggacagagacattgatgaaagagctcgaatcagaccaatctgccagcaggtctacaccagtgtcgatcaatgagatgtcagtcaccgaagtttacccccgt

SEQ ID NO: 1128 - protein, 666 aa, Eucalyptus grandis
  Eucgr.E03766.1
MSSCFSLSLSLSLSLLFFFINFSGTESAPTYLWHYCNATLYSTNSTYQSNLNTLLSNLSAAAAATNNTDGFANATAGQNPPDRAYGLFLCRGDVSTATCSECVTTGTQDILQRCPNQRVSTIWYDECMLRYSNRSIYGVMEQVPGLTMYNTGNISDPTRFVQVLGQTTDDVATKASDGGSVKKVAVEEANFTSLQKLYTLAQCTPDLTASDCNTCLRAAIAGLPQDKQGGRTLNPSCSVRFELYPFYNASALAAPAPPPSQVPSPPPAPKGKSNKTTVIIIAVAVPVGVGVVLLFLACCLRRRKVTKPYEVVQEDQSSVNDIANAESLQYDFATIQAATDNFSHQNKLGEGGFGEVFQGRLNNGHQIAVKRLSQGSGQGVGEFKNEVLLVAKLQHRNLVRMLGFCLEGEEKLLVYEFVPNKSLDYFLFDPEKSKQLDWSRRYKIVCGIARGMLYLHEDSRLRIIHRDLKASNILLDSEMIPKISDFGMARIVVVDQTQANTNKIVGTFGYMSPEYAMHGQFSVKSDVYSFGVLLLELISGKKNSFFYQSDGGEDLASHVWKNWRDGTPLEVLDLAVGDSYSRDEVLRCLHIGLLCVQEDPMDRPTMANIVLMLNSYSVSLALPQQPAFFLRSRTETLMKELESDQSASRSTPVSINEMSVTEVYPR

SEQ ID NO: 1129 - DNA, 1998 bp, Eucalyptus grandis
  Eucgr.E04152.1
atgagttcttgcttctccctctccctctccctctccctctccctcctcttcttcttcatcaatttttcgggtacagaatctgcacctacttatctatggcattactgcaacgccaccctctactctaccaactccacctaccaatccaacctcaacaccctgctctctaacctctccgccgctgccgctgccaccgacaacaccgacggcttcgccaacgccaccgccggccaaaaccctcccgatcgggcctacgggctcttcctctgccgcggagacgtcagcaccgccacgtgcagcgagtgcgtgaccaccggaacacaggatattctccaaaggtgccccaaccagcgagtctctacgatctggtacgacgaatgcatgctgaggtactccaacgcgtccatctacggggtcatggaacaggtgcctggtctcaagatgattaacaccgggaacatctccgacccaacccggttcatgcaagtcctgggacagaccatggacgacgtcgccacaaaggcgtccgacggtgggtcggggaaaaaagtcgcggtcgaggaggcgaatttcacgagcttgcagaagctgtacactcttgcgcagtgcacgccggacttgactgcgtcggactgcaacacatgccttcgcgcggcgattgcgggccttccccaggacaagcaaggtgggaggacgctcaatccgagctgcagcgtgaggtttgagctataccccttttacaatgcctcggctttggcggcaccggcccctccgccatcccaggttccgtctcctcctcctgctcctaaaggcaaaagcaataaaactactgtgataatcattgccgtcgctgttcctgttggcgtgggcgtggtgcttctcttcctcgcttgctgtttgaggcagaggaaagtgaccaagccgtacaaagtcgttcgagaagatcaaagcagcgtaaatgacattacaaacgccgagtccttgcagtatgattttgccaccatacagaccgccacagacaatttctctcaccaaaacaagttgggtgagggtggattcggggaagttttccagggtaggcttactaatggacaacaaatagctgtgaagagactatctcaaggctcgggacaaggtgttggagaatttaagaacgaagtcctactggtagcaaagcttcaacatcggaaccttgtgcggatgcttgggttctgcttggagggtgaagaaaaactgcttgtctatgagtttgtgccgaacaaaagtctcgactactttttatttgatcctgagaagagcaagcaattggattggtcgagacgttacaagatagtatgtgggattgctcgaggaatgctctatttacatgaggactctcgacttcggatcattcatcgggatctaaaagcaagcaatatcttgttggatagtgaaatgattccaaagatttcagattttggcatggcaagaattgttgtagtggatcaaacacaggcaaataccaataaaattgtggggacttttggttacatgtcacctgagtatgcaatgcatgggcagttctctgtgaagtccgatgtatatagtttcggtgttctacttcttgagctcattagtggtaagaagaatagtttcttctaccaatcagatgggggcgaagatctcgctagctatgtctggaaaaattggagagacggtacgccattggaagtgttagatccagccgttggagactcatattcaagagatgaagttcttagatgcctccacattggtttactatgtgttcaggaagatccaatggatagacccacaatggcaaacatagtcttgatgttgaacagctactctgttagtcttgcactgccccaacaaccggccttctttctccggagcaggacagagacatcgatgaaagagcttgaatcggaccaatctgccagcaggtctacaccagtgtcaatcaatgagatgtcagtcaccgaagtttacccccgt

SEQ ID NO: 1130 - protein, 666 aa, Eucalyptus grandis
  Eucgr.E04152.1
MSSCFSLSLSLSLSLLFFFINFSGTESAPTYLWHYCNATLYSTNSTYQSNLNTLLSNLSAAAAATDNTDGFANATAGQNPPDRAYGLFLCRGDVSTATCSECVTTGTQDILQRCPNQRVSTIWYDECMLRYSNASIYGVMEQVPGLKMINTGNISDPTRFMQVLGQTMDDVATKASDGGSGKKVAVEEANFTSLQKLYTLAQCTPDLTASDCNTCLRAAIAGLPQDKQGGRTLNPSCSVRFELYPFYNASALAAPAPPPSQVPSPPPAPKGKSNKTTVIIIAVAVPVGVGVVLLFLACCLRQRKVTKPYKVVREDQSSVNDITNAESLQYDFATIQTATDNFSHQNKLGEGGFGEVFQGRLTNGQQIAVKRLSQGSGQGVGEFKNEVLLVAKLQHRNLVRMLGFCLEGEEKLLVYEFVPNKSLDYFLFDPEKSKQLDWSRRYKIVCGIARGMLYLHEDSRLRIIHRDLKASNILLDSEMIPKISDFGMARIVVVDQTQANTNKIVGTFGYMSPEYAMHGQFSVKSDVYSFGVLLLELISGKKNSFFYQSDGGEDLASYVWKNWRDGTPLEVLDPAVGDSYSRDEVLRCLHIGLLCVQEDPMDRPTMANIVLMLNSYSVSLALPQQPAFFLRSRTETSMKELESDQSASRSTPVSINEMSVTEVYPR

SEQ ID NO: 1131 - DNA, 1965 bp, Eucalyptus grandis
  Eucgr.L02888.1
atgaattcttgcttcatcatctccctctgtctctcctcctccttcttcttcatcgacattttaagcattgaggctgcacccgaatatctgtttcatgattgcccgaacaccaccctcttcactcccaactccacctaccgatccaacctccacgccctcctctcttccctctcctccgccgccgccggcagcaccgacggcttcgccaatgccaccgccggccaaagccctctagaacgggcctatgggctcttcctctgccgcggcgacctcaacagcactgagtgcagccgctgcgtggccaccggagaatgggatatcctccaaagatgcccgaaccagcgagtctccacaatatggtacgaccagtgcatgttgcggtactcgaaccggtccatactctctgccatggagcgatcgttggatcgtgttttgtatgacgttgggaacgtcaccgacccaacccgtttcatgcagcttctcggtgaaaccctgaacgatatcgccacaagggcttcagctggcgggtcagggaagaaggttgcagcagcggaggcaaacttcactagctcacagaagttgtacgcactcgcacagtgtacgccagacttgacggcgtcagactgtgtcaagtgcctccagtttgcgatcgctaatctgccacaggggaagcaaggcgggaggttgctcgctccaagctgcaacttgagatatgagctctaccccttttatgatgcctcagccctgccgtcgccggcccctccacctcccgttccggcacctccgcctcccgctccggtgaccggacctaaaattgcattcgaaagcaatatatttactatgataatcatcgtaatcgccgtttctgtcgtctcaactgtggtggttctcttccttgctcggtgtttcagtaggaggaatgcgaccgacacacatgcagtcgtccaaggaggtcaaatcggccttactgaaattacaaactcccagtccatgttgtacgatttaaccaccatactagccgccacaagcaatttctcttgtcaaaacaagttgggtaacggcggatttggtgaagtcttcctgggtacgcttcttaatggactaccaatagctgtgaagagactatctcaaagctccaggcaaggttttgaagaatttaagaacgaagtcatgttgctaccgaagcttcaacatcgaaatgtcgtgcagctgctcgggttttgcttagagggtgaagaaaaactgcttgtctatgagtttgtgcagaataaaagtcttgactactttttattcgatcctgaaaaaaacaagcacttgaattggtcaacacgttacaacatagcatgtgggattgctcaaggaatgcgctatctacacgaggactctcgaattcggatcatccatcgtgatttgaaatcaagcaatatattgttggatagtgaaatgaaccccaagatttctgattttggcatggcaaggattttcaggattgaccaaacactagcaatgaccgaaagaattgcgggaacttatggctatatgtcacctgagtatgcaatgaatgggcaattctcagtgaagtccgatgtctatagtcttggtatcctacttctagagctcattattggtaagaagaatggttttttcaaccaggtcgacgggggcgaaggtattgcttgctacgcttggaaaaactggagagacggtacgccgttgttggtgttagatcccgccctaggagggacatattcagtgaacgaagttgctaaatgcatcaaaatcggtttgttgtgtgctcaggaagatccaaatcatagacccacaatggcggacatagtccgtgagttgaccagccaccctgttactcttgaactgccccgacagccggccttctgccatggcaggacagggagactggaatcggacaaatcccctgggaggtctatcactggggctgaactttgg

SEQ ID NO: 1132 - protein, 655 aa, Eucalyptus grandis
  Eucgr.L02888.1
MNSCFIISLCLSSSFFFIDILSIEAAPEYLFHDCPNTTLFTPNSTYRSNLHALLSSLSSAAAGSTDGFANATAGQSPLERAYGLFLCRGDLNSTECSRCVATGEWDILQRCPNQRVSTIWYDQCMLRYSNRSILSAMERSLDRVLYDVGNVTDPTRFMQLLGETLNDIATRASAGGSGKKVAAAEANFTSSQKLYALAQCTPDLTASDCVKCLQFAIANLPQGKQGGRLLAPSCNLRYELYPFYDASALPSPAPPPPVPAPPPPAPVTGPKIAFESNIFTMIIIVIAVSVVSTVVVLFLARCFSRRNATDTHAVVQGGQIGLTEITNSQSMLYDLTTILAATSNFSCQNKLGNGGFGEVFLGTLLNGLPIAVKRLSQSSRQGFEEFKNEVMLLPKLQHRNVVQLLGFCLEGEEKLLVYEFVQNKSLDYFLFDPEKNKHLNWSTRYNIACGIAQGMRYLHEDSRIRIIHRDLKSSNILLDSEMNPKISDFGMARIFRIDQTLAMTERIAGTYGYMSPEYAMNGQFSVKSDVYSLGILLLELIIGKKNGFFNQVDGGEGIACYAWKNWRDGTPLLVLDPALGGTYSVNEVAKCIKIGLLCAQEDPNHRPTMADIVRELTSHPVTLELPRQPAFCHGRTGRLESDKSPGRSITGAELW

SEQ ID NO: 1133 - DNA, 1932 bp, Eucalyptus grandis
  Eucgr.E02999.1
atgaagtcttgcttcgccatctccctctctctctccttcttcttcatcatcagaattttcattactgaagccatacccgaatatctgtatcatgattgcccaaacactacgctcttcactcccaactccacctaccaatccaacctcgacaccctcctctcttccctctcctccgccgccaacaacagcaccgatggcttcgccaacaccaccgccggccaaaacacttccaatcaggtttatgggctcttcctctgccgtggggacctcaacaccatcacgtgcatcgactgtgtggccacgggaaaacaggagatcctccaaaattgccccaaccagagagtctctgtaatctggtacgaccagtgcatgttgcggtactcggaccagtccaccttctcggtcatggagcaagagccgtctctaactttgtacaacatcgggaatgtcagcgactcaacccggttcatggatgtcctgttagaaaccatgggagtcgttaccaaaaaggctgttgctggctggtcagggaagaaggttgccgcagcggaggcgaacttcacgagcttggagaagctgtacgcattcgcgcagtgcacgccggacttgacagcatgggactgtaacacatgcctccagtacgcaaacggtcatctggttcagcggaagcaaggtgggagggtgctcacaccgagctgcaacgtgaggtacgagttctaccccttttataacgtctccgccctgccggtgtccgcgcctccgcctcctgctctggtgtccgcgcctccgcctcccgctccagtgaccggacctaaaggaaaaagcaacaaatctaccgttataaccatcgccattaccgttcctgttggagatgttatggtacttctttttctcacttgttgtttacttggaggaaaaaagatggatgaagtcgtcgaacgaaataatggtgcaaatgaacttaccactatggagtccttgcaatttgacttggctacaatacaagcggcaacaaatgatttctctcctgaaaacaagttgggtgaaggtggatttggtgaagttttccagggtagacttttggatagacaacaaatcgcacttcaacacagaaaccttgtacgactgctcggattttgcttggagggagatgaaaaactactcatctatgagtttgtgccaaataaaagccttgattacttcttatttgatccccaaaaaagcaaccaattgaattggtcattacgttataaaatagtatatgggatcgctcgaggaatgctctatctacacgaagattctcgtctccggatcatccatcgtgacctaaaatgtagcaatatcttgttagacagtgaaatgaacccgaagatttcagattttggcatggcaaggatttttggagtcaatcaaactcaagctagcacaaataaaatcgtggggacttttggttacatgtctcctgaatatgcaatgcatggagagttctcagtgaaatctgatgtttatagtttcggcatactacttatagagatcatttgtggcaagaagaataacttctatcatcacttggatgggggaggatatcttgctagttatgtatggaacaaatggagggatggcacacccttgaaagtgttggacccagctattgtggattcatattcaagggatgaagtccttcgctacttacacattggcttactatgcattcaagaagatccagccattagacccaccatggcaactgtagttctcatgctcagcagcaattactttaacccgtcgtcgccacaacaaccaaccttctgcatcagaagtagatcaaggagactgagcatcccaatgaaagagcttggatcgaatcaatctactagtaggaccttgccttcatcgatcaatgatatgtcggttaccaaattgtaccctcga

SEQ ID NO: 1134 - protein, 644 aa, Eucalyptus grandis
  Eucgr.E02999.1
MKSCFAISLSLSFFFIIRIFITEAIPEYLYHDCPNTTLFTPNSTYQSNLDTLLSSLSSAANNSTDGFANTTAGQNTSNQVYGLFLCRGDLNTITCIDCVATGKQEILQNCPNQRVSVIWYDQCMLRYSDQSTFSVMEQEPSLTLYNIGNVSDSTRFMDVLLETMGVVTKKAVAGWSGKKVAAAEANFTSLEKLYAFAQCTPDLTAWDCNTCLQYANGHLVQRKQGGRVLTPSCNVRYEFYPFYNVSALPVSAPPPPALVSAPPPPAPVTGPKGKSNKSTVITIAITVPVGDVMVLLFLTCCLLGGKKMDEVVERNNGANELTTMESLQFDLATIQAATNDFSPENKLGEGGFGEVFQGRLLDRQQIALQHRNLVRLLGFCLEGDEKLLIYEFVPNKSLDYFLFDPQKSNQLNWSLRYKIVYGIARGMLYLHEDSRLRIIHRDLKCSNILLDSEMNPKISDFGMARIFGVNQTQASTNKIVGTFGYMSPEYAMHGEFSVKSDVYSFGILLIEIICGKKNNFYHHLDGGGYLASYVWNKWRDGTPLKVLDPAIVDSYSRDEVLRYLHIGLLCIQEDPAIRPTMATVVLMLSSNYFNPSSPQQPTFCIRSRSRRLSIPMKELGSNQSTSRTLPSSINDMSVTKLYPR

SEQ ID NO: 1135 - DNA, 1752 bp, Eucalyptus grandis
  Eucgr.E03785.1
atgatatctagcttcaccttctccatctctctctccttcttcttcttcatcatcagaatcttcaatactgaagctgcacccacttacttataccataattgctcaaacaccacgcttttcactcccaactccacctaccgattcaacctcgacacccttctctcttccctctcctccgcctccaccaacagcatcaatggcttcgccaacgccaccgctggccagaaccctcccgaccaggcctatgggatcttcctctgccgtggcgacctcgacaccgccacgtgcagcgactgtgtggccaccggaaaacaggagatcctccaaagatgccccaaccagcgagtctctgtaatctggtacgacgagtgcatgttgcggtactcggaccagtccatcttctcggtcatggagcgagagccgtctcccatcttgtacaacaccgggaacgtcaccgacacaacccagttcatggatgtcctattaaaaaccatgagagacatcatcgcaaacgcttcagctggtgggtcaggaaagaagtttgccgcagcggcggcgaacttcacgagcttggagaagctgttcgcactctcgcagtgcacgccggacttgacaacatgggactgtaacacgtgcctccagtacgcaagcggttatctggttcaggggaagcaaggtgggagggcgctcacaccgagctgcaacgtgaggtacgagttctaccccttttataacgtctccgccctgccggtgtccgcgcctccgcctccttctctggtgtccgcgcctccgcctcccgctccagtgaccggacctaaaggaaaaagcaacaaatctaccgttatagccatcgccattaccgttcctgttggagttgttatggtacttctttttctcacttgttgtttgcttggaggaaaaaagatggatgaagtcgtcgaacgaaataacggtgcaaatgaacttaccactatggagtccttgcaatttgacttggctacaatacaaacggcaacaaatgatttctctcctgaaaacaagttgggtgaaggtggatttggtgaagttttccagggtagacttttggatggacaacaaattgcagtgaagaggctatctcaaagctctagacaaggtgatgaagaattcaaaaacgaagttctattagttgcaaagcttcaacacagaaaccttgtacggctgcttggattttgcttggacggagatgaaaaactactcatctacgagtttgtgccaaataaaagccttgattacttcttatttgatccccaaaaaaccaaccaattgaattggtcattacgttataaaatagtatctggaatcgctcgaggaatgctctatctacacgaagattctcgtctccggatcatccatcgtgacctaaaatgtagcaatatcttgttagacagtgaaatgaacccgaagatttcagattttggcatggcaaggatttttggagtcaatcaaactcaagctagcacaaataaaatcgtggggacttttggttacatgtctcctgaatatgcaatgcatggagagttctcagtgaaatctgatgtttatagtttcggcatactacttatagagatcatttgcggcaagaagaataacttctaccatcaattggatgggggcggctatcttgctagttatcttggatcgaatcaatctactagtaggaccttgccttcatcgaccaatgatatgtcgattaccgaattgtaccctcga

SEQ ID NO: 1136 - protein, 584 aa, Eucalyptus grandis
  Eucgr.E03785.1
MISSFTFSISLSFFFFIIRIFNTEAAPTYLYHNCSNTTLFTPNSTYRFNLDTLLSSLSSASTNSINGFANATAGQNPPDQAYGIFLCRGDLDTATCSDCVATGKQEILQRCPNQRVSVIWYDECMLRYSDQSIFSVMEREPSPILYNTGNVTDTTQFMDVLLKTMRDIIANASAGGSGKKFAAAAANFTSLEKLFALSQCTPDLTTWDCNTCLQYASGYLVQGKQGGRALTPSCNVRYEFYPFYNVSALPVSAPPPPSLVSAPPPPAPVTGPKGKSNKSTVIAIAITVPVGVVMVLLFLTCCLLGGKKMDEVVERNNGANELTTMESLQFDLATIQTATNDFSPENKLGEGGFGEVFQGRLLDGQQIAVKRLSQSSRQGDEEFKNEVLLVAKLQHRNLVRLLGFCLDGDEKLLIYEFVPNKSLDYFLFDPQKTNQLNWSLRYKIVSGIARGMLYLHEDSRLRIIHRDLKCSNILLDSEMNPKISDFGMARIFGVNQTQASTNKIVGTFGYMSPEYAMHGEFSVKSDVYSFGILLIEIICGKKNNFYHQLDGGGYLASYLGSNQSTSRTLPSSTNDMSITELYPR

SEQ ID NO: 1137 - DNA, 2022 bp, Eucalyptus grandis
  Eucgr.E04159.1
atgaagtcttccttcaccgtctccatctctcttttcttcttcctcaattttctcagtgtctatactcgaagttctgaggcggcacccctatatctgtttcatgattgcccaaacaccaccctcttcactcccaactccacctacggatccaacctcgacgccctcctctcttccctctcctccaccgccaacaacagcaccgatggcttcgccaacgccactgccggccaaaaccctcccgatcaggcctacgggctcttcctctgccgtggtgacctcgacatcgccaagtgcagcgactgcgtctccactggaaaacaggagatcctccagaaatgccccaaccagcgagtctctgtgatctggtacaacgagtgcatgttgaggtactcgaacgagtacatcttctccgtcatggaagaggagcctgtcctatggatggccaacaccgtgaacatctctgacccggccaagtacaggcaagtacttggaagtagcatcagagaagttgcctatacggcttcgggcaaaacatccgggaagaaattcgcgagcacagagatgaatttcacaagcttgcagaagctgtacccgatggcgcagtgcacgccggacttgatggagttggagtgtaacagctgcctcctgtcagcaattaaaattctcgaggggattcaaggagcgagggcattcactccgagctgcaacgcgaggttcgagttgtaccccttttacaatgtcactgccgtgcgggcctcacctcctcctccggttgcgacatctgaaggctcacctcctcctccccatcctcctcccgtgacaacacctgaaggaaaaaacaacaaattcacagtgataaccattgtcatagtcgttcccactggaggtgttatgatacttctctttctcacttgtttgcttcgaagaagaggaaagaagaaatatgaagtcatcaaaggaaaaagtggtgcaaacgaacttattaccatggagtccttgcaatatgacttggctaccatacaagccgcgacaaatgatttctctcatgaaagcaaattgggtgaaggtggatttggtgaagttttccagggtggacttcctaatggacaaacaattgcggtgaagaggctatctcaaagctcaagacaaggtgatgatgaatttaagaatgaagttctattagttgcgaagcttcaacacaaaaaccttgtacgactactcggattttgcttggagggaaacgaaaagctactagcctacgagtttgtgccaaataaaagccttgattgtttcttatttgatctcgaaaaaaggggacaattggattggccattacgttataaaatagtgtttgggatcgctcgaggaatgctctatttacacgaagattctcgtcttcgaatcatccatcgtgacctcaaatgtagcaatatcttgttagatagtgaaatgaacccgaagatttcagattttggcatggcaagaatttttggagttgatcaaactcaggctaacacaaataaaattgtggggacttttggttacatggctccagaatatgcaatgcatggagagttctcagtgaaatctgatgtttatagttatggcataatacttctagagatcatttgcggcaagaggaataactaccaccaccaattgggtgggggtgaatatcttgctagttatgcatggaatcaatggagagaaggcacgcccttgaaagtgttggacccagctatcgtggattcatattcaagagatcaagtgcttcgatgcctgcacatttgcttattatgcattcaggaagatccggctattagacctaccatggcaactgtagttctcatgctcagtagtaattccattactctgccatcacctcaacatccggccttcttcatccgcagtatatcacagggattgaacatcccaataagagagcttgaatcggatgaatccgccaataggactatgccttcatcgatcaatggcatgtcagttaccgaattgtaccccagg

SEQ ID NO: 1138 - protein, 674 aa, Eucalyptus grandis
  Eucgr.E04159.1
MKSSFTVSISLFFFLNFLSVYTRSSEAAPLYLFHDCPNTTLFTPNSTYGSNLDALLSSLSSTANNSTDGFANATAGQNPPDQAYGLFLCRGDLDIAKCSDCVSTGKQEILQKCPNQRVSVIWYNECMLRYSNEYIFSVMEEEPVLWMANTVNISDPAKYRQVLGSSIREVAYTASGKTSGKKFASTEMNFTSLQKLYPMAQCTPDLMELECNSCLLSAIKILEGIQGARAFTPSCNARFELYPFYNVTAVRASPPPPVATSEGSPPPPHPPPVTTPEGKNNKFTVITIVIVVPTGGVMILLFLTCLLRRRGKKKYEVIKGKSGANELITMESLQYDLATIQAATNDFSHESKLGEGGFGEVFQGGLPNGQTIAVKRLSQSSRQGDDEFKNEVLLVAKLQHKNLVRLLGFCLEGNEKLLAYEFVPNKSLDCFLFDLEKRGQLDWPLRYKIVFGIARGMLYLHEDSRLRIIHRDLKCSNILLDSEMNPKISDFGMARIFGVDQTQANTNKIVGTFGYMAPEYAMHGEFSVKSDVYSYGIILLEIICGKRNNYHHQLGGGEYLASYAWNQWREGTPLKVLDPAIVDSYSRDQVLRCLHICLLCIQEDPAIRPTMATVVLMLSSNSITLPSPQHPAFFIRSISQGLNIPIRELESDESANRTMPSSINGMSVTELYPR

SEQ ID NO: 1139 - DNA, 1878 bp, Eucalyptus grandis
  Eucgr.E04183.1
atgagttcttgcttcaccatcttcctctccctctccttctcctctttcttcttcttcgtcttcgtccagaatttcagtgctgaagctgcccccacctatataaagcatttttgcgcacgcattagtttcttcactcccaactccatctacgagtccaacctcaacaccgtcctctcttccctctcctccaacgccacgaccagcaccaacggctttgccactgccaccgctggccaggaccgtcccgaccaagcccatgggctctttctctgccgcggcgatgtcagcatctccacgtgcagcgactgtgtggccactggaaagcgtggtgtcctccgaagatgcggcctccagcgagtcgccacgatctggtacgacgagtgcatgttgaggtacgacaacaggtctttcttctcgtccttcgaaacgaagccttcttacacgacgcccaacactacgaacgtcactgatccgacccggttcgtacaagtcctgggacagaccatggataaaatcagcacaaggactcgcgacggcgggtcggggaagaaattcgcggtcgaggaggcgaatttgacgagcctgcagaagctgtacaccctcgcgcagtgcacgccggacttgacgccgttcgactgctaccggtgccttcgggatatgatctcgaacctccccttggataagcaaggtgggaggagtttcactctggtctgcggcgtcaggttcgagctgttcccgttttataatgcctcggccatggcggccccggtgcctccgccatcccggcttccgcttcctccagctctcgagaccagacctaaaaatgaaaatgaacttaccaccgtggagtccttgcaatttgacttggctacaatacaatctgcgacaaatgatttctctcctgaaaacaagttgggtgaaggtggatttggtgaagttttccagggtaaacttcctaatggacaacaaatcgcggtgaagaggctatctcaaagttcaagacaaggtgatgacgaattcaaaaatgaagttctattagttgcaaagcttcaacacaaaaaccttgtacgactactcggattttgcttggagggagacgaaaagctactcgcctacgagtttgtgccgaataaaagccttgattacttcttatttgatcctcaaaaaagtgataaattgaattggccattacgttataaaatagtatatgggattgctcgaggaatgctctatctacatgaagaatctcgtctccggatcatccatcgtgatctaaaatgtggcaatatcttgttagacagtgaaatgaacccaaagatttcagattttggcatggcaaggatttttggagttgatcaaacacaggctagcacaaataaaatcgtggggacttttggttacatgtctcctgaatatgccatgcatggacggttctcagtgaaatccgatgtttatagtttcggtatattgcttctagagatcatttgtggcaagaagaatggcttctacgaccaatttgatgggggtgaatatcttgctcgatatgcatggaatcagtggagagacggcacgcccttgaaagtgctggacccagctattgtggattcaaattcaagagatcaagtgcttcgatgcctacatatttgcttactatgcattcaagaagatccggctattagacccaccatggcaaccgtagttctcatgctcagtagcaattccattaccccaccatcaccccgacatccagctttctttgtccaaagcaaagcgaggggattgggcatcccaatggaagggcttggatcagaccaatccaccagtaggattaagcttttgtcaaacaataacttgtcgcttacggaactatacccccgg

SEQ ID NO: 1140 - protein, 626 aa, Eucalyptus grandis
  Eucgr.E04183.1
MSSCFTIFLSLSFSSFFFFVFVQNFSAEAAPTYIKHFCARISFFTPNSIYESNLNTVLSSLSSNATTSTNGFATATAGQDRPDQAHGLFLCRGDVSISTCSDCVATGKRGVLRRCGLQRVATIWYDECMLRYDNRSFFSSFETKPSYTTPNTTNVTDPTRFVQVLGQTMDKISTRTRDGGSGKKFAVEEANLTSLQKLYTLAQCTPDLTPFDCYRCLRDMISNLPLDKQGGRSFTLVCGVRFELFPFYNASAMAAPVPPPSRLPLPPALETRPKNENELTTVESLQFDLATIQSATNDFSPENKLGEGGFGEVFQGKLPNGQQIAVKRLSQSSRQGDDEFKNEVLLVAKLQHKNLVRLLGFCLEGDEKLLAYEFVPNKSLDYFLFDPQKSDKLNWPLRYKIVYGIARGMLYLHEESRLRIIHRDLKCGNILLDSEMNPKISDFGMARIFGVDQTQASTNKIVGTFGYMSPEYAMHGRFSVKSDVYSFGILLLEIICGKKNGFYDQFDGGEYLARYAWNQWRDGTPLKVLDPAIVDSNSRDQVLRCLHICLLCIQEDPAIRPTMATVVLMLSSNSITPPSPRHPAFFVQSKARGLGIPMEGLGSDQSTSRIKLLSNNNLSLTELYPR

SEQ ID NO: 1141 - DNA, 2037 bp, Eucalyptus grandis
  Eucgr.H04150.1
atgagttcttgcttcaccatcttcctctccctctccttctcctctttcttcttcttcgtcttcgtccagaatttcagcactgaagctgcccccacttttctagatcttttttgcgtacgcattagtttcttcactcccaattccacctacgagtccaacctcaacaccgtcctctcttccctctcatccaacgccaccaccagcaccaacggctttgccaccgccaccgctggccagaaccctcccgaccaagcccatgggctctttctctgccgtggcgatgtcagcatctccacgtgcagcgactgtgtggccactggaaagcttgttgtcctccgaagatgccgcaaccagcgagtcgccacgatctggtacgacgagtgcatgttgaggtacgacaacaggtccttcttctcggccttggaaatgaagcctagttatcagacggccaacactttgaacatcactgatccgacccggttcgcacaagtcctgggacagaccatggatacaatcgccaaaagggcttccaacggcgggtcggggaagaaattcgcggtcgaggaggcgaatttgacgagcttgcagaagctgtacaccctcgcgcagtgcacgccagacttgacgacgtccgactgcaacaggtgccttcaggagaggctcttgaacctcccccaggataagcaaggtgggaggagtttcactctgatctgcggcgtcaggttcgagctgttcccgttttataatacctcggccatggctccggtgcctccgccccagtttcggcgtcctcctgctcctgagagacctaaaggaaaaagcaacaaatctaccatgattaccattgccattaccatttctgttggaggttttatggtacttctctttctgacttgttgtttgcttcgaagaaagggaaagaggatgcatgaagtcttcaaagtaaaaggcgatgcaaatgaacttaccactgtggagtccttgcaatttgacttggctacaatacaagctgcaacaaatgatttttctcttgaaagcaagttgggtgaaggtggatttggtgaagttttccagggtaaacttcctaatggacaacaaatcgcggtgaagaggctatctcaaagttcaagacagggtgatgaagaattcaaaaatgaagttctattagttgcgaagcttcaacacagaaaccttgtacgactacttggattttgcttggagggagatgaaaagctactcgcctatgagtttgtgccgaataaaagccttgattacttcttatttgcacataatgagttttggtgcaacaatgcagatcctcaaaaaagcgatcaattgaattggccattacgttataaaatagtatatgggatcgctcgaggaatgctctatctacatgaagaatctcgtctccggatcatccatcgtgatctaaaatgtagcaacatcttgttagacagtgaaatgaacccaaagatttcagattttggcatggcaaggatttttggagttgatcaaacacaggccaacatagataaaattgtggggacttttggttacatgtctcctgaatatgccatgcatggacagttctccgtgaagtccgatgtttatagtttcggtatactatttctagagatcatttgtggcaagaagaatggcttctaccaccaattcgatgagggtgaatatcttgctagatatgcatggaatcaatggagagatggcacgcccttgaaagtgttggacccgactattgtggattcaaattcaagggttcaagtgcttcgatgcctacacatttgcttactatgcattcaggaagatccggctattagacccaccatggcaaccgtagttctcatgctcagcagcaattccatcaccccgccatcacctcgacatccagctttctttgtccgaagcaaatcgaggggactgggcatcccaatgaaagggcttgaatcgaaccaatccaccagtaggactaaacctttgtcaaacaataacttgtcgcttactgaattatacccccgg

SEQ ID NO: 1142 - protein, 679 aa, Eucalyptus grandis
  Eucgr.H04150.1
MSSCFTIFLSLSFSSFFFFVFVQNFSTEAAPTFLDLFCVRISFFTPNSTYESNLNTVLSSLSSNATTSTNGFATATAGQNPPDQAHGLFLCRGDVSISTCSDCVATGKLVVLRRCRNQRVATIWYDECMLRYDNRSFFSALEMKPSYQTANTLNITDPTRFAQVLGQTMDTIAKRASNGGSGKKFAVEEANLTSLQKLYTLAQCTPDLTTSDCNRCLQERLLNLPQDKQGGRSFTLICGVRFELFPFYNTSAMAPVPPPQFRRPPAPERPKGKSNKSTMITIAITISVGGFMVLLFLTCCLLRRKGKRMHEVFKVKGDANELTTVESLQFDLATIQAATNDFSLESKLGEGGFGEVFQGKLPNGQQIAVKRLSQSSRQGDEEFKNEVLLVAKLQHRNLVRLLGFCLEGDEKLLAYEFVPNKSLDYFLFAHNEFWCNNADPQKSDQLNWPLRYKIVYGIARGMLYLHEESRLRIIHRDLKCSNILLDSEMNPKISDFGMARIFGVDQTQANIDKIVGTFGYMSPEYAMHGQFSVKSDVYSFGILFLEIICGKKNGFYHQFDEGEYLARYAWNQWRDGTPLKVLDPTIVDSNSRVQVLRCLHICLLCIQEDPAIRPTMATVVLMLSSNSITPPSPRHPAFFVRSKSRGLGIPMKGLESNQSTSRTKPLSNNNLSLTELYPR

SEQ ID NO: 1143 - DNA, 1953 bp, Eucalyptus grandis
  Eucgr.E04185.1
atgagctcgtcctttaccatctccctccctcttctcttctccatcaatttgttcatcggcaactctcacacaagcgaagcagcacttacttataccgccttcaaatgctccggcaccaaacaattccttcctggttctacctaccaaaaaaacctcaatgaactcctctcatcactttcctccgccgccaattctgccggcaacaacagcagcggcggcggcggattctccaatgccgctgctggcagcccaccagaccaggcctacgggatcttcctctgccgtggcgacatcgatgccctgacatgcagcaactgtataagcaccgcagcccaagatattggccggcagtgccccggcaaaagaacctccatcatctggtacgacgtatgcatgctgaggtactcgaatcatcccatttactcggtcatgcaaacagcccctgcgtcgacacatgcgaacagctcgagcatcacagacgacccatctcggttcattcaactcctgaaagaggcctcggaggatgtagcacggaaggccccgagcagcagatcggggaagaaagtggccgctgcagaggcggagctcacggactcaccacagctttacatgctcgctgagtgcacacccgacttgacgccatcggactgccgcaaatgcctccgttgggcaatcgcacatctccctcaggtgacgccaggaggaagagtgttgactcccagctgcaacgtgaggtttagggaggaccgcttttacaatgccaccgcgttggggactgtggtggcgcaatttcggagattaaaattacttaacaaatctactacgataactatcgccattagtgttactcttggaggtgttatggtacttctctttctcacttgttgtgtccttcgaagtgccaaggggcttaccactgtggagtccttgcaatttgacttggctacaatacaagcagcaacaaattatttctctcctgaaaacaagttgggtgaaggtggatttggtgaagttttccagggtagacttcctaatggacaacaaattgcggtgaagaggctatctcgaaggtcaagacaaggtgttgaagaatttaagaatgaaattctattagttgcaaagcttcaacacagaaaccttgtacgactgcttggattttgcttggagggagatgaaaagttgctagcctacgagtttgtgccaaataaaagcctcgattacttcttatttgatctcgagaaaaggagacagttggattggccattacgtcataaaattgtttttgggattgcaagaggaatgctctatctacacgaagattctcgtctccgggtcatccatcgtgaccttaaatgtagcaatatcttattagacagtgaaatgaaccccaagatttcagattttggcatggcaaggatttttggagttgaccaaactcaagcaagcacaaacaaaatagtggggacttttggttatatgtctccagaatatgcgatgcatggagagttctcattgaaatccgatgtatatagttttggcataatacttctagagatcgtgtgcggcaagaagaataactactaccaccaactggacgagggtgaatatcttactagttatgtgtggaatcaatggagagatggcaagcccttggaagtgttggacccggctatcatggattcatattcaagagatggagtgcttcgatgcttgcacatttgcttactatgcattcaggaagatccgactattagacccactatggcaaccgtagttctcatgctcagcaacaattcctttaccttgccatcgcctcaacatcccgccttcttcgtccaaagtagcttgtctggaccaagcattcaaatggaagaacttaaattgaaccaatctcccaggaggactatgccttcgtcaacaaatggcatgtcagttactgaattgtgcccccaa

SEQ ID NO: 1144 - protein, 651 aa, Eucalyptus grandis
  Eucgr.E04185.1
MSSSFTISLPLLFSINLFIGNSHTSEAALTYTAFKCSGTKQFLPGSTYQKNLNELLSSLSSAANSAGNNSSGGGGFSNAAAGSPPDQAYGIFLCRGDIDALTCSNCISTAAQDIGRQCPGKRTSIIWYDVCMLRYSNHPIYSVMQTAPASTHANSSSITDDPSRFIQLLKEASEDVARKAPSSRSGKKVAAAEAELTDSPQLYMLAECTPDLTPSDCRKCLRWAIAHLPQVTPGGRVLTPSCNVRFREDRFYNATALGTVVAQFRRLKLLNKSTTITIAISVTLGGVMVLLFLTCCVLRSAKGLTTVESLQFDLATIQAATNYFSPENKLGEGGFGEVFQGRLPNGQQIAVKRLSRRSRQGVEEFKNEILLVAKLQHRNLVRLLGFCLEGDEKLLAYEFVPNKSLDYFLFDLEKRRQLDWPLRHKIVFGIARGMLYLHEDSRLRVIHRDLKCSNILLDSEMNPKISDFGMARIFGVDQTQASTNKIVGTFGYMSPEYAMHGEFSLKSDVYSFGIILLEIVCGKKNNYYHQLDEGEYLTSYVWNQWRDGKPLEVLDPAIMDSYSRDGVLRCLHICLLCIQEDPTIRPTMATVVLMLSNNSFTLPSPQHPAFFVQSSLSGPSIQMEELKLNQSPRRTMPSSTNGMSVTELCPQ

SEQ ID NO: 1145 - DNA, 2019 bp, Eucalyptus grandis
  Eucgr.E03041.1
atggatcctccaaatttcatcctcttgcttcttctcatgtttgcttccaccataaacgcccaattcccggcgacctactgtggttcgaccggcaacttcactgccaacggcacctaccagaacaccctctccatcctcctctccaccatctccaccgccagcgacctgcttctctcctacggcgttttcaataactccgctcccatcgtcggctcctccaaaaccctctatgtctatggcctctgccgtggtgactcaaccgccggaaactgttgcgcctgcctcaaagacttggcctccaacatgagccgcctctgccccctacaaaaggaggcactcctctacaccgggaactgcatcatccggtactcggatgccccgttcttcagttcagtcgcaacagaaccctcctacgtggcaagtaccagtgacgaggtctcgagcccggacacatacggcacatcgatgaggaagctcctgaacggtctgcgggccgaggcggcggttggcgatgtgctgagaaagtacgcatcggggaacttatcagcggggcctgacatcatctacgcgttggcacagtgcatgccagacttgacgaagcagcaatgcaggtactgcctggggctaggcgtccaagtgatcataaattgctgtgtcaggtacacaggaggacggttcatggtgccaagttgtctgatcctgtatgagaccaataatcggttcatgaactcagtcagtgagccacttgcaccaccgcggccaccgtcacttccatcgcgggagggagatgtgcggcctccatcaccaggaataagctacaaagtaggaaaaagcaacaaacctaccgtgataaccattgccattgctgttcctattggaggtattatggtacttctctttctcactggttgttggcttcgaagaaaaggaaagaagacgtatgaagtcatcgaagcaataaacggcgcaaatgaacttaccaccatggagtccttgcaatttgatttggctacaatgcaatccgcgacaaatgatttctctcctgaaaagaaattgggtgaaggtggatttggtgaagttttccagggtagacttcctaatggacaagaaatcgcggtgaagaggctatctcgaagctcaagacaaggtgatgaagaattcaagaatgaagttttattagttgccaagcttcaacacagaaatcttgtacgattgcttggattttgcttggaaggagctgaaaagttattggcctacgagtttgtgccaaataaaagccttgatcacttcttatttgatctcgaaaaaaggagacaattggattggcccacgcgctataaaataatatccagaatcgctcgaggaatgctttatctgcatgaagattctcgacttcggatcatccatcgtgacctaaaatgtagcaatatcttgttggacaatgaaatgaacccaaagatttcggattttggcatggcaaggatttttggaatcaatcaaaatcaagctagcacaaataaaattgtgggaacttttggttacatgtctccggaatatgcaatgcatggagagttctcagtgaaatccgatgtttatagttttggcatactacttctagagatcatttgcggcaagaagaataacttctatccccgattggacgggggtgaatatcttgctacttatgtgtggaatcagtggagagacaacaggcccttggaagtgttggacccgactatagagtattcatattcaagagacgaagtacttcggtgcctacacatgtgcttactatgcattcaggaagatccgaccattagacccactatggcaaccgtagttttcatgctcaatagcaattccattaacctaccattgcctcaacatccagccttcttcatccaaagaagtttgcgaggacagagagtcccaatggaagagcttgaattggagcaatccaccaggagcactatgcctttatcaaccaatggcatgtcgattaccgaattagaccctcgg

SEQ ID NO: 1146 - protein, 673 aa, Eucalyptus grandis
  Eucgr.E03041.1
MDPPNFILLLLLMFASTINAQFPATYCGSTGNFTANGTYQNTLSILLSTISTASDLLLSYGVFNNSAPIVGSSKTLYVYGLCRGDSTAGNCCACLKDLASNMSRLCPLQKEALLYTGNCIIRYSDAPFFSSVATEPSYVASTSDEVSSPDTYGTSMRKLLNGLRAEAAVGDVLRKYASGNLSAGPDIIYALAQCMPDLTKQQCRYCLGLGVQVIINCCVRYTGGRFMVPSCLILYETNNRFMNSVSEPLAPPRPPSLPSREGDVRPPSPGISYKVGKSNKPTVITIAIAVPIGGIMVLLFLTGCWLRRKGKKTYEVIEAINGANELTTMESLQFDLATMQSATNDFSPEKKLGEGGFGEVFQGRLPNGQEIAVKRLSRSSRQGDEEFKNEVLLVAKLQHRNLVRLLGFCLEGAEKLLAYEFVPNKSLDHFLFDLEKRRQLDWPTRYKIISRIARGMLYLHEDSRLRIIHRDLKCSNILLDNEMNPKISDFGMARIFGINQNQASTNKIVGTFGYMSPEYAMHGEFSVKSDVYSFGILLLEIICGKKNNFYPRLDGGEYLATYVWNQWRDNRPLEVLDPTIEYSYSRDEVLRCLHMCLLCIQEDPTIRPTMATVVFMLNSNSINLPLPQHPAFFIQRSLRGQRVPMEELELEQSTRSTMPLSTNGMSITELDPR

SEQ ID NO: 1147 - DNA, 2061 bp, Eucalyptus grandis
  Eucgr.E03770.1
atggatcctccagatctccctctcttgcttattctcctgtttacttccaccataaacgcccaattcccaaagacctactgtggtttgactggcaacttcaccgccaacagcacctacaacaccaccctcaccaccctcctctcctccatctctaccacagactccttgtccctcacctacggcttcttcaatgcctcctccgccatctccggcacctcccaaaccctctacgtcatcggttcctgccgtggcgacctcactgccaagagctgccacacctgcctcgaaacctcggcctccgacatccgccgcctctgccccctccagaaggaggcgattttctactgcgataactgcaccgtccgttactctaacgccttgatcttcagcacagttaagactgagcccaactaccttttgtacaacgaggacagcgtctcaaaccaggtcacgttcacggtggggacacagataaatggtctgcaggacgaggcagccggcggtggctcactgaggaagtttgctacaaggaacatgtctgtggggtctgacatgatttacgtgatggcgcagtgcacaccagatttgacaaaggagcaatgcatcgactgccaagagaaaatcgtcgggaacttgacgcagtgttgtctcgggaaggcgggaatgagggccctggtgccaagttgccagttccgttacgagatctatccgttccttgacccagttaccgagccacttccacctccgccgccgctgtcgccgccactgcctccgcctccctctccgccgcctccgcctccaggaaaaagcaacaaatctaccatgataaccatcgtcattaccgttcctattggaggtgttattgtccttgtctttctcatatgttgtttgcttcgaagaaagggaaagaagacgcatgaagttgtcaaaggaaaagacggtgcaaatgaacttaccaccgtggagtccttgcaatttgacttggctacaatacaagtagcaacaaatgatttctctcctgaaaacaagttgggtgaaggtggatttggtgaagttttcaagggtagacttccggatgtacaacaaattgcggtgaagaggctatctcgaagttctagacaaggtgatgaagaattcaaaaacgaagttctattagttgcgaagcttcaacacagaaatcttgtacgactgctcggattttgcttggagggagatgaaaaactactcacctacgagtttgtgccaaatagaagccttgattacttcttatttggtatgttgcaatttaaccttcttatgtacatttgcttcaaatcaaatttttggtgcaacaatgcagatccccaaaaaagcagtcaattgaattggtcattacgatataaaatagtatctgggatcgctcgaggaatgctctatctacacgaagattctcgtctccggatcatccaccgtgacctaaaatgtagcaatgtcttgttagacagtgaaatgaacccaaagatttcagattttggcatggcaaggatttttggagttgatcaaactcaagctagcacaaataaaatcgtggggacctttggttacatgtctccagaatatgcaatgcatggaaagttctcggtgaaatctgatgtttatagttttggcatactacttatagagatcatttgcggcaagaagaataacttctaccaccaattggatgggggagaatatcttgctagttatgtatggaataaatggagggatggtacggccttcaaagtgttggacccggctatcgtggattcttattcaagagatgaagtccttcgttgcttgcacattggcctattatgcattcaggaagatccagctattagacccaccatggcaaccgtagttcttaggctcagcagcaatcactttaactcgccattgcctcgacatccagccttcttcatccgaagtagatcggggggaccgagcatcccaatgaaagagcttggattgaatcaatctactaataggaccatgccttcgtcaaccaatgatatgtcggttactgaattgtaccctcgg

SEQ ID NO: 1148 - protein, 687 aa, Eucalyptus grandis
  Eucgr.E03770.1
MDPPDLPLLLILLFTSTINAQFPKTYCGLTGNFTANSTYNTTLTTLLSSISTTDSLSLTYGFFNASSAISGTSQTLYVIGSCRGDLTAKSCHTCLETSASDIRRLCPLQKEAIFYCDNCTVRYSNALIFSTVKTEPNYLLYNEDSVSNQVTFTVGTQINGLQDEAAGGGSLRKFATRNMSVGSDMIYVMAQCTPDLTKEQCIDCQEKIVGNLTQCCLGKAGMRALVPSCQFRYEIYPFLDPVTEPLPPPPPLSPPLPPPPSPPPPPPGKSNKSTMITIVITVPIGGVIVLVFLICCLLRRKGKKTHEVVKGKDGANELTTVESLQFDLATIQVATNDFSPENKLGEGGFGEVFKGRLPDVQQIAVKRLSRSSRQGDEEFKNEVLLVAKLQHRNLVRLLGFCLEGDEKLLTYEFVPNRSLDYFLFGMLQFNLLMYICFKSNFWCNNADPQKSSQLNWSLRYKIVSGIARGMLYLHEDSRLRIIHRDLKCSNVLLDSEMNPKISDFGMARIFGVDQTQASTNKIVGTFGYMSPEYAMHGKFSVKSDVYSFGILLIEIICGKKNNFYHQLDGGEYLASYVWNKWRDGTAFKVLDPAIVDSYSRDEVLRCLHIGLLCIQEDPAIRPTMATVVLRLSSNHFNSPLPRHPAFFIRSRSGGPSIPMKELGLNQSTNRTMPSSTNDMSVTELYPR

SEQ ID NO: 1149 - DNA, 2733 bp, Glycine max
  Glyma01g45170.1
atgtttggggcaaaagctgatcgatgtgatattggggtcatggtcgctatgcttttgttcatgatcttgtcactaaacggtgttgtttctggtgcagaccctattgatacctattgtcccagtgaattcccattgtacagcctcaacagttcattccataacaacctcaagcttgtgctgaggttgctttcctccgacaacgcttcaaaggcaggtttctatgacacatccataggacaaggcccagacaaagtgtacggacaatcactttgcagaggggacatctccaactccacagcttgcaaagaatgcattgagaaagcaagccgagatatcatgaataggtgcaagagtgagaatgcaatgatatggtataacctttgccaagtacgttactcctttcagagctttaaggtcgtggcttatactggaaagtatccgcagcagaataatgaggagaagaaagtatcggatcctataagatttagggaatacttgacatatttaatgagcaatctctcagacgaggctgctttcaatcctgataagaacatgtttgcagctggggaagttgactatcctgggaacaagacaatatatggcttagtccaatgtattccagactcacagtgcagtagttgtttgacttctgccttcacagaactcactgaatgctgctccgacctcgaagctgggattattcttgatcggacttgcaatatcaggttccagttgtctcagttcttcaatgcttcatctgcatatcgcttgatttatccaacttccacagcacaggaggaacagagctccaccccggtgtacctgtaccataactgttccggcggcaacaccaccgccaacagtgcctaccaactcaacctgaggaccctcctcacttccctgtcttccaacgccaccaccaccgaattctccaacaacaccgtgggactgggaacatccccgtccgacagggtgtacggcctgttcatgtgcaggggtgacgtgccctctgctctgtgccaacagtgcgtggtgaacgcaacggggcgtctccgctcccagtgctccctggccaaacaggccgtcatttggtacgacgagtgcaccgtgcggtactcgaaccgctccttcttctccacagtggacacgcggccacgtgtcggcctcctgaacaccgccaacatctccaaccaggattccttcatgcgcctgcttttccaaaccataaacagaaccgctgacgaggctgcaaacttttccgtgggtttgaagaaatacgcagtgaatcaagccaacatttctgggtttcagtctctatactgtttggctcagtgcacgccggatctgtcccaggaaaactgtagaagttgtctgagtggtgtgattggagaccttccttggtgctgtcagggaaagcagggaggaagggttctctatcctagctgtaatgtcaggtacgagctctaccctttctaccgcgtcactgcttcccctccttcatcttcaccttcaccgccaacacttcttcctcctccaacttcaccaatttccccaggaagcagtgggatctcagctggaacgattgttgcaattgtggttccaattacggtcgctgtgcttatatttatagtcggaatttgtttcttgagtagaagagcaaggaagaagcagcagggttctgtaaaggaaggaaaaactgcgtatgacatccccaccgtggactccttgcaattcgatttcagcacaattgaagcggccacaaacaagttctctgccgataacaagttgggggaaggtggatttggtgaggtttacaagggcactctttcaagtggacaagtagtagctgtcaagagactctccaaaagctctggacaaggtggagaagaatttaagaatgaagtggtggtggttgccaagcttcaacatagaaatttagtcaggcttcttgggttttgcttgcaaggagaagagaagatacttgtttatgaatatgtgcccaacaaaagtctcgactatattctctttgatcctgaaaagcaaagggagttggattgggggagacgttacaagattattggagggattgctcgaggcattcaataccttcatgaagattctaggcttagaattatacatcgtgatcttaaagctagtaacatattgttggatggagatatgaatccgaaaatctcagattttggcatggcaagaatatttggagtcgatcaaactcaaggaaacaccagcagaatagtagggacttatggttacatggctccagagtatgccatgcatggagagttctctgttaagtctgacgtgtacagttttggagtcctgctcatggagattttaagtggcaagaagaatagctctttctatcaaacggatggtgctgaggatctattgagctatgcttggcaactttggaaggatggaacacctttggaactgatggaccccatattaagagaatcctataatcagaatgaagtcatcagaagcatccatattggtttgttgtgtgtccaagaagatccagctgacagacccacaatggcaacaatagttcttatgctagacagtaacactgttactctaccaactcctacgcagcctgcatttttcgtccacagtggaactgatccaaacatgccaaaggagctgccattcgatcaatcaataccaatgtctgtgaatgacatgtcgattagcgaaatggatcctcga

SEQ ID NO: 1150 - protein, 911 aa, Glycine max
  Glyma01g45170.1
MFGAKADRCDIGVMVAMLLFMILSLNGVVSGADPIDTYCPSEFPLYSLNSSFHNNLKLVLRLLSSDNASKAGFYDTSIGQGPDKVYGQSLCRGDISNSTACKECIEKASRDIMNRCKSENAMIWYNLCQVRYSFQSFKVVAYTGKYPQQNNEEKKVSDPIRFREYLTYLMSNLSDEAAFNPDKNMFAAGEVDYPGNKTIYGLVQCIPDSQCSSCLTSAFTELTECCSDLEAGIILDRTCNIRFQLSQFFNASSAYRLIYPTSTAQEEQSSTPVYLYHNCSGGNTTANSAYQLNLRTLLTSLSSNATTTEFSNNTVGLGTSPSDRVYGLFMCRGDVPSALCQQCVVNATGRLRSQCSLAKQAVIWYDECTVRYSNRSFFSTVDTRPRVGLLNTANISNQDSFMRLLFQTINRTADEAANFSVGLKKYAVNQANISGFQSLYCLAQCTPDLSQENCRSCLSGVIGDLPWCCQGKQGGRVLYPSCNVRYELYPFYRVTASPPSSSPSPPTLLPPPTSPISPGSSGISAGTIVAIVVPITVAVLIFIVGICFLSRRARKKQQGSVKEGKTAYDIPTVDSLQFDFSTIEAATNKFSADNKLGEGGFGEVYKGTLSSGQVVAVKRLSKSSGQGGEEFKNEVVVVAKLQHRNLVRLLGFCLQGEEKILVYEYVPNKSLDYILFDPEKQRELDWGRRYKIIGGIARGIQYLHEDSRLRIIHRDLKASNILLDGDMNPKISDFGMARIFGVDQTQGNTSRIVGTYGYMAPEYAMHGEFSVKSDVYSFGVLLMEILSGKKNSSFYQTDGAEDLLSYAWQLWKDGTPLELMDPILRESYNQNEVIRSIHIGLLCVQEDPADRPTMATIVLMLDSNTVTLPTPTQPAFFVHSGTDPNMPKELPFDQSIPMSVNDMSISEMDPR

SEQ ID NO: 1151 - DNA, 2733 bp, Glycine max; identical to SEQ ID NO: 1149
  Glyma01g45170.3

SEQ ID NO: 1152 - protein, 911 aa, Glycine max; identical to SEQ ID NO: 1150
  Glyma01g45170.3

SEQ ID NO: 1153 - DNA, 1998 bp, Glycine max
  Glyma20g27740.1
atggcttggaattcctctttcaagcttatctttctctttgtccttgttaacttcctcagttttgcaacacctaaggcacaacaggtccctacttttcttgcccaggattgcccaagcaacggaaccacagccaacagcaccttccaaataaacatcaggaccctcttctcttcactatcttccaacgccaccgccaacaatgtattctacaactccacggtggcgggagcaaacccctctgacactgtctatggacttttcatgtgcaggggtgacgtcccatttcagctgtgtggacagtgcgttataaacgcaacccagaaactatcatcagacttacagtgctccttgtccaaacaagctgtgatctggtatgacgagtgcatggttcgctattccaaccgctcctttttctccaccgtagacacaaggcctgctattggcctgttgaacagcgctaatatctcaaaccaggcaaacttcatgcgtttgatgttcgacaccatgaacgaaacagcagatgaagcagctattggtgccaagaaatacgccacgaagcaagcaaacatatctgggtttcagaccctctattgtctggttcagtgcacgccggacttgtcaacccagggttgcagaagttgtcttagtgatgccatagggctccttccatggtgttgtgaaggaaaacaaggagggagaattctaaatcccagctgtaatgttaggtatgatttgtaccctttctaccgcaccaacgtctctgcaccaccagcgtctgtccctccaaccgattcttctaattcgggaggaggaggtagtgaaatttcaccggggacaattgttgcaattgtggttccaattacagtggctgtgctgctatttattgttggaatttggctcttaagtaaaagagcagcaaagaagcgtaactctgcgcaagaccccaaaactgagactgagatcagtgccgtggaatccttgagatttgatttcagtacaattgaagcagccacagataaattctctgatgctaacaagctaggcgaaggtggatttggtgaggtttacaagggcttgcttcctagcggccaagaagtagctgtcaagagactctctaaaaactctggacaaggtggaacagaatttaagaatgaagtagaggttgttgcaaagcttcaacacaaaaatttggtgaggcttctaggattttgcttggaaggagaagaaaagatacttgtttacgaatttgtagccaacaaaagccttgactatattctttttgatcctgagaagcaaaaatcattggattggacaaggcgatacaaaattgttgaaggaattgctcgaggcattcaatatcttcatgaagattccaggcttaagattatacatcgtgaccttaaagctagcaatgtcttgttagatggagatatgaatccaaaaatctcggattttggcatggcaagaatatttggagtggatcaaactcaagcaaataccaacaggattgtagggacatatggttacatgtctccagagtatgcaatgcatggagaatactctgctaagtctgatgtatacagttttggggtcctcattttggagattataagtggcaagaggaacagctctttctatgaaacagatgttgctgaggatctgttgagctatgcctggaaactttggaaggatgaagctcctttggagttgatggaccaatcattaagagaatcatatactcgaaatgaagttatcagatgcatccatatcggtttactgtgtgtccaagaagatccaatagatagacctacaatggcatcagtagttcttatgcttgatagttactctgttactctacaggtacctaatcagcccgcattctatataaacagtagaactgaaccaaacatgccgaaggggcttaaaattgatcagtctactaccaattcaacatcaaagtctgtcaatgatatgtcggttagtgaagtagatcctcga

SEQ ID NO: 1154 - protein, 666 aa, Glycine max
  Glyma20g27740.1
MAWNSSFKLIFLFVLVNFLSFATPKAQQVPTFLAQDCPSNGTTANSTFQINIRTLFSSLSSNATANNVFYNSTVAGANPSDTVYGLFMCRGDVPFQLCGQCVINATQKLSSDLQCSLSKQAVIWYDECMVRYSNRSFFSTVDTRPAIGLLNSANISNQANFMRLMFDTMNETADEAAIGAKKYATKQANISGFQTLYCLVQCTPDLSTQGCRSCLSDAIGLLPWCCEGKQGGRILNPSCNVRYDLYPFYRTNVSAPPASVPPTDSSNSGGGGSEISPGTIVAIVVPITVAVLLFIVGIWLLSKRAAKKRNSAQDPKTETEISAVESLRFDFSTIEAATDKFSDANKLGEGGFGEVYKGLLPSGQEVAVKRLSKNSGQGGTEFKNEVEVVAKLQHKNLVRLLGFCLEGEEKILVYEFVANKSLDYILFDPEKQKSLDWTRRYKIVEGIARGIQYLHEDSRLKIIHRDLKASNVLLDGDMNPKISDFGMARIFGVDQTQANTNRIVGTYGYMSPEYAMHGEYSAKSDVYSFGVLILEIISGKRNSSFYETDVAEDLLSYAWKLWKDEAPLELMDQSLRESYTRNEVIRCIHIGLLCVQEDPIDRPTMASVVLMLDSYSVTLQVPNQPAFYINSRTEPNMPKGLKIDQSTTNSTSKSVNDMSVSEVDPR

SEQ ID NO: 1155 - DNA, 2034 bp, Glycine max
  Glyma20g27750.1
atggcttggaattcctctttcaagctcctctttctctttgtctttgttagcttcctctgttttgcaacaactaaagcacagggccctaattttctttaccaggattgcccaagcaaccaaaccacagccaacagcaccttccaaataaacatcaggaccctcttctcttcactatcttccaacgccaccaccaacaatgtattctacaactccacagtgacgggaacaaacccctctgacactgtctatggacttttcatgtgcaggggtgacgtcccatttcagctgtgtggacagtgcgttataaacgcaacccagaaactatcatcagacttacagtgctccttgtccaaacaagctgtgatctggtacgacgagtgcatggttcgctattccaaccactcctttttctccaccgtagacacaaggcctgctattggcctgttgaacagcgctaatatctcaaaccaggcaaacttcatgcgtttgatgttcgacaccatgaacgaaacagcagatgaagcagctattggtgccaagaaatacgccacgaagcaagcaaacatatctgggtttcagaccctctattgtctggttcagtgcacgccggacttgtcaacccagggttgtagaagttgtcttagtgatgccatagggctccttccacggtgctgtgaaggaaaacaaggagggagaattctaaatcccagctgtaatgttaggtacgaattgtaccctttctttcgcaccaacaccattgcttcctccccagcccctacgcctacaccatcagtctctgttcctccaactccaaccacttcttctaactcgggaggaagtggtggaatttcatcgggtacaatagttgcaattgtggttcctattgcagtggccgtggtgatatttgttgtgggcatttggatcttatgcaaaagagcagcaaagaagcgtaactctgaacaagacccaaaaaacatgccgtttctcttcttagctggaactgagatcagtgccgtggaatccttgagatttgatttcagtacaattgaagcagccacacaaaaattctcagaagctaacaagctaggtgaaggtggatttggtgagggcttgcttccaagcggacaagaagtggctgtcaagagactctctaaaatctctggacaaggtggggaagaatttaaaaatgaagtagagattgttgcaaagcttcaacacaggaatttggtgaggcttctaggattttgtttggaaggggaagaaaagatacttgtctacgaatttgtagtcaacaaaagccttgactatattctttttgatcctgagaagcaaaaatcattggattggacaaggcgatacaaaattgttgaaggaattgctcgaggcattcaatatcttcatgaagattccaggcttaagattatacatcgtgaccttaaagctagcaatgtcttgttagatggagatatgaatccaaaaatctcggattttggcatggcaagaatatttggagtggatcaaactcaagcaaataccaacaggattgtagggacatatggttacatgtctccagagtatgcaatgcatggagaatactctgctaagtctgatgtatatagttttggagtcctagttttggagattttaagtggcaagaaaaacagctctttctatgaaaccgacgttgctgaagatctattgagctatgcctggaaattttggaaggatgaaacacccctggagttgctagaacactcattaagagaatcatatactccaaatgaagttatcagaagcatccatattggtttgctttgtgtccaagaagatccagcagatagacctacaatggcatcagtagttctcatgctttctagttactctgttactctaccggtacctaatcagcctgcattatttatgcatagtagaactgaatcaaacatgctgaagtgggtgcaaattgatcagtctattaccaagtcaacaacaaagtctgtcaatgagatgtcgcttagtggagatattcctcga

SEQ ID NO: 1156 - protein, 678 aa, Glycine max
  Glyma20g27750.1
MAWNSSFKLLFLFVFVSFLCFATTKAQGPNFLYQDCPSNQTTANSTFQINIRTLFSSLSSNATTNNVFYNSTVTGTNPSDTVYGLFMCRGDVPFQLCGQCVINATQKLSSDLQCSLSKQAVIWYDECMVRYSNHSFFSTVDTRPAIGLLNSANISNQANFMRLMFDTMNETADEAAIGAKKYATKQANISGFQTLYCLVQCTPDLSTQGCRSCLSDAIGLLPRCCEGKQGGRILNPSCNVRYELYPFFRTNTIASSPAPTPTPSVSVPPTPTTSSNSGGSGGISSGTIVAIVVPIAVAVVIFVVGIWILCKRAAKKRNSEQDPKNMPFLFLAGTEISAVESLRFDFSTIEAATQKFSEANKLGEGGFGEGLLPSGQEVAVKRLSKISGQGGEEFKNEVEIVAKLQHRNLVRLLGFCLEGEEKILVYEFVVNKSLDYILFDPEKQKSLDWTRRYKIVEGIARGIQYLHEDSRLKIIHRDLKASNVLLDGDMNPKISDFGMARIFGVDQTQANTNRIVGTYGYMSPEYAMHGEYSAKSDVYSFGVLVLEILSGKKNSSFYETDVAEDLLSYAWKFWKDETPLELLEHSLRESYTPNEVIRSIHIGLLCVQEDPADRPTMASVVLMLSSYSVTLPVPNQPALFMHSRTESNMLKWVQIDQSITKSTTKSVNEMSLSGDIPR

SEQ ID NO: 1157 - DNA, 2637 bp, Glycine max
  Glyma09g27780.1
atgacccacttctcaagttgcgggggtaccccaaaaaaaattatatatggacacttatgtgccatcagcagacacttagagagagaagatgaaattaagcgaggcagagatgaaattaagaaaaagaagtataaatatcataaatcatataatggaataagaagaaattttgcaacaactgaggcacaaaacgaccctttctatctatacaaagattgttccagcgacaaaaccagccccaacacctccttccaatttaacctcaagaacctcctttcttccctatcatccaacgccaccggcaacaccccattttacaacgccacaatcaatggcgaaaacccctctgactctatctatggacttttcatgtgtagggctgacgtgtcctctcacctctgccaactatgcgtccggaatgcaacccaacaactatcatcagaatgctccttatccaaacaagcagtcatatggtacgaggagtgcatggtttggtattccacgtcttttattttctccagtgtggccacaacacctagtaatcccatgaagaacagtggtaatgtctcaaacccagaaagcttcatgcgtttagtgtttttgacattaaaccaaactgcagatgaagcatcatcccaatcaagtattggtaacaataagttcgcaacaaaggaagcaaaaaacgtgttaggaatatctcagactcaaaccctttattgtttagctcagtgcacaccgaatctttcaccacatgattgtagaacatgtcttgatgatgcgataaggcaaattcaagggtgttgtgaaggaaggataggagggagagttctgtttcctagctgcaatgttaggtatgaaatgtaccctttctacaatttttataaggctgatgtggctaacacagtgtttggtctcttcttgtgccgagaccaagaggatcttccttcagggctttgtggtgagtgtgtcaaaaacgcaacgcatgaaatatcatcaaagtgtgactcgttccatgaggctataatttggtacagccagtgcatgcttcgctattcctatagaaattttttcaatgaagtggaaacaggtcctgtgttttctgagttaaacaccaccaacaaggatgatgaacaaaatttctttacgatgaagttagcgaagacgttagatcaagcggcgatccaggcaggggacagtgatgagaaatacggaaaaaggacgacaaaattgaatgatttgcaaaccctttatgctcttgctcagtgcacacaagatttgtctattgaagattgcaagggttgtctgggaattgtgcttggaacatcaattccatggtctcgtttgggaagtatagggggaagagttttgtatcctagctgcaatatcaggtttgaattgttccaattctacaaagacaatgacaaatctgggacgccatcatcaccagaaagaagaaaaggcaagtcgcgaataattatcttgattgttgtgttggcaagtatttctgtgacgttattctttgcagcttactattttctacataaaaaagcaagaaagaggcgtgcagctattctcgaagataattttggtcgtggaattgctactttagagtcgttgcaatttgatttggctaccattatagcagcaactaataaattctcagaccagaataaaataggcaaaggtggatttggagaagtttataagggtattcttcttgatggttcacaaatagccgtaaagagattatcaaaaagttcaaagcaaggatcaaatgagttcaagaatgaagttttattaatagccaaacttcaacaccgaaatctagtgactctaattggtttttgctttcaggaagaagaaaaaatacttatttatgaatatgtgccaaacaagagccttgattactttctatttgattctcaaccgcaaaagttaagctggtctgaacgctataatattataggaggaattgctcaaggaattctttatttacatgaacattctcgactaaaagttatacatcgtgatctcaaacccagtaatgttctattagatgaatgtatgattccaaaaatttcagattttggtctcgccagaattgttgaaataaatcaagacaaaggaaatacaagtgtaattgttggaacatatggttatatgtctccagaatatgcaatgttcggacaattttctgagaagtcagatgttttcagttttggtgtcatggttttagagattataagtggaaaaaagaatttcagttcttatgaatcacaccgtattactaatggcctcttaagctatgtttggaaacaatggagtgatcacacacctttgaacacattggacccagatattactgaaaattattctgaaattgaggtcatcaagtgcattcagattggtttattatgtgttcaacaagaccctgatgctagacctacaatggtgacagttgcttcatatctgactagtcaccctattgaattgccaacaccacaagagcctgcatttttcttgcatggtagaatgcatgaaaatccagttgcgaatgaatcaagttccaatcaatcaatcaacacttctacaccattctcgaacaatcaaatgtctataagccaatttcttcctcgg

SEQ ID NO: 1158 - protein, 879 aa, Glycine max
  Glyma09g27780.1
MTHFSSCGGTPKKIIYGHLCAISRHLEREDEIKRGRDEIKKKKYKYHKSYNGIRRNFATTEAQNDPFYLYKDCSSDKTSPNTSFQFNLKNLLSSLSSNATGNTPFYNATINGENPSDSIYGLFMCRADVSSHLCQLCVRNATQQLSSECSLSKQAVIWYEECMVWYSTSFIFSSVATTPSNPMKNSGNVSNPESFMRLVFLTLNQTADEASSQSSIGNNKFATKEAKNVLGISQTQTLYCLAQCTPNLSPHDCRTCLDDAIRQIQGCCEGRIGGRVLFPSCNVRYEMYPFYNFYKADVANTVFGLFLCRDQEDLPSGLCGECVKNATHEISSKCDSFHEAIIWYSQCMLRYSYRNFFNEVETGPVFSELNTTNKDDEQNFFTMKLAKTLDQAAIQAGDSDEKYGKRTTKLNDLQTLYALAQCTQDLSIEDCKGCLGIVLGTSIPWSRLGSIGGRVLYPSCNIRFELFQFYKDNDKSGTPSSPERRKGKSRIIILIVVLASISVTLFFAAYYFLHKKARKRRAAILEDNFGRGIATLESLQFDLATIIAATNKFSDQNKIGKGGFGEVYKGILLDGSQIAVKRLSKSSKQGSNEFKNEVLLIAKLQHRNLVTLIGFCFQEEEKILIYEYVPNKSLDYFLFDSQPQKLSWSERYNIIGGIAQGILYLHEHSRLKVIHRDLKPSNVLLDECMIPKISDFGLARIVEINQDKGNTSVIVGTYGYMSPEYAMFGQFSEKSDVFSFGVMVLEIISGKKNFSSYESHRITNGLLSYVWKQWSDHTPLNTLDPDITENYSEIEVIKCIQIGLLCVQQDPDARPTMVTVASYLTSHPIELPTPQEPAFFLHGRMHENPVANESSSNQSINTSTPFSNNQMSISQFLPR

SEQ ID NO: 1159 - DNA, 2637 bp, Glycine max; identical to SEQ ID NO: 1157
  Glyma09g27780.2

SEQ ID NO: 1160 - protein, 880 aa, Glycine max
  Glyma09g27780.2
MTHFSSCGGTPKKIIYGHLCAISRHLEREDEIKRGRDEIKKKKYKYHKSYNGIRRNFATTEAQNDPFYLYKDCSSDKTSPNTSFQFNLKNLLSSLSSNATGNTPFYNATINGENPSDSIYGLFMCRADVSSHLCQLCVRNATQQLSSECSLSKQAVIWYEECMVWYSTSFIFSSVATTPSNPMKNSGNVSNPESFMRLVFLTLNQTADEASSQSSIGNNKFATKEAKNVLGISQTQTLYCLAQCTPNLSPHDCRTCLDDAIRQIQGCCEGRIGGRVLFPSCNVRYEMYPFYNFYKADVANTVFGLFLCRDQEDLPSGLCGECVKNATHEISSKCDSFHEAIIWYSQCMLRYSYRNFFNEVETGPVFSELNTTNKDDEQNFFTMKLAKTLDQAAIQAGDSDEKYGKRTTKLNDLQTLYALAQCTQDLSIEDCKGCLGIVLGTSIPWSRLGSIGGRVLYPSCNIRFELFQFYKDNDKSGTPSSPERRKGKSRIIILIVVLASISVTLFFAAYYFLHKKARKRRAAILEDNFGRGIATLESLQFDLATIIAATNKFSDQNKIGKGGFGEVYKGILLDGSQIAVKRLSKSSKQGSNEFKNEVLLIAKLQHRNLVTLIGFCFQEEEKILIYEYVPNKSLDYFLFDSQPQKLSWSERYNIIGGIAQGILYLHEHSRLKVIHRDLKPSNVLLDECMIPKISDFGLARIVEINQDKGNTSVIVGTYGYMSPEYAMFGQFSEKSDVFSFGVMVLEIISGKKNFSSYESHRITNGLLSYVWKQWSDHTPLNTLDPDITENYSEIEVIKCIQIGLLCVQQDPDARPTMVTVASYLTSHPIELPTPQEPAFFLHGRMHENPVANESSSNQSINTSTPFSNNQMSISQFLPRY

SEQ ID NO: 1161 - DNA, 1980 bp, Glycine max
  Glyma10g39880.1
atgattatcaggtccaaacttagtctaacactgttcctactttgcaccctttcactcaccgttacagaaacctctgcatcagtgttcaacaacgttagctgctcgagcaacaagactttcactccgaacagcaccttcaacaccaacctcaacaccctcctctcttacctttcctccaacgtaaccaacaacgttagattcttcaacgccaccgcaggtaaagattcgaacgccgtctatggcctctacatgtgccgtggagacgtgccgtttgctctatgcagagagtgtgtgggttttgcaacactaaccatagcctcctcatgtcccacatcgaaagaggctgtgatttggtacaacgagtgtttattgcgctactcttataggctcatcttctctaaaatggaagagaggccaaggcacaagatcaatattccattgggggaccctctggttttgcatagtaatggattctacactgcgttaggatccattttcgatgaactaccacataaagcagcactggctcttgccgagtctaataatggatatgcggttaagcaagaaaatacttctgcgagtgtgacactgtatggcctcgcgcagtgcacgccggacttggctgccggagactgcatacggtgtgtcaccgatgcggcggcggagtttgtcaagtcttgctgcggagggagcataggagcgagtgttctgtttccgagttgcattgtaaggtatgagacgtatccgttttatcagcattcgggaacctccgcgccaacaatgattaagcgtggaggaaatattggaactgaagtgattgtgatcgttgttgtcttggttgtcgttttggtgatgctttttggctttggctattgtttcatccggataaaagcgagaaagaaacggaaggccggtgacagagaaaaatttgggccagaacacactgtcttggagtctttggaatttgatttggttacaattgaagcagccacaaacaatttttctgaagaccgcaggattggcaaagggggttacggagaagtgtacaagggaatccttcctaaccgagaggaagtagctgtaaagagattatcaacaaattctaagcaaggagcggaggaattcaaaaatgaagtgttgttaatagcaaaacttcaacacaaaaatttggtgagattagtaggattttgccaagaagacagagaaaaaatacttatttacgaatatgtgcctaacaagagccttgaccacttcttatttgattcccaaaagcacagacaattaacttggtcggagcggtttaaaatcataaaaggaattgcaagaggtattctttatcttcatgaagattctcgtcttaagattatacaccgtgatatcaaaccaagcaatgttctattggacaatggcatcaatccaaaaatctctgattttggaatggcaaggatggtagctacagaccaaattcaaggatgtacgaatagagttgtgggcacatatggttatatgtctcctgaatatgcaatgcatggacaattttctgagaagtctgatgtattcagttttggagttatggttcttgagattattagtgggaagaagaactcttgttattttgaatcatgccgtgttgatgacctcttgagttatgcatggaataactggagggatgaatcatcatttcaattactggatccaactctgctagagtcttatgttccaaacgaagttgaaaagtgtatgcagattggtttattgtgtgtacaagaaaatccagatgataggcctacaatgggaaccattgtttcatatcttagcaacccatcgcttgaaatgccattccctctagaaccagcatttttcatgcatggcagaatgagaagacattcagctgaacatgaatcatcttcaggttactccaccaatcgttcttccttgtcctctgtgaataagatgtctacgactgctttcttccctcga

SEQ ID NO: 1162 - protein, 660 aa, Glycine max
  Glyma10g39880.1
MIIRSKLSLTLFLLCTLSLTVTETSASVFNNVSCSSNKTFTPNSTFNTNLNTLLSYLSSNVTNNVRFFNATAGKDSNAVYGLYMCRGDVPFALCRECVGFATLTIASSCPTSKEAVIWYNECLLRYSYRLIFSKMEERPRHKINIPLGDPLVLHSNGFYTALGSIFDELPHKAALALAESNNGYAVKQENTSASVTLYGLAQCTPDLAAGDCIRCVTDAAAEFVKSCCGGSIGASVLFPSCIVRYETYPFYQHSGTSAPTMIKRGGNIGTEVIVIVVVLVVVLVMLFGFGYCFIRIKARKKRKAGDREKFGPEHTVLESLEFDLVTIEAATNNFSEDRRIGKGGYGEVYKGILPNREEVAVKRLSTNSKQGAEEFKNEVLLIAKLQHKNLVRLVGFCQEDREKILIYEYVPNKSLDHFLFDSQKHRQLTWSERFKIIKGIARGILYLHEDSRLKIIHRDIKPSNVLLDNGINPKISDFGMARMVATDQIQGCTNRVVGTYGYMSPEYAMHGQFSEKSDVFSFGVMVLEIISGKKNSCYFESCRVDDLLSYAWNNWRDESSFQLLDPTLLESYVPNEVEKCMQIGLLCVQENPDDRPTMGTIVSYLSNPSLEMPFPLEPAFFMHGRMRRHSAEHESSSGYSTNRSSLSSVNKMSTTAFFPR

SEQ ID NO: 1163 - DNA, 1965 bp, Glycine max
  Glyma20g27770.1
atgattaccaagtccaaacagagtctaactctgttcctactttgcacccttttactcaccatagcagaaacctcggcatcagtgttcaacaacgttagctgcacgagcaacaagactttcactccaaacagcaccttcaacaccaacctcaacacccttctctcctacctttcctcaaacgtaaccaacaacgttagattcttcaacgcaaccgtagggaaagattcgaacaccgtctatggcctctacatgtgccgtggagacgtgccgtttgctctatgcagagagtgtgtgggttttgcaacacaaacaataccttcgtcatgtcccacatcaaaagaagctgtgatttggtacaacgagtgtttgttgcgctactcttacaggttcatcttctctaaaatggaagagtggccaaggcacaagatcaatattccattgggggatcctgtggttttgcatagtaatggattctacactgcgttaggatccattttcgatgaattaccaaataaagcagcactggatcttagtgagtctaatggatatgccgttaagcaagaaaatgcttctggcagtgtaacactgtatggtctcgcgcagtgcacgccggacttggctgccggagactgcaaactgtgtgttgccgatgcggtggccgagtttgtcaagtcttgttgcggagggagcataggggcgagtgttctgtttcccagttgcattgtaaggtatgagacgtatccgttttatcagcattcgggaacctctgcgccaacaatgattcagcgtaaaaatattggaactgaagtgcttgtgatcgttgttgtcttgcttgtggttttggcgatgctttttggctttggctattgtttcatccggataaaagcgagaaagaaacgcaaggccagtgacagagaaaactttgggccagaactcactgtcttggagtctttggaatttgatttggctacaattgaagcagccacaaacaagttttctgaagaccgcaggataggcaaagggggttatggagaagtctacaagggaatccttcctaacggagaagaagtagctgtaaagagattatcaacaaattctaagcaaggaggggaggaattcaaaaatgaagtgttgttaatagccaaacttcaacacaaaaatttggtgagattaataggattttgccaagaagacagagagaaaatacttatctatgagtatgtgcctaacaagagtcttgaccacttcttatttgattcccaaaagcacagacaattaacttggccggagcggtttaaaatcgtaaaaggaattgcaagaggtattctttatctacatgaagattctcgtcttaagattatacaccgtgatatcaaaccaagcaatgttctattggacaatggcatcaatccaaaaatctctgattttggaatggcaaggatggtagctacagaccaaattcaaggatgcacgaatagagttgtgggcacatatggttatatgtctcctgaatatgcaatgcatggacaattttctgagaagtctgatgtattcagttttggagttatggttcttgagattattagtggcaagaagaactcttgttcttttgaatcatgtcgtgttgatgacctattgagttatgcatggaataactggagggatgaatcaccatatcaattgctggattcaactctgctagaatcttatgttccaaacgaagtggaaaagtgtatgcagattggtttattgtgtgtgcaagaaaatccagatgacaggccaacaatgggaacaattgtttcatatcttagcaatccttcatttgaaatgccattccctctagaaccagcattttttatgcatggcagaatgagaagacattcagctgaacatgaatcatcttcaggttactacaccaatcatccttcctcgtcctctgtgaataagatgtctacgactgctttc

SEQ ID NO: 1164 - protein, 655 aa, Glycine max
  Glyma20g27770.1
MITKSKQSLTLFLLCTLLLTIAETSASVFNNVSCTSNKTFTPNSTFNTNLNTLLSYLSSNVTNNVRFFNATVGKDSNTVYGLYMCRGDVPFALCRECVGFATQTIPSSCPTSKEAVIWYNECLLRYSYRFIFSKMEEWPRHKINIPLGDPVVLHSNGFYTALGSIFDELPNKAALDLSESNGYAVKQENASGSVTLYGLAQCTPDLAAGDCKLCVADAVAEFVKSCCGGSIGASVLFPSCIVRYETYPFYQHSGTSAPTMIQRKNIGTEVLVIVVVLLVVLAMLFGFGYCFIRIKARKKRKASDRENFGPELTVLESLEFDLATIEAATNKFSEDRRIGKGGYGEVYKGILPNGEEVAVKRLSTNSKQGGEEFKNEVLLIAKLQHKNLVRLIGFCQEDREKILIYEYVPNKSLDHFLFDSQKHRQLTWPERFKIVKGIARGILYLHEDSRLKIIHRDIKPSNVLLDNGINPKISDFGMARMVATDQIQGCTNRVVGTYGYMSPEYAMHGQFSEKSDVFSFGVMVLEIISGKKNSCSFESCRVDDLLSYAWNNWRDESPYQLLDSTLLESYVPNEVEKCMQIGLLCVQENPDDRPTMGTIVSYLSNPSFEMPFPLEPAFFMHGRMRRHSAEHESSSGYYTNHPSSSSVNKMSTTAF

SEQ ID NO: 1165 - DNA, 1998 bp, Glycine max
  Glyma20g27800.1
atgggttcttttcattttttccttctgctcctaactttcttttccctctttgttcacacctctccctcccctatcatccaagcagctatcgatcaaggtaccaaagcctactataactgcacaaggaacagcacttttgctgcctatagctcttaccgttctaacgtcaaaacacttctagattttctctcctccaatagcaccaacaatgccagattctacaacactacagtttctagcaaagacactgtttacggtagcttcctatgtagaatagacaccactccaaaacactgccaagaatgcgtgacacaagctgccaaactcatatcatcgctttgcaaaaatgctacagaggctatagtatggtaccaagtatgctatgtgcgctactccgatcgtcgtttcttctccaccgtggaggagagtcctaaactctcctttatgaatgataaagattatgtgggtaacgttgggctcttcaacaacattgtgtgggatatgatgaacgatttgagaagtgaagcagcaagtgctgctaataaatcggctgataagtctgtgaacatcattgataatgaaaaggtatatggctacgcttggtgcctcccatatctgtccaaagagaactgcagctggtgtcttagcgatgccatagcagaaattccaactggttgctgcagaggaaaatctgggggaacaataatatatcccagttgtggtgttagatacgaatcatatcaattccataaggcacaaatcaggggtggttcggtgacgccgccgccacttcccagtagtccttccccttttgcttcaccagggaaaagaaaacaaaagacactaacaataattgtgattgtagttccaattgttgtttcactggtgcttctatctttgggctgctgctgctttttacatagaaaagcaacaaagaatcaacatgatattctcaaagaaaactttgggaatgacagtaccactctggaaaccttgcgatttgaattagccaaaattgaagctgctacaaacagatttgctaaggaaaacatgataggcaaaggcggatttggagaggtttataggggtattcttttggatgggcaagaaatagcagtgaagaggcttactggaagctcccggcaaggagcagtggagtttaaaaacgaggttcaggttatagcaaagcttcaacacagaaatttagtaaggttactaggattttgcttagaagatgatgaaaagatacttatttatgagtatgtgccaaacaagagccttgactattttttattggatgccaagaagagaagactactatcttggtctgaacgtcaaaagatcattataggaattgctcgaggaattctatatctacatgaggattcttgcctcaaaataatacatcgtgatttaaaacctagtaatgttttgctagacagtaatatgattcccaaaatatcagattttggcatggctagaattgttgctgcagatcaaattgaagaaagtacgggcagaattgtagggacatatggttatatgtcccccgagtatgcaatgcatggacaattttctgtgaagtccgatgtgtttagttttggagtcatggttctagagattattaatggaaagaggaaaggttgttcttctgaatcagatggtattgatgacatccggagacatgcttggacgaaatggacagagcaaacaccattggaactattggatcctaacataggaggaccatattccggagaagaagtcatcaaatgcatacacattggtctgttatgcgttcaagaagatccaaatgatagacctacaatggcaacagttgtgttttacctcaacagcccttcaatcaacttgcctccccctcgtgaaccaggatattttaagcgcgatagaatacaagacaacaagacgacccacaaagaattggataatatcagtgattccatcaacggaatttctttaactaatttctttcctcgt

SEQ ID NO: 1166 - protein, 666 aa, Glycine max
  Glyma20g27800.1
MGSFHFFLLLLTFFSLFVHTSPSPIIQAAIDQGTKAYYNCTRNSTFAAYSSYRSNVKTLLDFLSSNSTNNARFYNTTVSSKDTVYGSFLCRIDTTPKHCQECVTQAAKLISSLCKNATEAIVWYQVCYVRYSDRRFFSTVEESPKLSFMNDKDYVGNVGLFNNIVWDMMNDLRSEAASAANKSADKSVNIIDNEKVYGYAWCLPYLSKENCSWCLSDAIAEIPTGCCRGKSGGTIIYPSCGVRYESYQFHKAQIRGGSVTPPPLPSSPSPFASPGKRKQKTLTIIVIVVPIVVSLVLLSLGCCCFLHRKATKNQHDILKENFGNDSTTLETLRFELAKIEAATNRFAKENMIGKGGFGEVYRGILLDGQEIAVKRLTGSSRQGAVEFKNEVQVIAKLQHRNLVRLLGFCLEDDEKILIYEYVPNKSLDYFLLDAKKRRLLSWSERQKIIIGIARGILYLHEDSCLKIIHRDLKPSNVLLDSNMIPKISDFGMARIVAADQIEESTGRIVGTYGYMSPEYAMHGQFSVKSDVFSFGVMVLEIINGKRKGCSSESDGIDDIRRHAWTKWTEQTPLELLDPNIGGPYSGEEVIKCIHIGLLCVQEDPNDRPTMATVVFYLNSPSINLPPPREPGYFKRDRIQDNKTTHKELDNISDSINGISLTNFFPR

SEQ ID NO: 1167 - DNA, 1965 bp, Glycine max
  Glyma10g39900.1
atgtgcatattcgaatcctcttcaacccacttgctacttctctctctctttgccttgctaaactctgcaagtgaagcaactcctatttataccgcacatgcctgcacagatggatcctattacttacccaacacaccattccaaaccaacttgaacctcctcctctcatccctcgtctccagcgccaccctccacgacggattccaccgcaccaccatcgacgatgtcaagggactcttcctctgccgcggcgacgccaccccctccgcctgtcacgactgcgtcaccgccgcggccaaaaatatcacagacctctgcaccaaccaaacagagtccataatctggtacgaccactgtatgctgcgttactccaacagctccattctcaacaacatagttccaagttttggcctcggtaacgaaccgagcgtccctgactcggaccacacacggttcaacgatgttcttgcgcccacgttgaacgatgcggcacgggaagccgtgaattcgagtaagaagtttgctacaaaagaagcgaatttcacgagctccatgaagctctacacactggcgcagtgcacgcccgatttgtccacttctgagtgcaacacgtgcttcgcaagctccatcggtgcctttccgaattgctgtgacggcaaacgaggtgcacgggtcctgcttccgggctgtagtgtcagatatgaattgtttccattttacaacgtttccaccgtttcccgccttccctctccgtcttcagggaaaagcagtatctctataattttggcgatcgttgtcccaattacagttgcaattctacttttcattgttggcgtctacttcctacgtaagagggcaagcaagaagtataatactttcgtccaggattcaattgcagatgatcttacagatgtcggtgatgtggagtccttgcaattcgacttgcctacagttgaagctgccacaaacagattctcggatgagaacaagattggccaaggtggatttggggtggtttataagggtgtcctccctagcggacaggagatagctgtgaagaggttgtcagtaacctccttgcagggtgctgtagagttcaggaatgaagctgctcttgtggccaagcttcaacatagaaatttagtgagactattgggattttgcttggagggacaagagaagatccttatctatgaatacataccaaacaaaagtcttgattactttttatttgaccctgcaaagcaaaaagagttagattggtcaagacgctacaaaattatagttggtattgctcgaggaattcagtatttacatgaagattcccaacttagaattatacaccgggatgtcaaagctagtaatgttctattagatgaaaatatgaacccaaagatttcagattttggtatggcaaaaattttccaggcagatcagactcaagtaaatacaggaaggatagttgggacttatggttacatgtctccagaatatgcaatgcgtggacagttctctgtgaaatcagatgtgttcagctttggtgtcttagttttggagattgtgagtggcaagaagaacactgacttttatcaatcgaatcatgctgatgaccttttaagccatgcgtggaagaattggacactgcagacacctctggagttgctggatccaacactgagaggttcttattcaagaaatgaagtcaacagatgcatccatattggtttattgtgtgttcaagaaaatccatctgataggccttcgatggccactattgcacttatgctgaacagttattcagttaccatgtcaatgccacaacaaccagcatcttttctgcgtggaagaggtcctaacaggttaaaccaagggatggactctgatcagtctaccaccgatcagtctacgacttgttcaattccatggtctgtgaatgaagtatccattactgatgtataccctcgc

SEQ ID NO: 1168 - protein, 655 aa, Glycine max
  Glyma10g39900.1
MCIFESSSTHLLLLSLFALLNSASEATPIYTAHACTDGSYYLPNTPFQTNLNLLLSSLVSSATLHDGFHRTTIDDVKGLFLCRGDATPSACHDCVTAAAKNITDLCTNQTESIIWYDHCMLRYSNSSILNNIVPSFGLGNEPSVPDSDHTRFNDVLAPTLNDAAREAVNSSKKFATKEANFTSSMKLYTLAQCTPDLSTSECNTCFASSIGAFPNCCDGKRGARVLLPGCSVRYELFPFYNVSTVSRLPSPSSGKSSISIILAIVVPITVAILLFIVGVYFLRKRASKKYNTFVQDSIADDLTDVGDVESLQFDLPTVEAATNRFSDENKIGQGGFGVVYKGVLPSGQEIAVKRLSVTSLQGAVEFRNEAALVAKLQHRNLVRLLGFCLEGQEKILIYEYIPNKSLDYFLFDPAKQKELDWSRRYKIIVGIARGIQYLHEDSQLRIIHRDVKASNVLLDENMNPKISDFGMAKIFQADQTQVNTGRIVGTYGYMSPEYAMRGQFSVKSDVFSFGVLVLEIVSGKKNTDFYQSNHADDLLSHAWKNWTLQTPLELLDPTLRGSYSRNEVNRCIHIGLLCVQENPSDRPSMATIALMLNSYSVTMSMPQQPASFLRGRGPNRLNQGMDSDQSTTDQSTTCSIPWSVNEVSITDVYPR

SEQ ID NO: 1169 - DNA, 1983 bp, Glycine max
  Glyma20g27700.1
atgatggaagataaagcgccagaaccaaaactgctaaacaattgttacgcacatgcctgctcggatgaaggatcccattaccgacccaacacaacattcgaaaccaacctcaacatccttctctcatccctcgtctccaacgccaccctccaccacggtttctaccgcacaaacgtctcccttggaacctccgatgaggtcaagggactcttcctctgccgcggtgacgtcaccccctccctctgtctcgactgcgtcaccgccgcagcaaaaaacatcacaaacttctgcaccaaccagacacagtccataatctggtacgacgagtgtatgctgcgttactccaacagttccaccctcgacaacatagtcccaagtgtcggcatgaagaacgaacagagcgtctccgactcggactacgcgcggttcaacgatgttcttgcgtccacgttaaatgatttaaagcaggaggccttgaactcttcttcttcgggtaagaagtttgctacaaaagaagcgaatttcacgagctcaatgaagctctacaccctggcgcagtgcacgcccgatttgtccacttctgactgcaacacgtgcttctcaagctccatcggtggctttccgaactgctgtgacggcaaacgaggtgcacgggtcctgcttcctggctgtagtgtcagatatgaactgtatcccttttacaatgtttcctccgtgtctcaccttccctctccatcttcagggaaaagcagtatctctataattgtggcaattgttgtcccaattgtttttgtgattcttctattcattgttggcgtctacttcctatgtaaaagggcaagcaagaagtataatacttttgtccaggattcaagtaatctctccttctccgtcctagcaattgttccggttgcggatgatcttaccgatgtcggcgatgtggagtccttgcagttcgacttggctacagttgaagctgccacagacagattctcagatgagaacaagattggccaaggtggatttggggtggtttataagggtgtcttccctaacggacaggagatagctgtgaagaggttgtcagtaacctccttgcagggtgctgtagagttcaggaatgaagctgctcttgtggccaagcttcaacatagaaatttagtgagactattgggattttgcttggagggacaagagaagatccttatctatgaatacataccaaacaaaagccttgatcgctttttatttgaccctgtaaagcaaagagagttagattggtcaagacgctacaagattattgttggcattgctcgaggaattcagtatttacacgaagattcccagcttagaattatacaccgtgatctcaaagctagtaatgttctattagatgaaaatatgaacccgaagatttcagattttggcatggcaaaaattttccaggcagatcagactcaagtaaatacaggaaggatagttgggacttatggttacatgtctccagaatatgcaatgcgtggacagttctctgtgaaatcagatgtgttcagctttggtgtcttagttttggagattgtgagtggcaagaagaacactgagttttatcaatcgaatcatgctgatgaccttttaagccatgcttggaagaattggacagagaaaacacctttggagttgctggatccaacactgagaggttcttattctagaaatgaagtcaacagatgcatccatattggtttattgtgtgttcaggaaaatccatctgacaggccttcgatggccactattgcacttatgctgaacagttattcagttaccatgtcaatgccacgacaaccagcatctcttctgcgcgggagaggtcctaacaggttaaaccgagggatggactctgattcgtctacctccaatcagtctaccacttgttcaattgcatggtctgtgaatgaagtatccattactgatttataccctcgc

SEQ ID NO: 1170 - protein, 661 aa, Glycine max
  Glyma20g27700.1
MMEDKAPEPKLLNNCYAHACSDEGSHYRPNTTFETNLNILLSSLVSNATLHHGFYRTNVSLGTSDEVKGLFLCRGDVTPSLCLDCVTAAAKNITNFCTNQTQSIIWYDECMLRYSNSSTLDNIVPSVGMKNEQSVSDSDYARFNDVLASTLNDLKQEALNSSSSGKKFATKEANFTSSMKLYTLAQCTPDLSTSDCNTCFSSSIGGFPNCCDGKRGARVLLPGCSVRYELYPFYNVSSVSHLPSPSSGKSSISIIVAIVVPIVFVILLFIVGVYFLCKRASKKYNTFVQDSSNLSFSVLAIVPVADDLTDVGDVESLQFDLATVEAATDRFSDENKIGQGGFGVVYKGVFPNGQEIAVKRLSVTSLQGAVEFRNEAALVAKLQHRNLVRLLGFCLEGQEKILIYEYIPNKSLDRFLFDPVKQRELDWSRRYKIIVGIARGIQYLHEDSQLRIIHRDLKASNVLLDENMNPKISDFGMAKIFQADQTQVNTGRIVGTYGYMSPEYAMRGQFSVKSDVFSFGVLVLEIVSGKKNTEFYQSNHADDLLSHAWKNWTEKTPLELLDPTLRGSYSRNEVNRCIHIGLLCVQENPSDRPSMATIALMLNSYSVTMSMPRQPASLLRGRGPNRLNRGMDSDSSTSNQSTTCSIAWSVNEVSITDLYPR

SEQ ID NO: 1171 - DNA, 1977 bp, Glycine max
  Glyma20g27720.1
atgttaaacttgaaatcctcttcatcccacttgctactcctctttctcttcaccttggtgaccattgcaagtgaagcagcagctcctatatacagcgcacatgcctgcacagatgatggaccattttaccaacccaacacaacataccaaaccaacttgaagctcctcctctcttccctcgtctccaacgccaccctccaccagggcttcttcctcaccaacatctccctcggaaaccccgatgaggtcaagggactcttcctctgccgcggtgacgtcaccccctccgtctgtcacgactgcgtcgccgccgcggcaaccaacatcacagacctctgcaccaaccaaacagagtccgtgatctggtatgaccagtgtatgttgcgctactccaacctttccttcctcaacaacatagtccctggagttaacttgaattccgaacagaacgtctctgactccaacaataccggcttcatcaattttcttgcgtccacgttgaatggtctggcacaggaagccgtgaattctctttccgggaagaagtttgctacaaaagaagcgaatttcacgagctcgatgaaggtctacaccttggcgcagtgcaggcctgatttgtccacctttgactgtaacatgtgcttcacaagtgccataagtaacctcggtgatggcaaacgaggtgcacgatctctgcttccgagttgtaatgtcagatatgaattgtaccctttttacaatgtttccgcagtgtcctctcacccagccccagaccttccccctcctccatcttcagggaaaaacagtatctctataatcgtgccaattgttgtcccaattgtcgttgtgattgtacttttcattgttggagtctgcttcctacgtaagagggcaagcaagaagtataacacttttgtccaggattcaattgtggatgatcttaccgatgtggagtccttgcaatttgatttggctacaattgaagctgccacgaatggattctcggatgagaacaagattggccaaggtggatttggtgtggtttataagggtatcctccctaacagacaggagatagctgtgaagaggttgtcagtaacctccttgcagggtgcagtagagttcagaaatgaagctgcccttgtggccaagcttcaacatagaaatttagtgagactgttgggattttgcttggaggggagggagaagatccttatctatgaatacataacaaacaaaagccttgatcactttctatttgaccctgtgaagcaaagagagttagattggtcaagacgctacaatattatagttggcattgctcgaggaattctttatttacatgaagattcccaacttagaattatacatcgtgatctcaaagcgagcaatgttttattagatgaaaatatgaacccaaagatttcagattttggcatggcaaagatttttcaggcagaccagactcaagtaaatacaggaaggatagtagggacttttggttacatgtctccagaatatgcaatgcgtgggcagttctctgtgaaatcagatgtgttcagctttggtgtcttagttttggagattgtgagtggcaagaagaacacggatttttatcaaccgaatcaagctgatgatctcttaagctatgcttggaagaattggacagagcaaacacctttgcagttgctggatccaactctgagaggttcttattcaagaaatgaagtaaacagatgcatccatattggtttattatgtgttcaggaaaatccatctgacagaccttcgatggccaccattgcacttatgctgaacagttattcagttaccttgtcaatgccacgacaaccagcatcttttctgcgcggaagaaatcctaacaggctaaaccaagggcttgactctgatcagtctaccacttgttcaattccatggtctgtgaatgaagtatccattacagacatataccctcgc

SEQ ID NO: 1172 - protein, 659 aa, Glycine max
  Glyma20g27720.1
MLNLKSSSSHLLLLFLFTLVTIASEAAAPIYSAHACTDDGPFYQPNTTYQTNLKLLLSSLVSNATLHQGFFLTNISLGNPDEVKGLFLCRGDVTPSVCHDCVAAAATNITDLCTNQTESVIWYDQCMLRYSNLSFLNNIVPGVNLNSEQNVSDSNNTGFINFLASTLNGLAQEAVNSLSGKKFATKEANFTSSMKVYTLAQCRPDLSTFDCNMCFTSAISNLGDGKRGARSLLPSCNVRYELYPFYNVSAVSSHPAPDLPPPPSSGKNSISIIVPIVVPIVVVIVLFIVGVCFLRKRASKKYNTFVQDSIVDDLTDVESLQFDLATIEAATNGFSDENKIGQGGFGVVYKGILPNRQEIAVKRLSVTSLQGAVEFRNEAALVAKLQHRNLVRLLGFCLEGREKILIYEYITNKSLDHFLFDPVKQRELDWSRRYNIIVGIARGILYLHEDSQLRIIHRDLKASNVLLDENMNPKISDFGMAKIFQADQTQVNTGRIVGTFGYMSPEYAMRGQFSVKSDVFSFGVLVLEIVSGKKNTDFYQPNQADDLLSYAWKNWTEQTPLQLLDPTLRGSYSRNEVNRCIHIGLLCVQENPSDRPSMATIALMLNSYSVTLSMPRQPASFLRGRNPNRLNQGLDSDQSTTCSIPWSVNEVSITDIYPR

SEQ ID NO: 1173 - DNA, 2097 bp, Vitis vinifera
  GSVIVT01006430001
atggcaatcctctcagaacgaacaattgtactactcttctttctttcttctcttatcatacatggaagcccaaagcctaccctcctctacagcttttgtactgaaaattccaactatgtccccaatagcacttaccagagtagcctcaacgtcctcctcacttccctgtcgtcagatgctacaatacttaacggccgcaaattccacaacacgaccgcaggccaagcgccagacatggtatatggcctctacttatgcaggggagatgtcacagacgcagtatgccaggactgcgtccagactgcaagtcaagagatcctgaccaagtgtcccaacagaaaagaggcactaagttggtacgaccagtgcatgttgcggtactccaaccgatcaatcttctcaatcatggaagaaaggccaatgttgactatgtctaactcactcgatatggatgacccagataggtttgatcagattgtgaataaaaccatggtgggtttgattgaaaaggctacccataattcttctgagagggacatgtttgagactggagaagcaaattttaatgcgtccaccaagatatatggcttggtgcagtgcacaccagatttatccggcagtaattgtagtacgtgcctcgagaatattttttctcgtattaccaattgttgccttgggaagcaaggggccaggattctagttcccagctgcaacttcaggtacgagttgtaccctttctatggggacttagcagcagctacaccacctgcacctgcaccttcacctctgtcacttctgtcacctccaggtaaaaagggaaactcgtcccaacttctaattgctatcattgttccagtagcgggcacattgataatctctggcttcctctgctattgttggctaaataggaaaaggtggaatatcttcacaaacaattatcatcatagttattccaataatctctctgtggtgatcttttctattctatgctactgtttcatatgcaggaaagcaaagaagaaatacagttctacagaagaggaaaaagttgagaatgatatcaccactgtgcagtcattgcaatttgattttggcacacttgaagctgctacaaataacttctctgatgataacaagattggtgaaggtggatttggtgatgtgtacaagggtacactttctagcggaaaagaaattgctataaagaggctatctagaagctctgcccaaggcgcagtagaattcaagaatgaggttgtattggtagccaagcttcaacacagaaacctagtgaggttattgggattttgcttggaaggggaagagaagatacttgtctatgaatatgtgcccaacaaaagccttgactgctttctgtttgatcctgataaacaaggacaactggattggtcaagacggtataagattattggaggaatagctcgagggattctttaccttcatgaagattctcagctcaaagttatacaccgtgatctaaaagccagcaatgttttgttagatggtgatatgaacccaaaaatttcagattttggcatggcaaggatttttggaggagaccaaactcgaggaagtaccaaaagagttgttggcacatatggctacatgtctccagagtatgcaatgcgtggacacttctctgccaagtcagatgtatacagtttcggtgtcctagttttggagataataagtggcaagaagatcagtcatttctacgaatcagaccaaactgaggaccttctaggctatgcatggaaactttggagggatggtacacccctggaattgatggacccgatcatgagggactcttatgcaagaaatgaagtcattagatgcatccatatgggtttattatgtgttcaagaagatcctgatgacagaccatccatggcatcagtagtcctcatgctcagcagttactctgttactctaccattgcctcaacaaccagcattcttcattggcagtggaacgcaatcaggctttccaataaaggcagaatcagatcaatctacaagcaagtcaacgccatggtctgtgaatgaaacatcgattagtgaactatatcctagg

SEQ ID NO: 1174 - protein, 699 aa, Vitis vinifera
  GSVIVT01006430001
MAILSERTIVLLFFLSSLIIHGSPKPTLLYSFCTENSNYVPNSTYQSSLNVLLTSLSSDATILNGRKFHNTTAGQAPDMVYGLYLCRGDVTDAVCQDCVQTASQEILTKCPNRKEALSWYDQCMLRYSNRSIFSIMEERPMLTMSNSLDMDDPDRFDQIVNKTMVGLIEKATHNSSERDMFETGEANFNASTKIYGLVQCTPDLSGSNCSTCLENIFSRITNCCLGKQGARILVPSCNFRYELYPFYGDLAAATPPAPAPSPLSLLSPPGKKGNSSQLLIAIIVPVAGTLIISGFLCYCWLNRKRWNIFTNNYHHSYSNNLSVVIFSILCYCFICRKAKKKYSSTEEEKVENDITTVQSLQFDFGTLEAATNNFSDDNKIGEGGFGDVYKGTLSSGKEIAIKRLSRSSAQGAVEFKNEVVLVAKLQHRNLVRLLGFCLEGEEKILVYEYVPNKSLDCFLFDPDKQGQLDWSRRYKIIGGIARGILYLHEDSQLKVIHRDLKASNVLLDGDMNPKISDFGMARIFGGDQTRGSTKRVVGTYGYMSPEYAMRGHFSAKSDVYSFGVLVLEIISGKKISHFYESDQTEDLLGYAWKLWRDGTPLELMDPIMRDSYARNEVIRCIHMGLLCVQEDPDDRPSMASVVLMLSSYSVTLPLPQQPAFFIGSGTQSGFPIKAESDQSTSKSTPWSVNETSISELYPR

SEQ ID NO: 1175 - DNA, 2376 bp, Vitis vinifera
  GSVIVT01034326001
atggcaatcctctcagaacgaacaattgtgctactcttctttctttcttctcttatcatccatggaagcccaaagcctaccctcctctacaaattttgtactgaaaattccaactatgtccccaatagcacttaccagagtagcctcaacctcctcctcacttccctgtcgtcagatgctacaatacttaacggccgcaaattccacaacacgaccgcaggccaagcgccagacatggtatatggcctctacttatgccggggagatgtcacagatgcagtatgccaggactgcgtccagactgcaagtcaagagatcctgaccaagtgtcccaacagaaaagaggcactaagttggtacgaccagtgcatgtttcggtactccaatcgatcaatcttctcaatcatggaagaaaggccaagtttgattagttttgactcactcgatatggaggacccagataggtttgatcagattgtgaatgaaaccatggtgggtttgattgaaaaggctacccataattcttttgagagggacatgtttgagactggagaagcaaattttaatgcgtccaccaagatatatggcttggtgcagtgcacaccagatttatccggcagtaattgtagtacgtgcctcgagaatattctttctcgtattaccaattgttgccttgggaagcaagggggcaggattctagttcccagctgcaacttcaggtacgagttgcatccattctatggggacttagcagcagctacaccacctgcaccttcacctctgtcacctctgtcacctccaggtaaaaagggaaactcttcccaacttctaattgctatcattgttccagtagcgggcacattgataatttctggcttcctctgctattgttggctaaagaggaaaaggaaagcaaagaagaaatacaattctacagaagaggaaaaagttgagaatgatatcaccactgtgcagtcattgcaatttgattttggcacacttgaagctactacaaataacttctctgatgataacaagattggtgaaggtggatttggtgatgtgtacaagggtacactttctagcggaaaagaaattgctataaagaggctatctagaagctctgcacaaggcgcagtagaattcaagaatgaggttgtattggtagccaagcttcaacacagaaacctagtgaggttattgggattttgcttggaaggggaagagaagatacttgtctatgaatatgtgcccaacaaaagccttgaccactttctgtttgaccctgataaacaaggacaactggattggtcaagacggtataagattattggacgaatagctcgagggattctttaccttcatgaagattctccgctcaaagttatacaccgtgatctaaaagccagcaatgttttgttagatggtgatatgaacccaaaaatttcagattttggcatggcaaggatttttggagtagatcaaactcgaggaagtaccaaaagagttgttggcacatatggctacatgtctccagagtatgcaatgcatggacacttctctgccaagtcagatgtatacagtttcggtgtcctagttttggagataataagtggcaagaagaacagttgtttctacgaatcaggccaaactgaggaccttctaagctatgcatggaaactttggaggaatggtacacccctggaattgatggacccgatcatgggggactcctatgcaagaaatgaagtcattagatgcatccatatgggtttattatgtgttcaagaagatcctgaggacagaccatccatggcatcagtagtcctcatgctcagcagttactctgttactccaccattgcctcaacaaccagcattctgcattggcatttgtcggactgtccgtccgtctatggcgattatgtcagattctggcactgagatcttggttccggcctgcgccatcattgggataatcttttttgtggttcagtggattctggtctctcgcgtcaagctttctccaaagcggcactcaaccactctagaggcaaggaagggtgttaggaaggcttttatcactgcatttagatctggtgcagtcatgggtttccttcttgctgcaaatggtcttttggtcctctatattgccaacaacctcttcaagatatactatggtgatgattgggaaggcctttttggggctataactagttatggccttgatggttcttccatggctctctttggcagagtaggtggaggaatctatacaaaagctactgatgtcggtgcaaatcctcatgggcatctttggtttggaaatatcaggaaaactagaatgatgagaaaaacaaaaaagattggtcacctt

SEQ ID NO: 1176 - protein, 792 aa, Vitis vinifera
  GSVIVT01034326001
MAILSERTIVLLFFLSSLIIHGSPKPTLLYKFCTENSNYVPNSTYQSSLNLLLTSLSSDATILNGRKFHNTTAGQAPDMVYGLYLCRGDVTDAVCQDCVQTASQEILTKCPNRKEALSWYDQCMFRYSNRSIFSIMEERPSLISFDSLDMEDPDRFDQIVNETMVGLIEKATHNSFERDMFETGEANFNASTKIYGLVQCTPDLSGSNCSTCLENILSRITNCCLGKQGGRILVPSCNFRYELHPFYGDLAAATPPAPSPLSPLSPPGKKGNSSQLLIAIIVPVAGTLIISGFLCYCWLKRKRKAKKKYNSTEEEKVENDITTVQSLQFDFGTLEATTNNFSDDNKIGEGGFGDVYKGTLSSGKEIAIKRLSRSSAQGAVEFKNEVVLVAKLQHRNLVRLLGFCLEGEEKILVYEYVPNKSLDHFLFDPDKQGQLDWSRRYKIIGRIARGILYLHEDSPLKVIHRDLKASNVLLDGDMNPKISDFGMARIFGVDQTRGSTKRVVGTYGYMSPEYAMHGHFSAKSDVYSFGVLVLEIISGKKNSCFYESGQTEDLLSYAWKLWRNGTPLELMDPIMGDSYARNEVIRCIHMGLLCVQEDPEDRPSMASVVLMLSSYSVTPPLPQQPAFCIGICRTVRPSMAIMSDSGTEILVPACAIIGIIFFVVQWILVSRVKLSPKRHSTTLEARKGVRKAFITAFRSGAVMGFLLAANGLLVLYIANNLFKIYYGDDWEGLFGAITSYGLDGSSMALFGRVGGGIYTKATDVGANPHGHLWFGNIRKTRMMRKTKKIGHL

SEQ ID NO: 1177 - DNA, 1845 bp, Vitis vinifera
  GSVIVT01038006001
atggccattttctcagaacgagcaattgtgctactcttctttctttcttctcttatcatccatggaagcccaaagcctgacctcttctacagcctttgtactgaaaatggcaactatgaacccaatagcacttaccagtataacctcaacctcctcctcacttccctgtcgtcaaatgctgcaacacttaacggccgcaaattccacaaccagacggcaggccaagcgccagacatggtatatggcctctacctatgcaggggggatgtcacagacgcagtatgccagaactgcgtccagactgcaagtcaagagattctgaccaagtgtcccaacagaaaagaggtaatcagttggtacgaccagtgcatgtttcggtactccaaccgatcaatcttctcaataatggaagaaaggccaagtgtgactgggtctaacgaattggagatggaggacccagataggtttgatcagattgtgaatgaaaccatggtgggtatgattgaaaaggctacctataattcttctgagagagacatgtttgagactggagaagcaaaatttaatgcgtccaccaagatatatggtttggcgcagtgcacaccagatttatccggcagcgattgtaggaggtgccttgaaaatattttttctcgtattcctaattgttgctatgggaagcaaggggccaggattctaggaccaagctgcaacttcaggtacgaggtgtaccctttctatggagactttgcagctgctgcaccgcttgcaccttcacctctgtcacctccagaaggaagcaaaagtgactccacgccaagtgcttttggggaagatagtcaaagcatggactcgaccatggattcactactctttgatttgaagacacttagagctgccactaacaacttctctgatgctaataagattggtgaagggggctttggagctgtttacaagggtctactttcaagtggactagagatagctataaaaaggctctcaagaaattcagggcaagggacagaagaattcaagaatgaaattgcattacttgctaaacttcaacataggaatcttgttcgccttttggggttttgcttggaagcaaaagagaaaatactcgtctatgagtttgtgcccaataaaagcctcgactactttctatttgatactgacaaacaatcacagttggattggcctacacgacacaagattatagtgggtattgctcgaggactactttacctgcatgaggaatctaggttgaagatcattcaccgtgatcttaaagctagcaacatattattggactccaagttgaatcccaaaatttctgactttggcatggcaaggattttctttatggagcaaagtcaagcaaatacaacgaggattgtagggacatatggttacatgtctcctgagtatgcaatgcatggacaattttcagtgaagtcagatgtgttcagttttggtgttttgcttctagagatactaagcggcaagaagaatagttgtttcaacaactcagagtgcagccaggaccttctaagctatgcttggagacagtggaaggatcgaacagctctggaactgatagatccaattgtgggaggagagtattcaagaagtgaagtaatgagatgcatccatattgggttattatgtgttcaagaagatgcagctgacagacccacaatggcatcagtagctctcatgctaaacagctattctgttactctccctttgccttcaaaacccgccttcttccttcattctaaaaaggaatccaatccatccaccagcaaatctggtggcagtataggccacttcggtgtatgt

SEQ ID NO: 1178 - protein, 615 aa, Vitis vinifera
  GSVIVT01038006001
MAIFSERAIVLLFFLSSLIIHGSPKPDLFYSLCTENGNYEPNSTYQYNLNLLLTSLSSNAATLNGRKFHNQTAGQAPDMVYGLYLCRGDVTDAVCQNCVQTASQEILTKCPNRKEVISWYDQCMFRYSNRSIFSIMEERPSVTGSNELEMEDPDRFDQIVNETMVGMIEKATYNSSERDMFETGEAKFNASTKIYGLAQCTPDLSGSDCRRCLENIFSRIPNCCYGKQGARILGPSCNFRYEVYPFYGDFAAAAPLAPSPLSPPEGSKSDSTPSAFGEDSQSMDSTMDSLLFDLKTLRAATNNFSDANKIGEGGFGAVYKGLLSSGLEIAIKRLSRNSGQGTEEFKNEIALLAKLQHRNLVRLLGFCLEAKEKILVYEFVPNKSLDYFLFDTDKQSQLDWPTRHKIIVGIARGLLYLHEESRLKIIHRDLKASNILLDSKLNPKISDFGMARIFFMEQSQANTTRIVGTYGYMSPEYAMHGQFSVKSDVFSFGVLLLEILSGKKNSCFNNSECSQDLLSYAWRQWKDRTALELIDPIVGGEYSRSEVMRCIHIGLLCVQEDAADRPTMASVALMLNSYSVTLPLPSKPAFFLHSKKESNPSTSKSGGSIGHFGVC

SEQ ID NO: 1179 - DNA, 1896 bp, Vitis vinifera
  GSVIVT01015799001
atggtgtgtactgcagctaaaataaatctcaaatatatactactcattatatggtgcctaacccttagccctgccgctgctctcacttacttaaacaattcctgtccacagactccaaacacaactgctgctatcagcccaaataccacctaccaaaccaatctcaatttgcttctctcctttctttcttcaaatgctaccatcgactccggattctacaacgccaccgtggggcgggaaccttccgatgtagtttacggtctttttctctgccgaggtgatcttagccctcaactctgtcaagagtgtgtgggggctgccactaacaagtcacgcgaccagtgtcagggaataaaggcggctgttatttggtatgacgagtgcatattgcattactcaaatcagtccatcttctccacactcatagaagagccgatactgatgatgcgcaacacggtgaatctcacagacccagatggattcaatcggacactgcaaggtataatggacagcataagaactcaagctgtgaatgatcgatctggcaagaagtactatgccaccaaagaagaaaattacttagcgccacaaatggtacaaagggtgtatagcctggtgcaatgcacaccagatttatccgccacccagtgcaatctatgtcttttgggagtggaagactatcttcaagaatgctgcagtgcacgtcaaggggcaagggtcgtgtttccaagctgtagttttagatatgaattttatcctttctacacagctgaggcaggggccgaagcaccagctcctacacctctgcttcttcctcctgctccaccttcacaacccaccactgaaggaaaaggtggaatatcttcacaaacaattatcaccattgttgttccaacagttgtctctgtggggatcttttatattttatgctactgcttcataagcaggaaagcaaggaagaaatacaatacagaagaggaaaatgtggagaatgatatcacgaccgtgcagtcattgcaatttgattttggtacacttcaagctgctacaaataacttctctgatgataacaagattggtcaaggtggatttggtgatgtatacaagggtacactttctagtggtcaagaaattgctataaagaggctatctagaagttcagtgcaaggtgcagtagaattcaagaatgagattgtgttggtagccaagcttcaacacagaaacctagtgaggttattgggattttgcttggaaggggaagagaagatacttgtctatgaatatgtgcccaacaaaagccttgactgctttgtgtttgatggtgatatgaacccaaaaatttcggattttggcatggcaaggattgttggagtagatcaaactcaaggaaataccaacagagttgttggcacatatggctacatgtctcctgagtatgcaatgcgtggacacttctctgctaagtcagatgtatacagttttggtgtcctcgttttggagataataagtggcaagaagaacggtagcttctatgaatcaggccaaactgagggccttccaagctatgcatggaaactttggagggatggtacacccctggaattgatggacccaatgatgggggactcttacgcaagaaatgaagtcattagatgcatacatatgggtttattatgtgttcaagaagatcctgatgacagaccatccatggcatcagtagtcctcatgctcagcagttactctgttactctaccattgcctcaacaaccagcattcttcattcgcagtgggacgcagtcgggctttccaataaatgcactggaatcagatcaatctgcaagcaagtcaacgccatggtctctgaatgaaacatcgatttctgaactatatcctagg

SEQ ID NO: 1180 - protein, 632 aa, Vitis vinifera
  GSVIVT01015799001
MVCTAAKINLKYILLIIWCLTLSPAAALTYLNNSCPQTPNTTAAISPNTTYQTNLNLLLSFLSSNATIDSGFYNATVGREPSDVVYGLFLCRGDLSPQLCQECVGAATNKSRDQCQGIKAAVIWYDECILHYSNQSIFSTLIEEPILMMRNTVNLTDPDGFNRTLQGIMDSIRTQAVNDRSGKKYYATKEENYLAPQMVQRVYSLVQCTPDLSATQCNLCLLGVEDYLQECCSARQGARVVFPSCSFRYEFYPFYTAEAGAEAPAPTPLLLPPAPPSQPTTEGKGGISSQTIITIVVPTVVSVGIFYILCYCFISRKARKKYNTEEENVENDITTVQSLQFDFGTLQAATNNFSDDNKIGQGGFGDVYKGTLSSGQEIAIKRLSRSSVQGAVEFKNEIVLVAKLQHRNLVRLLGFCLEGEEKILVYEYVPNKSLDCFVFDGDMNPKISDFGMARIVGVDQTQGNTNRVVGTYGYMSPEYAMRGHFSAKSDVYSFGVLVLEIISGKKNGSFYESGQTEGLPSYAWKLWRDGTPLELMDPMMGDSYARNEVIRCIHMGLLCVQEDPDDRPSMASVVLMLSSYSVTLPLPQQPAFFIRSGTQSGFPINALESDQSASKSTPWSLNETSISELYPR

SEQ ID NO: 1181 - DNA, 1569 bp, Vitis vinifera
  GSVIVT01036853001
atgagacagtcagacagcggtaatatcacagagccagaccagtttaatcaggtgctgggagacaccttagactccataaggactcaagctgtgaatgatcaatctggcaagaagtttgccactaaagaagaaaatttcacaggatttcaaagggtgtacagcctagtgcagtgcacacctgatttatctccagaccaatgcgatcggtgtctcataggaaccattgcaatcctccctgattgctgcggtggcaaacagggggcaagggtcctgtttccaagctgcaacgttcggtatgagttgtacccattctaccagagtgtggccgcaccaccatctcctccgccggctcgaccttcagaaccaagcactgaaggaaaaggtggaatatcttcaaaaacaattgtcatcatagttgttccaacgtttgtctctgtggtgatcttctctattctatgctactgtttcatacgtaggtgtgctaagaagagatacgatactttagaagcggaaaatgttgagttcaatatcaccaccgagcagtcattgcaatttgatttggctacaattcaagctgctacaaataacttctctgaccataacaagattggtgaggggggatttggtgccgtatacaagggtacactttctagtggacaagaaattgctataaagaggctatctaaaagctctgggcaaggtgcagtagaattcaaaaatgaggttgtattggtagccaagcttcaacacagaaatctagtgaggttattgggattttgcttggaaggggaagagaagatacttgtctatgaatatgtgcccaacaaaagccttgactacttcctgtttgatcctgataaacgaggacaattggattggtcaagacggtacaagattattggaggaatagcccgagggattctttatcttcatgaagattccaggctcagagttatacatcgtgatctaaaagccagcaatgttttgctagatggtgatatgaaccctaaaatttcagattttggcatggcaaggatttttggtgtagatcaaactcaaggaaatacaaacagagttgttggcacatatggttacatgtctccagagtatgcaatgcatggacgcttctctgtcaagtccgatgtctatagttttggtgtcttagttttagagattataagtggcaagaggagtaattgtttccacgaatcagaccaagcagaagaccttctgagctatgcttggaaactttggaggaatgacacacccttggaatttatgggcccaacgacaaggaattctttctcaaaaaatgaagtcattaggtgcatccatatggggttattatgtgttcaagaagatccggatgacagaccatccatggcatcggtagttctcatgctcagcagttactctgttactctaccattgcctcaacagccagcctcctttagtcgcacgggagcactgtcagactttccaataatggcactggaatcggaccaatctgcaagtaagtcaatgacatggtctgtgaatgaagcttcaatcactgatttatatcctaga

SEQ ID NO: 1182 - protein, 523 aa, Vitis vinifera
  GSVIVT01036853001
MRQSDSGNITEPDQFNQVLGDTLDSIRTQAVNDQSGKKFATKEENFTGFQRVYSLVQCTPDLSPDQCDRCLIGTIAILPDCCGGKQGARVLFPSCNVRYELYPFYQSVAAPPSPPPARPSEPSTEGKGGISSKTIVIIVVPTFVSVVIFSILCYCFIRRCAKKRYDTLEAENVEFNITTEQSLQFDLATIQAATNNFSDHNKIGEGGFGAVYKGTLSSGQEIAIKRLSKSSGQGAVEFKNEVVLVAKLQHRNLVRLLGFCLEGEEKILVYEYVPNKSLDYFLFDPDKRGQLDWSRRYKIIGGIARGILYLHEDSRLRVIHRDLKASNVLLDGDMNPKISDFGMARIFGVDQTQGNTNRVVGTYGYMSPEYAMHGRFSVKSDVYSFGVLVLEIISGKRSNCFHESDQAEDLLSYAWKLWRNDTPLEFMGPTTRNSFSKNEVIRCIHMGLLCVQEDPDDRPSMASVVLMLSSYSVTLPLPQQPASFSRTGALSDFPIMALESDQSASKSMTWSVNEASITDLYPR

SEQ ID NO: 1183 - DNA, 2046 bp, Citrus clementina
  clementine0.9_004089m
atgaatgtgatcctcgtgtttgtcaccgcgctaagcgttcaaatcagccttacaaaggcagatgataagcctacttacatttatcataattgccccagcacaaattttactccaaacagcgcttaccaatccaacctcaatctcctgctctctactcttcggtctaacgccacccgcggcagcagcgacaaattttccaaaggattctacaacactactacaggccacgaacccaacaaggtctacggtctctttctctgccgtggtgatttcggtccggaaacctgccaaaattgtgtcagtgttgctacctcagatacagcccaactctgtcctttcggaaaggagaatacaattgggtacgaagagtgccttttacgttattcgaacatttctttcttttcagtcctggacacctcgttcaaactctcccaatcgaatgtagaaaagtttccaagtcggtcatttgaccagttcgtgtggaattcgattaacgaagcagtaaatcaggctctaagtactaccaaaatgtttgctacggtaaagaaaaattatacagcctctcaaacgctatacagcctcgttcagtgcacgccggacttgtcaagggatgactgtagcagctgtcttcgtttagctatttcactcttgaaccgatgctgtggatttaagataggaggaagagtgatgtatcccagttgcaacttccgatatgagctgtaccagttttataatgatacgtcgaacgggacactgccgcctgtgtttttttatccgccgtctcctggttctgaaacaagctctagaggaggcaaaggaaagaaagcaacatggattgcaattggcacaattataccaacaattactcttctcatactgttgggttcttttttttggtgcaggaggagaagaaataaagcgaagaaagcaataaaaaaacaagaactttatacgagagaaggtagaattggggatgacgagtcaaacgatacattaggtggagcggcgcaaggggaatctcatcaagagttcccaatcttcccattaggtctagcactcgaggctacaaaccatttctctcatgaaaataagcttggagaaggtggtttcggccctgtgtacaagaatttgcgtccagggtatactagcgggtgggaaggaaattgcagtaaaaggctctcaagatcatccggccaagggcgacaagagttcaagaatgaagttactttaatcgccaaattacaacacaaaaatattgtgagactactgggatgctgtttagatggaaatgaactgctgctcgtctatgaatatatgcccaacaaaagccttgatctcttcctttttgattcaactaggggtgcacaattggattggaaaagacgcatatgcatcattaatggaattgctcgaggccttttgtatttgcacgaggattctcgactcagggttattcatcgagatcttaaaactagtaatatcttgttggatcatgagatgaaccccaagatatcagactttggaatggcaagaatctttggtggcaatcaaaatgaagctaatactaatagagttgttggaacatatggatatatggcacccgaatatgcaatggaaggagtattttcaataaaatcagatgtttttagtttcggagttcttcttctagagattgtaagtggaaaaaggaacagtggattttatctttcgaaagacggtcacagcctccttacttatacatggaaattatggtgtgaaggagaagctctggagctgatggatccagtactcaagcagtcatgcgtgggcgctgaacttctgaaatatatacatattggattgttgtgcgttcaggaagacccagcccgcagacctagcatgtcatctgtggttgtaatgttggcgagtgatacaataacacttcctccaccagcccagcctgcattttctgttggccgaatggttgctagttctggtccattcttttcatcagattctaaattttgctctattaatgagattactctttcaagtgtgtatcctcgt

SEQ ID NO: 1184 - protein, 682 aa, Citrus clementina
  clementine0.9_004089m
MNVILVFVTALSVQISLTKADDKPTYIYHNCPSTNFTPNSAYQSNLNLLLSTLRSNATRGSSDKFSKGFYNTTTGHEPNKVYGLFLCRGDFGPETCQNCVSVATSDTAQLCPFGKENTIGYEECLLRYSNISFFSVLDTSFKLSQSNVEKFPSRSFDQFVWNSINEAVNQALSTTKMFATVKKNYTASQTLYSLVQCTPDLSRDDCSSCLRLAISLLNRCCGFKIGGRVMYPSCNFRYELYQFYNDTSNGTLPPVFFYPPSPGSETSSRGGKGKKATWIAIGTIIPTITLLILLGSFFWCRRRRNKAKKAIKKQELYTREGRIGDDESNDTLGGAAQGESHQEFPIFPLGLALEATNHFSHENKLGEGGFGPVYKNLRPGYTSGWEGNCSKRLSRSSGQGRQEFKNEVTLIAKLQHKNIVRLLGCCLDGNELLLVYEYMPNKSLDLFLFDSTRGAQLDWKRRICIINGIARGLLYLHEDSRLRVIHRDLKTSNILLDHEMNPKISDFGMARIFGGNQNEANTNRVVGTYGYMAPEYAMEGVFSIKSDVFSFGVLLLEIVSGKRNSGFYLSKDGHSLLTYTWKLWCEGEALELMDPVLKQSCVGAELLKYIHIGLLCVQEDPARRPSMSSVVVMLASDTITLPPPAQPAFSVGRMVASSGPFFSSDSKFCSINEITLSSVYPR

SEQ ID NO: 1185 - DNA, 1953 bp, Citrus clementina
  clementine0.9_028901m
atgaatatgaatataatcctcgtgtttctctctgtgttaagctttctaatcagtctcccaagagcatatggtgacccttggtacgagggtcatgtttgcaaagacggaatgaatttcaatagcaacagcacgtaccaatcaaaccttaaactcctcctctctacgcttcgctctaacgctacccacggcagcagggacaaaatctctgatggattttacaacgctaccgcaggccaagaccttgacaaggtcagcggtctctttctttgccgaggggatgtcagaagagaaacctgccaagattgtgtcaatttcgctacatcagacctaccccaacgctgtcccgtgcaaaagggagccgtaatatggtaccgcgagtgccttttacattattcgaactattctttcctttcaaccgtggactacgtcccctatttatgcttggcgaatgcacaagattctccaaatcggtcatttggcaagcaagtgcggaatttgatggacgaagctgtaaatcaggctctgagtactcccaaaatgttcgggacagcaaaggaagattattcagactttccaacactgtacggcctcgctcagtgcacgcagaacctgtcaccagatcagtgccgtaattgtcttggagacgctatttcacaactggtggaatgttgtaaagttaggcaaggaggacagttgctgtatccaagttgtatcacccgatatgagctgtacccattttataataataagttgattgcttcaccgacaccggcgcccccatctcctggttctgtaacaagctccaaaggaacgaaagcaatatggattgcaattggcacaactataccaaccatttgtctattcattttgttggtttctgtcgtttggcacaggaggagaagaaataaaggtagaaccggggacgactcatatgatattttaggaggagaaacgcacggggattctcatcaagagctcccaatcttcccgttaggtctagcactcgaggctacaaaacatttctctgatgaaaataagcttggagaaggtggtttcggccctgtgtacaagggtatattagcgggtgggaaggaaattgccgtaaaaaggctctcaggatcatccggccaagggctacaagagttcaagaatgaagttactttaatcgccaaattacaacacaaaaatcttgtgagactattgggatgctgtttagatggaaatgaactgctgctcatctatgaatatatgcccaacaaaagccttgatgtcttccttttcgattcaactaggcatgcacaattggattggaaaagacgcattagcatcattaatggaattgcacgaggccttttgtacttgcacgaggattctcggctgaaaattattcatcgagatcttaaagcaagtaatgtcttgctagatcatgagatgaacccaaaaatatcagacttcggaatggcaagaatctttggtggcaatcaaaatgaatctaataccagtaaagttgttggaacatatggatatatggcgcccgaatatgcactggaaggaataatttcagtaaaatcggatgtttttagtttcggagttcttcttttggagatcataagtggaaaaaagaatagtggattttatctttccgaacacggtcaaagcctacttacttatacatggaaattatggtgtaaaggagaagaagctctagagctgatggatccagtaatcaagcagtcatgcgtggccgcggaacttctgaaatttatacatattggattattgtgcgttcaggaagacccagccgacagacctaacatgtcatctgtggctgtaatgttggcgagtgatgcagtaccacttcctcaaccaacccaacctgcgttttctgctggccgaagtattgctaggtctggtcaatcctcatcatcagattctaaaatttgctccgttaat

SEQ ID NO: 1186 - protein, 652 aa, Citrus clementina
  clementine0.9_028901m
MNMNIILVFLSVLSFLISLPRAYGDPWYEGHVCKDGMNFNSNSTYQSNLKLLLSTLRSNATHGSRDKISDGFYNATAGQDLDKVSGLFLCRGDVRRETCQDCVNFATSDLPQRCPVQKGAVIWYRECLLHYSNYSFLSTVDYVPYLCLANAQDSPNRSFGKQVRNLMDEAVNQALSTPKMFGTAKEDYSDFPTLYGLAQCTQNLSPDQCRNCLGDAISQLVECCKVRQGGQLLYPSCITRYELYPFYNNKLIASPTPAPPSPGSVTSSKGTKAIWIAIGTTIPTICLFILLVSVVWHRRRRNKGRTGDDSYDILGGETHGDSHQELPIFPLGLALEATKHFSDENKLGEGGFGPVYKGILAGGKEIAVKRLSGSSGQGLQEFKNEVTLIAKLQHKNLVRLLGCCLDGNELLLIYEYMPNKSLDVFLFDSTRHAQLDWKRRISIINGIARGLLYLHEDSRLKIIHRDLKASNVLLDHEMNPKISDFGMARIFGGNQNESNTSKVVGTYGYMAPEYALEGIISVKSDVFSFGVLLLEIISGKKNSGFYLSEHGQSLLTYTWKLWCKGEEALELMDPVIKQSCVAAELLKFIHIGLLCVQEDPADRPNMSSVAVMLASDAVPLPQPTQPAFSAGRSIARSGQSSSSDSKICSVNE

SEQ ID NO: 1187 - DNA, 1899 bp, Citrus clementina
  clementine0.9_004892m
atgtcacagagccctgaaaacatgccgtttcattgctcacatcttcctaataatactgcttcagccaagttcacatccaatcttcagcgcttattccaaactctttctgaagtggctggcaaagacgcctacaataaaacgactgaagggaggtatccggacaaagtttatggtctttacctctgtagaggcgatgttaacaatgaatcatgtggcgaatgcgtagatttagcaactgacaccattcagaaagattgtgatggcaccaaagaagcagttatatggtctgataagtgtatggtacgttattctgatagatctctctcccctaactcagagacgtggccaagcaattgctcgacccacagagagaactctactgaacctgaaacgttgagaaagactgtggctaagtcattaaaggaagtaattgcgatggcaactttgaataacgaatctaagtatgcaacccatgtggttaacttttccagcaagcataagctgtacagtctcgtgcagtgcataccagagctgtcaacggaagattgtcgtgcttgcttaacaagtgccgccacttcaattctacgttgttaccaggataagaagggtgccagatttcttaacccgagttgtaatataagattcgagctgtacccgttcttcacgtccaaccctccacctgcagccggccctaacgaggagagagcaattagtcgagaggctcaattacttgaattgggagaaattcaaattggaagccattactcgtatattttacgagaagagaagcaagtggaatccaaagagtttcctctgttcccatttgacctcaccgtggaagctacacaacatttctccgatgaaaacaagctaggagaagggggctttggccctgtttataagggtgtattagcggatggccaagaaattgctgtgaagaggctctcaagaacatctgggcaaggcctagaagaattcatgaatgaagttactgtaattgccaaattacaacataagaatcttgtgagactcttgggatgctgcttaaggggaaatgaattgctgctcatctatgagtacatgcccaacaaaagccttgattttcttctctttgattcaacaaggaatggacaattagactgggaaagacgcgttggcatcattaatggaattgcacgaggtctcttatatttgcacgaggattctcgactcaaaataattcatcgcgacctcaaagctagcaatattttgctagatcatgacatgaacccaaagatatcagattttggaatggcaagaatatttcgtggaaatcaaaatgaagctaatacaaatagagttgtcggaacatatggatatatggccccagaatacgccatggaaggactattctcagttaaatcagatgtctttagctttggagttcttcttctagagataatcagtggcaaaaagaatagcagcttttatctttctgacgaaagtcgaagcctcctcgcgcatgcatggaaactatggtgtgaaggaaatgcattagagctcatggatcccgtgctcaagcaatcgtttaatccagatgaagtgttgaaatgcattcatatcgggctgctgtgcgttcaagcagacccggaagacagactaaccatgtcttctgtggttgttatgttggcaagtgataccgttacgcttcctaaaccaacccaacctccgttttcttttagccgagttgctctcaagttaactcaatgctcatctaatattagagattgttttgatgctgatttaaccctttcaaatgcacgaaaaggactggtacagatcctcgaagcggaacttagtactagaaggggaatgcagaaaagtgatgatcgaatgaccaagataaaagtgatgatcgaa

SEQ ID NO: 1188 - protein, 633 aa, Citrus clementina
  clementine0.9_004892m
MSQSPENMPFHCSHLPNNTASAKFTSNLQRLFQTLSEVAGKDAYNKTTEGRYPDKVYGLYLCRGDVNNESCGECVDLATDTIQKDCDGTKEAVIWSDKCMVRYSDRSLSPNSETWPSNCSTHRENSTEPETLRKTVAKSLKEVIAMATLNNESKYATHVVNFSSKHKLYSLVQCIPELSTEDCRACLTSAATSILRCYQDKKGARFLNPSCNIRFELYPFFTSNPPPAAGPNEERAISREAQLLELGEIQIGSHYSYILREEKQVESKEFPLFPFDLTVEATQHFSDENKLGEGGFGPVYKGVLADGQEIAVKRLSRTSGQGLEEFMNEVTVIAKLQHKNLVRLLGCCLRGNELLLIYEYMPNKSLDFLLFDSTRNGQLDWERRVGIINGIARGLLYLHEDSRLKIIHRDLKASNILLDHDMNPKISDFGMARIFRGNQNEANTNRVVGTYGYMAPEYAMEGLFSVKSDVFSFGVLLLEIISGKKNSSFYLSDESRSLLAHAWKLWCEGNALELMDPVLKQSFNPDEVLKCIHIGLLCVQADPEDRLTMSSVVVMLASDTVTLPKPTQPPFSFSRVALKLTQCSSNIRDCFDADLTLSNARKGLVQILEAELSTRRGMQKSDDRMTKIKVMIE

SEQ ID NO: 1189 - DNA, 1899 bp, Citrus clementina
  clementine0.9_004898m
atgtttaatgttggcacactcttcagcgcaaagctctacaatgaagctggccgctacttatactccaacgcaactgaaggggattacccagacaaagtttatggtctttacaattgtagattcgacgtttctaatgacgtctgccaagactgcataaaagttgcaatccataccattgtgacaaattgtactggcgccaaggaggctattgtatggtatgatcagtgtatggtgcgcttctgtaacagttcttttccttcttggctagagacagagccatctgtagccctactgatcacaataaacgttactgatccttataagttctctaatattttggctcagtccttcagtgatctaattcaaaatgtaacctcaagggattttgagtatccagctgcagcccaaatggttaacgcctctagcattgataaacttaggactctggtgcagtgcataccatatctgtctaaatcagactccaatatttgcctgcgcggggctgttgctcaaattccaaactgctgctacggaaagcgaggtgctagaattcttacgccaagttgtaacataagatacgagctgtaccctttctttgaggaccctacagttcctatctatccacctaataagaagaatggtagctccgacgattcgggaaagaagaaaacgagggaaagcagaacatggattgcaatcggcgccactgtatcatcaattatagtacttgtgctatttagttttttacttcggtgtataaagagaagaaaggaaagagtcaaagaggagaaagcaaatagtcaagagacagggctgcttcatctagcagacggtagacttggcaacgactatacgtatgatgctttacgaggacagaagcaggaagaaactcaagagttccctttgtttccgttacatctcgcagttgaagctacgcagcatttctctgatgaaaataagcttggagaaggcggatttggccctgtttacaagggtaaattagcagatggcaaagaaatagcagtgaagaggctctcaagaacatctgggcaaggcctgcaagagttcaagaatgaagttactctaatcgccaaattgcaacataaaaatcttgtgaggctgttgggctgctgcttagaggaaaatgaatcactgcttatatatgagtacatgcccaataaaagccttgatgtcttcctctttgattcagcgagaagagtacaactggactggaaacgacgcataagtatcattcatggaattgctcggggtcttttgtatttacacgaggattctcgacttagaattattcatcgtgatctcaaagctagtaatgttttactagatcatgagatgaacccgaagatatcagactttgggatggctaggatatttggtggaaatcaaagtgaagctaacaccaaccgaattgttggaacatatggatacatggccccagagtatgctatggaaggattattttctgtaaaatcggatgttttcagttttggcgttctactgctagaaatcatcagtggaaaaaagaacagtgggttttatctatcagaacttggtcaaagcctcctttcttatacatggaaactatggtgtgaaggagaagcactggagctgatggatccagtactcaagcagtcatgcgttgctgctgaacttttgaaatttatccacattggattattgtgtgttcaagcagactcagcagatagacctatcatgtcttctgtggttgtcatgttagcaagcgataatgtaacacttcctcaaccaaccgaacctgcattttctgtaggccgaaatgttgcaaggccaggtcaattctcatcgggtgccaaagtttgttctgttaatgaggttactctttcaaatgtgtcacctcgt

SEQ ID NO: 1190 - protein, 633 aa, Citrus clementina
  clementine0.9_004898m
MFNVGTLFSAKLYNEAGRYLYSNATEGDYPDKVYGLYNCRFDVSNDVCQDCIKVAIHTIVTNCTGAKEAIVWYDQCMVRFCNSSFPSWLETEPSVALLITINVTDPYKFSNILAQSFSDLIQNVTSRDFEYPAAAQMVNASSIDKLRTLVQCIPYLSKSDSNICLRGAVAQIPNCCYGKRGARILTPSCNIRYELYPFFEDPTVPIYPPNKKNGSSDDSGKKKTRESRTWIAIGATVSSIIVLVLFSFLLRCIKRRKERVKEEKANSQETGLLHLADGRLGNDYTYDALRGQKQEETQEFPLFPLHLAVEATQHFSDENKLGEGGFGPVYKGKLADGKEIAVKRLSRTSGQGLQEFKNEVTLIAKLQHKNLVRLLGCCLEENESLLIYEYMPNKSLDVFLFDSARRVQLDWKRRISIIHGIARGLLYLHEDSRLRIIHRDLKASNVLLDHEMNPKISDFGMARIFGGNQSEANTNRIVGTYGYMAPEYAMEGLFSVKSDVFSFGVLLLEIISGKKNSGFYLSELGQSLLSYTWKLWCEGEALELMDPVLKQSCVAAELLKFIHIGLLCVQADSADRPIMSSVVVMLASDNVTLPQPTEPAFSVGRNVARPGQFSSGAKVCSVNEVTLSNVSPR

SEQ ID NO: 1191 - DNA, 2238 bp, Eucalyptus grandis
  Eucgr.E02439.1
atgtacccttattccttcgaagcaagtctcatcaggcatgatagtcctccggtcctccccattaaaaaatttctatgcttctggatgacctcgagagaatgtgcagaagttgcttattatcgtactcctcttgagttgaaagaaagtccatggctggctttgaattactcttactgtacttgcgttctttccaagttcaagcaaaaaagattatcgatgtaccaagaaatatccttcgctttctggatttcatgcctgatcctcttcatcccaggcactcctgtcggtgcacagacatatcttcaagaaaagtgcgcagataggggcgactatgctgctcctagcaagtttcaggacaacctcagcagcctcctctccaagggcgactcagctgattacagcaaaggacccattcgcggtttctacaacacaacggaaggtgaagatccggacaaagtttatggtctcttcctctgcagaggggatgttgctgccaatctctgtcagtcttgcatccgttcagctagcagcacgatcatagaaagatgtccaggacagaaagaggcaatcatatggtacgacgagtgtctcttgcgctactcctacagatcgttcttctctatcatggagacaacgccgtttcttttcattgtcaaccctgcgaacgattcagttaccttcaacaggactatggagcaaacttttgataatgagaaggactttgtggcagaagtgacggatttgtcgaggaatgtgacggacttggcgatcttgtcagaaagcttatacgcaaccttaaacgttagtgtctcaagttcagtgaccctgcacgggcttgcacagtgcacccccgatatatcaaaatcagcttgtaagagttgcttgttttcggctattgaaaagtttccaaccattctcatttatcaaaggggaggtgccagagttcttcagccaagttgtaatgtactgtacgaactgtatcattttgatggggaaactagagggaaaaccagcactgattccagcattaaaggggtaaaacaaaatccatggattgcaatagttagctcagtaattggatcggggttactaatagttatcgtgggttcgtgtatttttttgaagaggacaaagagattgaagaaagagaaggaaaacaaccaaaaggttctgttacttcatctgagacaagaaattggagaagagctttcaaaggaaaactctcgtggagaaaagccagtggcttctcaacaattctctctgatgcgattagacgtcatacgcgcagccacaggaaacttctccaatgaatgtaaacttggggaaggcgggtttggctctgtgtacaagggcacattggcagatggaaaagaaattgcagttaagaggctttcaagaacctcagaccaaggactcattgagttgaagaacgaagtcatcttgattgccagactacaacacaggaacctcgtccaattattgggatgctgtttggaagaacatgaaaaactcttgatatacgaatacatgcccaacaaaagcctggatgccttcctttttgattcgaatatagggcaatatctagattggaagctgcgcatgaacatcatctgtggaatagctcggggacttctctatctgcatgaggattctcgcctgagaattatccacagggatctgaaggctagcaatattttgctagatggcgagatgaatccaaagatatccgatttcggaatggcaaggatcttcagtgtagatcaagacagggcaaacacgaacagggtcgttggaacctatggatacatggcaccggagtatgcaatgcaaggactcttttctgtaaaatcagacgtcttcagttttggagttctcttgctagagatagtaagcgggtgcaagaataatggttttcatctccaagtaaagggtgaaagccttctcacatttgcatggaagttgtggtccgaaggtcgagcattggaacttatcgatccattaattgatgagtcatgtggtgaagttgaagtgctgaaatgcatacacatcggtctattgtgcgtccaagaagacccggcggatcgactgactatgtcactcgtggttcatattttagctggcgatactatcacactcagctcaccatcgcagcctgcattctccgttgggagagatgcggaaaaacttaatcgtgcctcgactgtcaatggagtaaccctttcggttgttgcggctagg

SEQ ID NO: 1192 - protein, 746 aa, Eucalyptus grandis
  Eucgr.E02439.1
MYPYSFEASLIRHDSPPVLPIKKFLCFWMTSRECAEVAYYRTPLELKESPWLALNYSYCTCVLSKFKQKRLSMYQEISFAFWISCLILFIPGTPVGAQTYLQEKCADRGDYAAPSKFQDNLSSLLSKGDSADYSKGPIRGFYNTTEGEDPDKVYGLFLCRGDVAANLCQSCIRSASSTIIERCPGQKEAIIWYDECLLRYSYRSFFSIMETTPFLFIVNPANDSVTFNRTMEQTFDNEKDFVAEVTDLSRNVTDLAILSESLYATLNVSVSSSVTLHGLAQCTPDISKSACKSCLFSAIEKFPTILIYQRGGARVLQPSCNVLYELYHFDGETRGKTSTDSSIKGVKQNPWIAIVSSVIGSGLLIVIVGSCIFLKRTKRLKKEKENNQKVLLLHLRQEIGEELSKENSRGEKPVASQQFSLMRLDVIRAATGNFSNECKLGEGGFGSVYKGTLADGKEIAVKRLSRTSDQGLIELKNEVILIARLQHRNLVQLLGCCLEEHEKLLIYEYMPNKSLDAFLFDSNIGQYLDWKLRMNIICGIARGLLYLHEDSRLRIIHRDLKASNILLDGEMNPKISDFGMARIFSVDQDRANTNRVVGTYGYMAPEYAMQGLFSVKSDVFSFGVLLLEIVSGCKNNGFHLQVKGESLLTFAWKLWSEGRALELIDPLIDESCGEVEVLKCIHIGLLCVQEDPADRLTMSLVVHILAGDTITLSSPSQPAFSVGRDAEKLNRASTVNGVTLSVVAAR

SEQ ID NO: 1193 - DNA, 2106 bp, Eucalyptus grandis
  Eucgr.E02441.1
atggccgtctttgaattacttttgctgtacttgcattctttccaagttcaagcaaaaaagattgtcgatgcaccaagaaatatttccttcgctttctggatttcatgcctgatcctcttcatcccaggcactcctgtcggtgcacagacatatcttcaagaaaagtgcgcagataggggcgagaatgctgctaaaaactatgctccttatagcaagtttcaagacaacctcaacagcctcctctccaagggcaactacgctgattacaacaaaggacccattcacggctttcacaacacaacagaaggcgaagatccggacaaagtttatggtctcttcctctgcagaggggatgttgctgccaatctctgtcagtcttgcatccgttcagctagcagcacgatcatagaaagatgtccaggacagaaagaggcaatcatatggtacgacgagtgtttcttgcgctactccaacagatcattcttctctatcatggagacaacgccgtttcttttcattgtcaaccctgcgaacgattcggttaccttcaacaggactatggagcaaacttttgataatgagaaggactttgtggcagaagtgacggatttgtcgaggaatgtgacggacttggtgatcttgtcagaaagcttatacgcaaccttaaacgttagtgtctcaagttcagtgaccctttacgggcttgcacagtgcacccccgatatatcaaaatcagcttgtaagagttgcttgctttctgctattgaaaagtttccaaccattcttaattatcgaaggggaggtgccagagttcttcagccaagttgtaatgtacggtacgaactgtatcatttttatgggaagactagagggaaaaccagcaccgattccagcattaaaggggtaaaacaaaatccatggattgcaatagttagctcagtaattggatcagggttactaatagttatcgtgggttcgtgtatttttttgaagaggacaaagagattgaagaaagagaaggaaaacaaccaaaaggttctgttacttcatctgagacaagaaattggagaagagctttcaaaggaaaactctcgtggagaaaagccagtggcttctaaaaaattctctctgatgcgattagacgtcatacgcgcagccacaggaaacttctccaatgaatgtaaacttggggaaggtgggtttggccctgtgtacaaggccacattggcagatggaaaagaaattgcagttaagaggctttcaagaacctcagaccaaggactcatcgagttgaagaacgaagtcatcttgattgccagactacaacacaggaacctcgtccaattattgggatgctgtttggaagaacatgaaaaactcttgatatatgaatacatgcccaacaaaagcctggatgccttcctttttgattcgaatatagggcgatatctagattggaagctgcgcatgaacatcacctgtggaatagctcggggacttctctatctgcatgaggattctcgcctgagaattatccacagggatctgaaggctagcaatattttgcttgatggcgagatgaatccaaagatatccgatttcggaatggcaaggatcttcagtgtaaatcaagacaaggcaaacacaaacagggtcgttggaacctatggatacatggcaccggagtatgcaatgcaaggactcttttctgtaaaatcagacgtcttcagttttggagttctcttgctagagatagtaagcgggcgcaagaataatggttttcatcgccaagtaaagggtgaaagccttctcacatttgcatggaagttgtggtccgaaggtcgagcgttggaacttatcgatccgttaatcgatgagtcatgtgatgaagttgaagtgctgaaatgcatacacatcggtctattgtgtgtccaagaagacccggcggatcgactgactatgtcactcgtggttcatattttagctggcgatactatcacactcagccccccatcgcagcctgcattctccgttgggagagatgcggaaaaacttgatcgtccctcaactgttaatgaagtaaccctttcggttgttgcggctagg

SEQ ID NO: 1194 - protein, 702 aa, Eucalyptus grandis
  Eucgr.E02441.1
MAVFELLLLYLHSFQVQAKKIVDAPRNISFAFWISCLILFIPGTPVGAQTYLQEKCADRGENAAKNYAPYSKFQDNLNSLLSKGNYADYNKGPIHGFHNTTEGEDPDKVYGLFLCRGDVAANLCQSCIRSASSTIIERCPGQKEAIIWYDECFLRYSNRSFFSIMETTPFLFIVNPANDSVTFNRTMEQTFDNEKDFVAEVTDLSRNVTDLVILSESLYATLNVSVSSSVTLYGLAQCTPDISKSACKSCLLSAIEKFPTILNYRRGGARVLQPSCNVRYELYHFYGKTRGKTSTDSSIKGVKQNPWIAIVSSVIGSGLLIVIVGSCIFLKRTKRLKKEKENNQKVLLLHLRQEIGEELSKENSRGEKPVASKKFSLMRLDVIRAATGNFSNECKLGEGGFGPVYKATLADGKEIAVKRLSRTSDQGLIELKNEVILIARLQHRNLVQLLGCCLEEHEKLLIYEYMPNKSLDAFLFDSNIGRYLDWKLRMNITCGIARGLLYLHEDSRLRIIHRDLKASNILLDGEMNPKISDFGMARIFSVNQDKANTNRVVGTYGYMAPEYAMQGLFSVKSDVFSFGVLLLEIVSGRKNNGFHRQVKGESLLTFAWKLWSEGRALELIDPLIDESCDEVEVLKCIHIGLLCVQEDPADRLTMSLVVHILAGDTITLSPPSQPAFSVGRDAEKLDRPSTVNEVTLSVVAAR

SEQ ID NO: 1195 - DNA, 2100 bp, Eucalyptus grandis
  Eucgr.E02448.1
atggccgtctttgaattactcttactgaacttgcattctttcctagttcaagcaaaaaagatgatcgatgcaccaagaaatatttccttcgctttctggatttcatgcctgttcctcttcatcccaggcactcctgtcggtgcacagacatatgttcaggagcggtgtgcagataggggcgactacgcttctcctagcaagtttcaggacaacctcagcagcctcctctccaagggcgactccgctgattacagcaaaggacccattcgcggtttctacaacacaacggaaggtgaagatccggacaaagtttatggtctcttcctctgcagaggggaggttgccaccaatcaatgtcagtcttgcatccgtaaagctagcaacaccatcatagaaagatgtccaggacagaaagaggcgatgatatggtatgatgagtgtctcctgcgctactctaacagatcgttcttctctatcatggagacaagaccgattatttttgttgtcgaccctgcgaacaattcagttaccttcaacaagattgtggagcaaacttttgataatgagaactttgcggcaaaagtgacagatttggcaagaaatgtcacggacatggcaatctcctcagaaagcttatacgcaaccataaacgttaatgtctcaagttcagtgaccctgcatgagcgtgtacagtgcacccccgacatcataaagtcagcttgtaagagttgcttgctttctgctatcaaagagtttcctaccgctcttaattataaaaggggaggtgcgagaattcttcagccaagttgttatgtactgtaccgaatggatgttgctggggaacctggaggacaagcaccagcatcttctgcagcaagtaaagggctcaaacgaattccatggattgcaatagttagctcagtaattggatcggggttactaataatcatcgtgggttcgtgtcttttctttatgaggaaaaagagattgaagaaagagatggaagacagccaagaggttcagttacttcatctacgacaagaaattggagaagagttttcaaaggaaaactctcgtggactggcgggttctcaagaattatctctgatgcgattagacatcatacgagcagccacaggaaacttctccgatgaatgtaaacttggggaaggggggtttggttctgtgtacaggggcacattggcagatggaaaagaaattgcagttaagaggctttcaagaacctcaggccaaggactcattgagttgaagaacgaagtcatcttgattgccagactacaacacaggaaccttgtccgattattgggatgctgcttggaagaagatgaaaaactcttgctatatgaatacttgcccaacaaaagcctggatgccttgctttttgattcgaatatagggcgacatctagattggaagctacgcatgaacatctcctgtggagtagctcggggacttctctatctgcatgaggattctcgcctgaaaattatccacatggatctgaaagctagcaatattttgctagatggtgagatgaatccaaagatatccgattttggaatggcaaggatcttcagtgcaaatcaagacaaggcaaacacaaacagggttgttggaacctatggatacatggcaccggagtatgcgatgcaaggacttttttctgtaaaatcagacgtcttcagttttggagttctcttgctagagatagtaagcgggcgcaagaataatggttttcatctccaagaacagggtgaaagccttctcacatttgcatggaagttgtggtccgaaggtcgaccattggaacttatcgatccgttaatcaatgagtcatgtgatgaaggtgaagtgctgaaatgcatacacgttggtctattgtgcgttcaagaagacccagcagatcgaccggctatgtcactcgtggttcatattttaggaggcgataccatcacactcggccgaccatcgcagcctgcattctcagttgggagaaaagtgaaaaaacttgatcgtttcgggcacactcaagaagcctcaaccgttaatggaataaccatttcggttgttacggctagg

SEQ ID NO: 1196 - protein, 700 aa, Eucalyptus grandis
  Eucgr.E02448.1
MAVFELLLLNLHSFLVQAKKMIDAPRNISFAFWISCLFLFIPGTPVGAQTYVQERCADRGDYASPSKFQDNLSSLLSKGDSADYSKGPIRGFYNTTEGEDPDKVYGLFLCRGEVATNQCQSCIRKASNTIIERCPGQKEAMIWYDECLLRYSNRSFFSIMETRPIIFVVDPANNSVTFNKIVEQTFDNENFAAKVTDLARNVTDMAISSESLYATINVNVSSSVTLHERVQCTPDIIKSACKSCLLSAIKEFPTALNYKRGGARILQPSCYVLYRMDVAGEPGGQAPASSAASKGLKRIPWIAIVSSVIGSGLLIIIVGSCLFFMRKKRLKKEMEDSQEVQLLHLRQEIGEEFSKENSRGLAGSQELSLMRLDIIRAATGNFSDECKLGEGGFGSVYRGTLADGKEIAVKRLSRTSGQGLIELKNEVILIARLQHRNLVRLLGCCLEEDEKLLLYEYLPNKSLDALLFDSNIGRHLDWKLRMNISCGVARGLLYLHEDSRLKIIHMDLKASNILLDGEMNPKISDFGMARIFSANQDKANTNRVVGTYGYMAPEYAMQGLFSVKSDVFSFGVLLLEIVSGRKNNGFHLQEQGESLLTFAWKLWSEGRPLELIDPLINESCDEGEVLKCIHVGLLCVQEDPADRPAMSLVVHILGGDTITLGRPSQPAFSVGRKVKKLDRFGHTQEASTVNGITISVVTAR

SEQ ID NO: 1197 - DNA, 2196 bp, Eucalyptus grandis
  Eucgr.E02450.1
atggccgtctttgaattactcttactgaagtttcattctttccaagttcaagcaaaaaagattatcgatgcaccaagaaatatttccttcgctttctggatttcatgcctgatcctcttcatcccaggcactcctgtcggtgcacagacatatgttcaggagcggtgtgcagataggggcgactacgcttctcctagcaagtttcaggacaacctcagcagcctcctcctcaggggcaactccgctgattacagcaaaggacccattcgcggtttctacaacacaacggaaggtgaagatccggacaaagtttatggtctcttcctctgcagaggggatgttgcctccgatctctgtcagacttgcatccgtaacgctagcagcaccatcatagacagatgtccaggacagaaagaggcgaccatatggtacgacgagtgtctcctgcgctactctaacagatcgttcttctctgtcatggagacaacaccgattattttttttatcgaccctgagagcacttcagttaccttcaacaagattgtggagcaaactttcgatgatgaggactttgcggcaaaagtgacagatttgttcgtgagaaatgtcacggacaatgcgatctcctcggaaagcctatacgcaaccataaacgttagtgtctcaagttcagtgaccctgcatgagcgtgcacagtgcacccctgacatctcaaagtcagcttgtaagagttgcttgctttctgctatcaaagggtttcctaccgctcttaatcataaaaggggaggtgcgagaattcttcagccaagttgttatgtactgtaccgaatgtattttcctggggaacctggaggacaagtaccagcaccttctgcaaccaggaaagggctcaaacgaactccatggattgcaatagttagctcagtaattggatcggggttactaataatcatcgtgggttcatgtcttttctttatgaggaaaaagagattgaagaaagatatggaaaacagccaagaggttcagttacttcatctacaacaagaaattggagaagagttttcaaaggaaaactctcgtggactggcgggttctcaagaattatctctgatgcgattagacatcatacgagcagccacaggaaacttctccgatgaatgtaaacttggggaaggggggtttggttctgtgtacaaggtaagtatttcagtgactcaacacgtttctgtggggaaattggggaaatcttctaatggtagcaaattggccgagtcattatcaatggttcagggcacattggcagatggaaaagaaattgcagttaagaggctttcaaaaacctcaggacaaggactcatcgagttgaaaaacgaagtcatcttgattgccagactacaacacaggaaccttgtccgattattgggatgctgcttggaagaagatgaaaaactcttgctatatgaatacttgcccaacaaaagcctggatgccttgctttttgattcgagtatagggcgatatctagattggaagctgcgcatgaacattgcctgtggagtagctcggggacttctctatctgcatgaggattctcgcctgagaattatccatagggatctgaaagctagcaatattttgctagatggcgagatgaatccaaagatatccgatttcggaatggcaaggatcttcagtctaaatcaagacaaggcaaacacaaacagggttgttggaacctatggatacatggcaccggagtatgcgatgcaaggacttttttctgtaaaatcagacgtcttcagttttggagttctcttgctagagatagtaagcgggcgcaagaataatggttttcatctccaagaacagggtgaaagccttctcacatttgcatggaagttgtggtccgaaggtcgagtgttggaacttattgatccgttaatcaatgagtcatgtgatgaagttgaagtgctgaaatgcatacacgtcggtctattgtgcgttcaggaagacccagcagatcgaccagctatgtcactcgtggttcatattttaggaggcgataccatcacactcggccaaccatcgcagcctgcattctcagttgggagaaaagtgaaaaaacttgatcgtttcgggcacactcaagaagcctcaactgttaatggaataaccatttcggttgttacggctagg

SEQ ID NO: 1198 - protein, 732 aa, Eucalyptus grandis
  Eucgr.E02450.1
MAVFELLLLKFHSFQVQAKKIIDAPRNISFAFWISCLILFIPGTPVGAQTYVQERCADRGDYASPSKFQDNLSSLLLRGNSADYSKGPIRGFYNTTEGEDPDKVYGLFLCRGDVASDLCQTCIRNASSTIIDRCPGQKEATIWYDECLLRYSNRSFFSVMETTPIIFFIDPESTSVTFNKIVEQTFDDEDFAAKVTDLFVRNVTDNAISSESLYATINVSVSSSVTLHERAQCTPDISKSACKSCLLSAIKGFPTALNHKRGGARILQPSCYVLYRMYFPGEPGGQVPAPSATRKGLKRTPWIAIVSSVIGSGLLIIIVGSCLFFMRKKRLKKDMENSQEVQLLHLQQEIGEEFSKENSRGLAGSQELSLMRLDIIRAATGNFSDECKLGEGGFGSVYKVSISVTQHVSVGKLGKSSNGSKLAESLSMVQGTLADGKEIAVKRLSKTSGQGLIELKNEVILIARLQHRNLVRLLGCCLEEDEKLLLYEYLPNKSLDALLFDSSIGRYLDWKLRMNIACGVARGLLYLHEDSRLRIIHRDLKASNILLDGEMNPKISDFGMARIFSLNQDKANTNRVVGTYGYMAPEYAMQGLFSVKSDVFSFGVLLLEIVSGRKNNGFHLQEQGESLLTFAWKLWSEGRVLELIDPLINESCDEVEVLKCIHVGLLCVQEDPADRPAMSLVVHILGGDTITLGQPSQPAFSVGRKVKKLDRFGHTQEASTVNGITISVVTAR

SEQ ID NO: 1199 - DNA, 2103 bp, Eucalyptus grandis
  Eucgr.E02450.2
atggccgtctttgaattactcttactgaagtttcattctttccaagttcaagcaaaaaagattatcgatgcaccaagaaatatttccttcgctttctggatttcatgcctgatcctcttcatcccaggcactcctgtcggtgcacagacatatgttcaggagcggtgtgcagataggggcgactacgcttctcctagcaagtttcaggacaacctcagcagcctcctcctcaggggcaactccgctgattacagcaaaggacccattcgcggtttctacaacacaacggaaggtgaagatccggacaaagtttatggtctcttcctctgcagaggggatgttgcctccgatctctgtcagacttgcatccgtaacgctagcagcaccatcatagacagatgtccaggacagaaagaggcgaccatatggtacgacgagtgtctcctgcgctactctaacagatcgttcttctctgtcatggagacaacaccgattattttttttatcgaccctgagagcacttcagttaccttcaacaagattgtggagcaaactttcgatgatgaggactttgcggcaaaagtgacagatttgttcgtgagaaatgtcacggacaatgcgatctcctcggaaagcctatacgcaaccataaacgttagtgtctcaagttcagtgaccctgcatgagcgtgcacagtgcacccctgacatctcaaagtcagcttgtaagagttgcttgctttctgctatcaaagggtttcctaccgctcttaatcataaaaggggaggtgcgagaattcttcagccaagttgttatgtactgtaccgaatgtattttcctggggaacctggaggacaagtaccagcaccttctgcaaccaggaaagggctcaaacgaactccatggattgcaatagttagctcagtaattggatcggggttactaataatcatcgtgggttcatgtcttttctttatgaggaaaaagagattgaagaaagatatggaaaacagccaagaggttcagttacttcatctacaacaagaaattggagaagagttttcaaaggaaaactctcgtggactggcgggttctcaagaattatctctgatgcgattagacatcatacgagcagccacaggaaacttctccgatgaatgtaaacttggggaaggggggtttggttctgtgtacaagggcacattggcagatggaaaagaaattgcagttaagaggctttcaaaaacctcaggacaaggactcatcgagttgaaaaacgaagtcatcttgattgccagactacaacacaggaaccttgtccgattattgggatgctgcttggaagaagatgaaaaactcttgctatatgaatacttgcccaacaaaagcctggatgccttgctttttgattcgagtatagggcgatatctagattggaagctgcgcatgaacattgcctgtggagtagctcggggacttctctatctgcatgaggattctcgcctgagaattatccatagggatctgaaagctagcaatattttgctagatggcgagatgaatccaaagatatccgatttcggaatggcaaggatcttcagtctaaatcaagacaaggcaaacacaaacagggttgttggaacctatggatacatggcaccggagtatgcgatgcaaggacttttttctgtaaaatcagacgtcttcagttttggagttctcttgctagagatagtaagcgggcgcaagaataatggttttcatctccaagaacagggtgaaagccttctcacatttgcatggaagttgtggtccgaaggtcgagtgttggaacttattgatccgttaatcaatgagtcatgtgatgaagttgaagtgctgaaatgcatacacgtcggtctattgtgcgttcaggaagacccagcagatcgaccagctatgtcactcgtggttcatattttaggaggcgataccatcacactcggccaaccatcgcagcctgcattctcagttgggagaaaagtgaaaaaacttgatcgtttcgggcacactcaagaagcctcaactgttaatggaataaccatttcggttgttacggctagg

SEQ ID NO: 1200 - protein, 701 aa, Eucalyptus grandis
  Eucgr.E02450.2
MAVFELLLLKFHSFQVQAKKIIDAPRNISFAFWISCLILFIPGTPVGAQTYVQERCADRGDYASPSKFQDNLSSLLLRGNSADYSKGPIRGFYNTTEGEDPDKVYGLFLCRGDVASDLCQTCIRNASSTIIDRCPGQKEATIWYDECLLRYSNRSFFSVMETTPIIFFIDPESTSVTFNKIVEQTFDDEDFAAKVTDLFVRNVTDNAISSESLYATINVSVSSSVTLHERAQCTPDISKSACKSCLLSAIKGFPTALNHKRGGARILQPSCYVLYRMYFPGEPGGQVPAPSATRKGLKRTPWIAIVSSVIGSGLLIIIVGSCLFFMRKKRLKKDMENSQEVQLLHLQQEIGEEFSKENSRGLAGSQELSLMRLDIIRAATGNFSDECKLGEGGFGSVYKGTLADGKEIAVKRLSKTSGQGLIELKNEVILIARLQHRNLVRLLGCCLEEDEKLLLYEYLPNKSLDALLFDSSIGRYLDWKLRMNIACGVARGLLYLHEDSRLRIIHRDLKASNILLDGEMNPKISDFGMARIFSLNQDKANTNRVVGTYGYMAPEYAMQGLFSVKSDVFSFGVLLLEIVSGRKNNGFHLQEQGESLLTFAWKLWSEGRVLELIDPLINESCDEVEVLKCIHVGLLCVQEDPADRPAMSLVVHILGGDTITLGQPSQPAFSVGRKVKKLDRFGHTQEASTVNGITISVVTAR

SEQ ID NO: 1201 - DNA, 1737 bp, Populus trichocarpa
  POPTR_0017s09070.1
catgatgttaatgaggtctatggcctctttctttgccgtggcgatgtcagtgtcaaagtttgcctagaatgtgtgaaccttctaagaaacgaagtagtccaaagatgtccaatccagaaggaggctatcatatattatgatctgtgcttcctgcgctactcaaacagtaacatcttctccaggttcagccaaacgtcttgggttgtcttgttgaatacacaaaatatagctgttgatgtacaatttaacaagcgagtgaatgattctatatctgatgctgctaaagaagctgcaagagcgccatcaggtgaaaaaaagttcgcagccaaaaaagtgatttatacgtgggaagaatctctatacgttcttgtgcagtgcacaccggatctatctaaatatgattgtaatcggtgtcttaacctaactatctcctacatatcagtttggagtaaaaatgcgcaaggaggaagagtcttgtttccaagctgtaattctcgatttgaaatttattctttttacaacgaaactgccgttgttcccctccctccaccaccactgtcaccaccaccactgtccccgccagttgttcccctccctccatctccaggctcaatagcagatggaaaagaggaaataggaaatatccaagaggaacaattactcgacttggcagggcgagcaactgttggggacgactatccagacaaagatattcaaggagaggtgacatcccaggacctccctttgatccggctagatgttataaatgaagctacaaagcaattttctgatgaaaacaaacttggtcaaggagggtttggcccagtatacaggggtacgttagaggatggcaaagaagttgcagttaagaggctctcaagaacttctggtcaaggacaaagagaattcctgaacgaagtcgttttaatcgccagattacaacacagaaatcttgtcagactcctgggatgctgtctggaaaaaaatgaaaagttacttatctatgagtatatgcccaacaaaagccttgatgtcattctttttggttccagcaatggagtcctgcttgactggcaaagacgcttgagcataatcaatggaattgcacgggggctcttgtatcttcatgaagattctcgtcttagaattattcacagggatctcaaaacaagcaacattttgcttgattatgagatgaatccaaagatatcagactttggaatggctcggattttcggtggaaatcaaagcgaggctaacacgaatagaattgtcggaacttatggatacatggccccagagtatgctatggcgggtcttttttctgtaaaatcagatgttttcagtttcggagtgttgctgttagagataatcagtggaaaaagaaacgttggctttcatctcttagaagaaggcgaaagccttctcacttttgcatggaaactgtggtctgatggtcaaggactggaattgatggaccctatgctagagaaatcaagcgtggcaactgaggtgctgagatgcatccacattgggctgctctgcgtgcaagaggatccagcagatagacccacaatgtcatctgtgcttcatgtgttggcaagtgataccataacactccctatccctaaacagcctgcattttctattggccgatttgttgccatggaaggtcaatcctcaaatcagaaagtttgttctagcaatgaattaaccttttccgtttcatcaccacga

SEQ ID NO: 1202 - protein, 579 aa, Populus trichocarpa
  POPTR_0017s09070.1
HDVNEVYGLFLCRGDVSVKVCLECVNLLRNEVVQRCPIQKEAIIYYDLCFLRYSNSNIFSRFSQTSWVVLLNTQNIAVDVQFNKRVNDSISDAAKEAARAPSGEKKFAAKKVIYTWEESLYVLVQCTPDLSKYDCNRCLNLTISYISVWSKNAQGGRVLFPSCNSRFEIYSFYNETAVVPLPPPPLSPPPLSPPVVPLPPSPGSIADGKEEIGNIQEEQLLDLAGRATVGDDYPDKDIQGEVTSQDLPLIRLDVINEATKQFSDENKLGQGGFGPVYRGTLEDGKEVAVKRLSRTSGQGQREFLNEVVLIARLQHRNLVRLLGCCLEKNEKLLIYEYMPNKSLDVILFGSSNGVLLDWQRRLSIINGIARGLLYLHEDSRLRIIHRDLKTSNILLDYEMNPKISDFGMARIFGGNQSEANTNRIVGTYGYMAPEYAMAGLFSVKSDVFSFGVLLLEIISGKRNVGFHLLEEGESLLTFAWKLWSDGQGLELMDPMLEKSSVATEVLRCIHIGLLCVQEDPADRPTMSSVLHVLASDTITLPIPKQPAFSIGRFVAMEGQSSNQKVCSSNELTFSVSSPR

SEQ ID NO: 1203 - DNA, 2025 bp, Solanum lycopersicum
  Solyc03g111540.1.1
atggcgttggttctagtttcgtgtttgtgcagtaaccaaacattaattctgattttgttgctccattcagtactgcttgtgggtgtcaaagcacagatgcagatgaatcccttatactacgattgttcgatgcccaataattatacagaaggaagcaaattccaatcaaatcttaaccgtttgctgtacaataatagtagcaattccatctatacaaaagcaagtgaaggagaagatcttgataaagtttatggagtattcctctgtagaggagatgttgtaactaaagactgcaaaaattgcatagatgaggcaatagagcggatactaagtgaatgtccgctcaagaaacaggcaattatatggtttgatgaatgtctggtccgctactctaatgtatctttcgcgtcaatattagacagctcgatttctaagatcctgtatgacacacaaaatgtttcacagccagaacggttcatggggaatttgagtgcgatgtttgataatgtcatcactcaagctattaccatcaatctgaatctgaaatatgctgacaattctgatgaaattaacgattttcaaagactgtatggcatggtgcagtgtctacctgatttgtcagctgcagattgtgtcacttgcctgaacgccgctttgtctcaaatgagtatcacactttttgacaccaaaataccaacaggaggcagagttcttcatgcaagctgcaacttaaggtacgaaatatatcaactcctcgccagtttaccgccattgaccagccagggcaacgaagaccaaggcaaaaatacttcaaagacaaagcttattagtatcattacaggtgttacactagcaattttagctgttgtactggcaggaacttggttttaccttctaaaaagacgaagacgaatagagaaagagaggaatgagaacagtcaagaacttcaattgcttgacataataggagaaacacttgatgagaatgatgattttggctcagaaaagaaggggagatccagagagtttccagttgtaaaactagacctcattcgagcagctacgcaaaatttttctgaagaaaacaagcttggagaaggtggatttggtcctgtgtacaagggtacactaccatatggcataacaattgcaatcaaaaggctgtctagaacgtccggtcagggactgaaagagttcaagaatgaagttgtcttaattgccagattacaacacagaaatctcgtgaggctcttgggttgctgtttagagggaatcgaagcactgcttatctatgagttcatgcccaacaaaagcctggacttcttcatttttgaatcaagagaaaacaagattctggattggagacaacgtctccacattattaaaggaatagcaaagggcattctgtatctacacgaggattctcgactaagaatcattcatagggacctaaaagcaagcaatgttttactggacaaagatatgaacgccaagatatcagactttggaatggcaaagatgtttagcggaaatcaaagagaagccaatacaaatagagttgttggaacctatggatatatggctcctgagtatgctatggagggacttttttctactaaatcagatgtgttcagctttggtgttctgttgcttgagatagtaagtggaaggaagaacaatagctatgtttccgaatatggtcagagtctccttaattttgcgtggaagttgtggcgtgaagagcatggattagagctaatggacccttgcttatcgcagtcctgtgtgacaactgagataacaaaatgcatccatatcggactactctgcgttcaacaagacccagcagatagacctaccatgtcctctgtagtttttatgctggaaaacaacactaaaacacttccacagccatcacaacctgcattttctattgggagacttgccatgaaatcagctgagcctcaatctaatgatcagttgtgttccgttaacgaggtcactttatccatactatcaccccga

SEQ ID NO: 1204 - protein, 675 aa, Solanum lycopersicum
  Solyc03g111540.1.1
MALVLVSCLCSNQTLILILLLHSVLLVGVKAQMQMNPLYYDCSMPNNYTEGSKFQSNLNRLLYNNSSNSIYTKASEGEDLDKVYGVFLCRGDVVTKDCKNCIDEAIERILSECPLKKQAIIWFDECLVRYSNVSFASILDSSISKILYDTQNVSQPERFMGNLSAMFDNVITQAITINLNLKYADNSDEINDFQRLYGMVQCLPDLSAADCVTCLNAALSQMSITLFDTKIPTGGRVLHASCNLRYEIYQLLASLPPLTSQGNEDQGKNTSKTKLISIITGVTLAILAVVLAGTWFYLLKRRRRIEKERNENSQELQLLDIIGETLDENDDFGSEKKGRSREFPVVKLDLIRAATQNFSEENKLGEGGFGPVYKGTLPYGITIAIKRLSRTSGQGLKEFKNEVVLIARLQHRNLVRLLGCCLEGIEALLIYEFMPNKSLDFFIFESRENKILDWRQRLHIIKGIAKGILYLHEDSRLRIIHRDLKASNVLLDKDMNAKISDFGMAKMFSGNQREANTNRVVGTYGYMAPEYAMEGLFSTKSDVFSFGVLLLEIVSGRKNNSYVSEYGQSLLNFAWKLWREEHGLELMDPCLSQSCVTTEITKCIHIGLLCVQQDPADRPTMSSVVFMLENNTKTLPQPSQPAFSIGRLAMKSAEPQSNDQLCSVNEVTLSILSPR

SEQ ID NO: 1205 - DNA, 1905 bp, Glycine max
  Glyma06g46910.1
atgaccgtcttcaccatggcaagtgcacaatccccaaactacatgaatgatgactgccacaactcaacaacacaacaagccctaaccctaacataccaaaccaaccttcacaacaccctcttgtggctgtcttctgatgctgccacaagcaaaggatacaatcacaccaccacaggaaatggcacagttgatgctgtatatggcctctatgattgcagggttttcgagtggcgtcccccatctcgtgaatgtcttcaacgcggtcctaacagatcttctgctgtgatatggtataactactgcattctcaggtactcaaaccataacttctttgggaaccttaccacaactccatcatggcaaattgtagggtccaagaacacaactaatccagaagagcttcagaaatctgaggattacatgcaaagtttgagaagagaagccactgtggagaccaacaaattatatgcaatgggagggttcaatttgagtaatggtgaggaaaggtatgggttggtgcagtgcagtagggaccttactaatgttgagtgcagtcagtgtttggaggctatgttagtcaaagttcctcagtgttgtgctgcaaacctaggatggcaagttttggctccaagttgtcttataaagtatgatgattatatgttctaccagattactaatcaaacatcttctcttttgcctaatccagctaagaagggaggtaaaattaagtcaacaaccttgatcataatcatagtgagtgtattggtggcactagctttagtagtttgctctatctactacttgtggaggcagtatctgtcaaacaaagatggattgctatcagtgaacacccctacatcttttcatggccatgttcaaagagaagatgcattgactgtagaccttcctacaatccctttaatttggattcgacagagcactaataacttttcagagttggataaattaggagaaggtggatttggtcctgtttacaagggtaatttagaagatggaacagaaattgctgtcaaaagactctctaaaacatctggtcaaggtttggaggagttcaagaatgaagtgatcttcatagccaaactgcaacataggaaccttgtgagactcttgggttgctgtattgaggaaaatgaaaagctgcttgtgtacgagtacatgccaaattctagccttgactctcacttgttcaataaggaaaaaagaaagcaactagattggaagttaagactgagcattatcaatggaattgcaaaaggacttctataccttcatgaagactctagacttagagtaatccatagagatctgaaagccagcaatgttcttctggatcaagacatgaatccaaaaatatcagattttggattggcaagaacatttgaaaaaggccagagtcaggaaaatacaaaaagagttatgggcacctatggttacatggctccagaatatgcaatggaagggttgtattcagtgaaatctgatgttttcagctttggagttcttttactagaaatcatatgtgggaaaaggaatagtggattctatctttcagaacatggtcaaagtcttcttgtatatagttggagactttggtgtgaaggaaaaagcttggaattgttggatcaaatactggaaaagacatataaaaccagtgaagttatgaggtgcatacacattggtttgttatgtgttcaggaagatgcagtagatcgaccaaccatgtcgacggttgttgtcatgctggcaagtgacacaatagcccttccaaaacctaatcatcctgccttttcagttggaaggcagaccaaagaagaagaatcaacatcaaaaacttccaaggatccttctgttaatgaagtaacagtatcaaatattttacccagg

SEQ ID NO: 1206 - protein, 635 aa, Glycine max
  Glyma06g46910.1
MTVFTMASAQSPNYMNDDCHNSTTQQALTLTYQTNLHNTLLWLSSDAATSKGYNHTTTGNGTVDAVYGLYDCRVFEWRPPSRECLQRGPNRSSAVIWYNYCILRYSNHNFFGNLTTTPSWQIVGSKNTTNPEELQKSEDYMQSLRREATVETNKLYAMGGFNLSNGEERYGLVQCSRDLTNVECSQCLEAMLVKVPQCCAANLGWQVLAPSCLIKYDDYMFYQITNQTSSLLPNPAKKGGKIKSTTLIIIIVSVLVALALVVCSIYYLWRQYLSNKDGLLSVNTPTSFHGHVQREDALTVDLPTIPLIWIRQSTNNFSELDKLGEGGFGPVYKGNLEDGTEIAVKRLSKTSGQGLEEFKNEVIFIAKLQHRNLVRLLGCCIEENEKLLVYEYMPNSSLDSHLFNKEKRKQLDWKLRLSIINGIAKGLLYLHEDSRLRVIHRDLKASNVLLDQDMNPKISDFGLARTFEKGQSQENTKRVMGTYGYMAPEYAMEGLYSVKSDVFSFGVLLLEIICGKRNSGFYLSEHGQSLLVYSWRLWCEGKSLELLDQILEKTYKTSEVMRCIHIGLLCVQEDAVDRPTMSTVVVMLASDTIALPKPNHPAFSVGRQTKEEESTSKTSKDPSVNEVTVSNILPR

SEQ ID NO: 1207 - DNA, 1896 bp, Populus trichocarpa
  POPTR_0004s02340.1
atgggtcacaatttccttcttgttaaaaaaagtattcaaatgcttttgctgtatttttccattgccaaccttcttgatcttgcttatgctgatcctccatacggactttgctcgaacaaatctagttatacagataatagtccatttcaaaacaacctcgagaccctcatggcttctctttcctcaaatgcttcagtttcaaaaaatttcaatacctctactggaattgatccagacagagtgtatgctcaatatatgtgcctcaactatgtaaaaaatgaaagctgccgtacctgcgtagctgcagcatctcaaggtatcaggcagctttgtccaggagataaggaagcagttgtatggggagagttatgtcaattgcgctactcgaatcaaagattcttaggccacttggatgtttcaggaaacattccccaatataatccaaagaacatttcaaatccagaacatcttagtttagtagtcaataaaaccttgagtagtcttatcaagaaggcagcttttgattcttcagcgaatatgtatgctactagagacgaacctttcactgatagtgacagctttttctctctagtacagtgctctacagacttgtctccaaatgattgttacacatgccttgaggttgccgtaaaaaatgttacgacttgttgctatttttctcgtggagcgagggttctcagccgcagttgctatttaaggtatgagttatatgatttctatgacggcgcaactgaatcttctaaaagtccggtgaccggaaaaggtactaatttgcttatagatcaattaagacatggtaaatttcgtgtgtttgatcacccaaaccacaatgatttccagcaccaagattttcagagagatggccttaatgatcgggaatcggcaattatggatttggcatccataaatgcagctactgataacttctctgaaacaaacttgcttgggcaaggtggttttggcccggtttacaagggtatactgagtgatggaaaagaagtagcagtaaagagactttcggattcgtccgagcaaggcaaaaacgagtttacaaatgaagttctgctaattatgaaacttcagcacaaaaatcttgttaagcttctcggtttttgtgttgatcgagaggaaaagctgctggtctatgaattcatgcctaacaacagcctagacgtggttctctttgatccgaggaaacgtgctcaacttagttggagaagtcgtattcatattataaatgggattgcaaagggaactctttatctccatgaggattctagacttagaatcatccatcgggacctgaaagctagcaatatcttgttggacaataacatgaatccgaagatttctgacttcggaatggcaaggatcatggaagctaatgaaggcgaaaccaatactgttaggatagtgggaacatatggatacatggcaccagagtatgaaatggagggactttactccaccaaatctgatgtttttagttttggagttattctgctggagatcataaccggaagaaagaattctggattccacaaatcgaaacgtgctcctagcctcctagcttatgcatgggaattatggaacaatggaaaggaactcgagatgatagatccagtgttggctgattcatgctgctctgatgaattttcccgatgcgtgcatatcggtttattatgcgtccaagaagatgctagtgaaaggccagccatgtcgtccgttgttttaatgctgaaaagtgacaactcaattgatcttccccaacctcaacggccggccttttttgctgggagatttacagaccaccacgaggcaaaagcaaatgattgttctgtcaatggcttaacagtttctgatattttacctcgt

SEQ ID NO: 1208 - protein, 632 aa, Populus trichocarpa
  POPTR_0004s02340.1
MGHNFLLVKKSIQMLLLYFSIANLLDLAYADPPYGLCSNKSSYTDNSPFQNNLETLMASLSSNASVSKNFNTSTGIDPDRVYAQYMCLNYVKNESCRTCVAAASQGIRQLCPGDKEAVVWGELCQLRYSNQRFLGHLDVSGNIPQYNPKNISNPEHLSLVVNKTLSSLIKKAAFDSSANMYATRDEPFTDSDSFFSLVQCSTDLSPNDCYTCLEVAVKNVTTCCYFSRGARVLSRSCYLRYELYDFYDGATESSKSPVTGKGTNLLIDQLRHGKFRVFDHPNHNDFQHQDFQRDGLNDRESAIMDLASINAATDNFSETNLLGQGGFGPVYKGILSDGKEVAVKRLSDSSEQGKNEFTNEVLLIMKLQHKNLVKLLGFCVDREEKLLVYEFMPNNSLDVVLFDPRKRAQLSWRSRIHIINGIAKGTLYLHEDSRLRIIHRDLKASNILLDNNMNPKISDFGMARIMEANEGETNTVRIVGTYGYMAPEYEMEGLYSTKSDVFSFGVILLEIITGRKNSGFHKSKRAPSLLAYAWELWNNGKELEMIDPVLADSCCSDEFSRCVHIGLLCVQEDASERPAMSSVVLMLKSDNSIDLPQPQRPAFFAGRFTDHHEAKANDCSVNGLTVSDILPR

SEQ ID NO: 1209 - DNA, 1704 bp, Populus trichocarpa
  POPTR_0314s00200.1
atgtcttctctttcctcaaatgcttctgtttcaaaaattttcaatacctctactggaattgatccagacagagtgtatgctcaatatatgtgcctcaactatgtaaaaaatgaaagctgccgtacctgcgtagccgcagcatctcaagatatcaggcagctttgtccaggagataagaaagcagttgtctgggaagagctatgtcaattgcgctactcgaatcaaagattcttaggccacttggatgtttcaggaaacgttccccaatataatccaaagaacatttcaaatccagaacatcttagtttagtagtcaataaaaccttgagtagtcttatcaagaaggcagcttttgattcttcagcgaatatgtatgctactagagaagaaccgttcactgatagtgacagctttttctctctagtacaatgctctacagacttgtctccaaatgattgttacacatgccttgaggttgccataaaaaatgttacgacttgttgctatttttctcgtggagcaagggttttcagccgcagttgctatttaaggtatgagttatatgctttctatgacagcgcatctgaatcttctcaaagtccggtgaccggaaaaggtactaatttgcttatagatcaattaagacgtaaaaagtggttatatttggatcaccaagattttcagagagatggccttaatgatcgggaatccgcaattatggatttggcatccataaatgcagctaccgataacttttctgaagcaaactttcttgggcaaggtggttttggcccagtatacaagggtatactgagtgatggaaaggaattagcagtaaagagactttcagctttgtccgagcaaggcaaaaacgagtttacaaatgaagttctgctaatcatgaaacttcagcacaaaaatcttgttaagcttctcggtttttgtgttgatggagaggaaaagcttctggtctatgaattcatgcctaacaacagcctagacatggtcctctttgatccgaggaaaggtgctcaacttagttggagaagtcgtattcatattataaatgggattgcgaagggaattctttatctccatgaggattctagacttagaatcatccatcgggacctgaaagctagcaatatcttgttggacaataacatgaatccgaagatttctgacttcggaatggcaaggatcatggaagctaatgaaggcgaagccaatactgttaggatagtgggaacatatggatacatggcaccagagtatgcaatggagggactttactccaccaaatctgatgtttttagttttggagttattctgctggagatcataaccggaagaaagaattctggattccacaaatcgaaacgtgctcctagcctcctagcttatgcatgggaattatggaacaatggaaaggaactcgagatgatagatccagtgttggttgattcatgctgctctgatgaattttcccgatgcgtgcatatcggtttattatgcgtccaggaagatgctagtgaaaggccagccatgtcttccgttgttttaatgctgaaaagtgacaactcaattgatcttccccaacctcaacggccggccatttttgctgggagatttacagaccaccacgaggcaaaagctaatgattgttctgtcaatggcttaacagtttctgatattttacctcgt

SEQ ID NO: 1210 - protein, 568 aa, Populus trichocarpa
  POPTR_0314s00200.1
MSSLSSNASVSKIFNTSTGIDPDRVYAQYMCLNYVKNESCRTCVAAASQDIRQLCPGDKKAVVWEELCQLRYSNQRFLGHLDVSGNVPQYNPKNISNPEHLSLVVNKTLSSLIKKAAFDSSANMYATREEPFTDSDSFFSLVQCSTDLSPNDCYTCLEVAIKNVTTCCYFSRGARVFSRSCYLRYELYAFYDSASESSQSPVTGKGTNLLIDQLRRKKWLYLDHQDFQRDGLNDRESAIMDLASINAATDNFSEANFLGQGGFGPVYKGILSDGKELAVKRLSALSEQGKNEFTNEVLLIMKLQHKNLVKLLGFCVDGEEKLLVYEFMPNNSLDMVLFDPRKGAQLSWRSRIHIINGIAKGILYLHEDSRLRIIHRDLKASNILLDNNMNPKISDFGMARIMEANEGEANTVRIVGTYGYMAPEYAMEGLYSTKSDVFSFGVILLEIITGRKNSGFHKSKRAPSLLAYAWELWNNGKELEMIDPVLVDSCCSDEFSRCVHIGLLCVQEDASERPAMSSVVLMLKSDNSIDLPQPQRPAIFAGRFTDHHEAKANDCSVNGLTVSDILPR

SEQ ID NO: 1211 - DNA, 2094 bp, Vitis vinifera
  GSVIVT01012617001
atgggggtaaaagtagctccacatataaggcccaaccaattgttgtccagacagttctcaaaaagggaaaatatgatgtcctcccaaggtgtctcaaaagccattcaattgcttttcatttcttctgttctttctggctttcctgatcttgtctgtgctgatcctccttataatgtttgttcaaccaccactacttatggacttaatagtctcttccaaagtaatcttgaaaatctccttgattccttaccttctaaagcttttgtctcccactttgacaatacctccattggaaatggcctagacagagttaatggtgcctttctgtgcctcaattatgttgcaaatgatcaatgcagaaactgcatatctacagcagcataccatgtcaagaaactttgtccaaacatgaatgaagccatcgtgtgggaggatgaatgccaaattctctattctaatgaaacattcttaggtcatttgagtactacaggaaacatacctctagataatatgaagaatgtttcagacttagagtcagaacagctgagatttagatctgttgtgaacgataccctgcagaaccttatcaaacaggcagctttcaattcttcaactgacatgtatgccaccaaaccagtagtctttacagatgtagatatcttatatgctctagtgcaatgcactccagacttgtcaccagataactgtagtatatgccttcagactgccacaacagaaatcttagcagtctattatttttcacggggcgcaaggcttctcagtcgtagttgctatctaaggtatgagttctaccccttttatgaagttgcaactgagccccaagctcctgtttctccacaaaatccggggacaaggaaagatggaagaaggaaaacagggatgattctaatcattacaagtgtatcagtatctttggttgtggcaactttggctttctatgtctattgtctagcaacgaggaatggaaagaaaaaggagagaaaacaatatctaaatcgagaagttcaattacctgatattgatgaccccagttacacaggtccatatcaatttcacggaaggaaaagtctgaattctcaggaatttctctttattgatttagcaactatacatgaagctactgacaacttctctgaattgaataagctcggacaaggtggttttggccctgtttacaagggtgttttgcgtgatggcaaggaagtagcagttaagaggctttcaagtgattctgagcaaggttcagaggaattcacaaacgaagttctgctaataatgaaacttcaacataagaatctggtcaggcttttgggcttttgtgtggacagggaggaaaggatgcttgtctatgaatatatgcccaacagtagcttagatgtcttcctctttgatccaaggagacgtgcacaacttgattggagcagacggcttaatattattggtggaattgctcgagggattctttatcttcacgaagattctcgacttagaatcattcatagggacctaaaagcaagcaatgtgctattggactgtgatatgaagccaaagatctctgactttggaatggcaaggatctttggaggaagtgaaggtgaagctaacaccgctacaatagttggaacacatggatatatggctccagagtatgctatggaagggctatattccgttaagtctgatgtttttagcttcggagttctcttacttgagatcataactgggaggaggaattctggcttccatctctccaagcgcgctcctagcctcatatcatatgcatggcagctatggaatgaaggaaaggggtcggagttgatggatccattattgactgactcatgctgccagaatgaatttttgagatgctaccatattggattactatgtgttcaagaagatgcatttgacaggccaaccatgtcatctgttgtcatgttgaaaagtgaaactgtaacccttcgccagcctgaacgacctgccttctccattgggagattcactgactgcgatgaaaaaaatgcctgtggttgttccgtcaatggtttgacagtttcaaatatcgggcctcgc

SEQ ID NO: 1212 - protein, 698 aa, Vitis vinifera
  GSVIVT01012617001
MGVKVAPHIRPNQLLSRQFSKRENMMSSQGVSKAIQLLFISSVLSGFPDLVCADPPYNVCSTTTTYGLNSLFQSNLENLLDSLPSKAFVSHFDNTSIGNGLDRVNGAFLCLNYVANDQCRNCISTAAYHVKKLCPNMNEAIVWEDECQILYSNETFLGHLSTTGNIPLDNMKNVSDLESEQLRFRSVVNDTLQNLIKQAAFNSSTDMYATKPVVFTDVDILYALVQCTPDLSPDNCSICLQTATTEILAVYYFSRGARLLSRSCYLRYEFYPFYEVATEPQAPVSPQNPGTRKDGRRKTGMILIITSVSVSLVVATLAFYVYCLATRNGKKKERKQYLNREVQLPDIDDPSYTGPYQFHGRKSLNSQEFLFIDLATIHEATDNFSELNKLGQGGFGPVYKGVLRDGKEVAVKRLSSDSEQGSEEFTNEVLLIMKLQHKNLVRLLGFCVDREERMLVYEYMPNSSLDVFLFDPRRRAQLDWSRRLNIIGGIARGILYLHEDSRLRIIHRDLKASNVLLDCDMKPKISDFGMARIFGGSEGEANTATIVGTHGYMAPEYAMEGLYSVKSDVFSFGVLLLEIITGRRNSGFHLSKRAPSLISYAWQLWNEGKGSELMDPLLTDSCCQNEFLRCYHIGLLCVQEDAFDRPTMSSVVMLKSETVTLRQPERPAFSIGRFTDCDEKNACGCSVNGLTVSNIGPR

SEQ ID NO: 1213 - DNA, 1230 bp, Arabidopsis thaliana
  AT5G14640.1
atggcttctgtgggaacattaccagcttcttctatggctacaaaacaaagcaatgcttctatatgcgctgaaaaattacctgaagggattaatgagatgaagataaaagatgataaggaaatggaagcagctgtggttgatgggaatggaactgaaacaggtcacattattgttacaactattggtggtaaaaatggtcagcctaaacagaccataagttatatggcagagcgcatcgttggacaaggttcttttggaatcgtttttcaggccaagtgtttagaaacgggggaaactgttgcaatcaagaaagttttgcaagacaagagatacaagaatcgggagctgcagacaatgcgtcttcttgatcaccctaatgttgtatccctcaagcattgttttttctcaacgactgaaaaagatgagctctatctcaatctggtccttgaatacgttcctgagactgtctatcgcgtctcaaagcactatagtcgggcaaaccagaggatgcccattatatatgttaaactctatacttatcagatttgcagagctttggcttatattcatggtggagtaggagtctgccacagagacataaaaccacagaatcttctggttaatcctcatacgcatcaggtcaaactatgcgattttggtagcgcaaaagttctggttaaaggcgagccaaacatctcatacatctgctcccgttactatcgagcacctgaacttatatttggagctacagaatatacaacaacaattgacatatggtctgcaggctgtgttcttgctgaattgcttctgggacagcctctatttccaggtgagagtggagttgaccagctagttgagataataaaggttcttggaacaccaacacgggaggaaatcaaatgcatgaatccaaactacacagaattcaaattcccgcaaataaaggctcatccttggcacaaaatattccataagcgtacacctccagaagctgtagaccttgtctcaagacttctccagtattctccaaacctcagatcaaccgctatggaggcgatagttcacccgttcttcgatgagctacgtgatcccaatacacgtcttcctaatggtcgtgccttgcctcctctcttcaactttaaacctcaagagctaaaaggagcaagtttagagttgttgtccaagcttatacctgaccacgcccgaaaacaatgttccttcctcgctctc

SEQ ID NO: 1214 - protein, 410 aa, Arabidopsis thaliana
  AT5G14640.1
MASVGTLPASSMATKQSNASICAEKLPEGINEMKIKDDKEMEAAVVDGNGTETGHIIVTTIGGKNGQPKQTISYMAERIVGQGSFGIVFQAKCLETGETVAIKKVLQDKRYKNRELQTMRLLDHPNVVSLKHCFFSTTEKDELYLNLVLEYVPETVYRVSKHYSRANQRMPIIYVKLYTYQICRALAYIHGGVGVCHRDIKPQNLLVNPHTHQVKLCDFGSAKVLVKGEPNISYICSRYYRAPELIFGATEYTTTIDIWSAGCVLAELLLGQPLFPGESGVDQLVEIIKVLGTPTREEIKCMNPNYTEFKFPQIKAHPWHKIFHKRTPPEAVDLVSRLLQYSPNLRSTAMEAIVHPFFDELRDPNTRLPNGRALPPLFNFKPQELKGASLELLSKLIPDHARKQCSFLAL

SEQ ID NO: 1215 - DNA, 1227 bp, Arabidopsis thaliana
  AT3G05840.2
atggcctcggtgggcatagagcctagtgccgcggttagagaatctactggaaacgttactgatgctgatagattacccgaggagatgaaggacatgaaaattcaagatgataaagaaatggaagctacgattgttaatggcaatgtgactgagactggccatataatagtaactactataggaggaagaaatggccagccaaaacagacaatcagttacatggcggagcgagttgttggacatggctcctttggtgttgtgtttcaggccaaatgtttagaaacaggagaaactgttgctataaagaaagttctacaagatcggaggtacaagaatcgtgagcttcaaacaatgaggctacttgaccatccaaatgttgtgtctttgaaacattgtttcttctctacaaccgaaaaagatgagctttatctcaacttggttctggaatacgttccggaaactgtgcaccgcgtcatcaaacactacaacaaacttaaccaacgaatgcctctcgtttacgtcaaactttacacttatcagatttttaggtccttatcctacattcaccgatgtatcggcgtatgtcatcgagacatcaaacctcaaaacttgttggtaaatccacacactcatcaagtgaaactatgcgattttggaagtgcgaaagtattggttaaaggagagccaaacatttcatacatttgctcgaggtattacagagcacctgagctcatttttggagccaccgagtatactacagccattgatgtctggtctgcaggatgtgttctcgccgagcttcttctcgggcagccattgttcccgggtgagagcggtgttgatcaacttgtagagattataaaggttttgggaacaccaacaagggaagaaatcaaatgcatgaacccgaattacacagagttcaaatttcctcagattaaagctcatccatggcataagattttccacaagagaatgcctccagaagctgttgatttggtctcaaggcttcttcaatactctcccaatctccgttgtgctgctcttgattcattggtccacccattctttgacgagctaagagatccgaatgcgcgattacccaacggacgtttccttccaccgctctttaactttaagcctcatgaacttaaaggtgtgcctgtggagatggtggcgaagttagttccagaacatgcgaggaagcaatgtccgtggctcagtttg

SEQ ID NO: 1216 - protein, 409 aa, Arabidopsis thaliana
  AT3G05840.2
MASVGIEPSAAVRESTGNVTDADRLPEEMKDMKIQDDKEMEATIVNGNVTETGHIIVTTIGGRNGQPKQTISYMAERVVGHGSFGVVFQAKCLETGETVAIKKVLQDRRYKNRELQTMRLLDHPNVVSLKHCFFSTTEKDELYLNLVLEYVPETVHRVIKHYNKLNQRMPLVYVKLYTYQIFRSLSYIHRCIGVCHRDIKPQNLLVNPHTHQVKLCDFGSAKVLVKGEPNISYICSRYYRAPELIFGATEYTTAIDVWSAGCVLAELLLGQPLFPGESGVDQLVEIIKVLGTPTREEIKCMNPNYTEFKFPQIKAHPWHKIFHKRMPPEAVDLVSRLLQYSPNLRCAALDSLVHPFFDELRDPNARLPNGRFLPPLFNFKPHELKGVPVEMVAKLVPEHARKQCPWLSL

SEQ ID NO: 1217 - DNA, 1215 bp, Arabidopsis thaliana
  AT5G26751.1
atggcgtcagtgggtatagctcctaatcctggagcaagagactctactggtgttgataaattgcctgaagaaatgaatgacatgaaaattcgtgacgataaagaaatggaagcgacagtggtagatggaaatggaacagagactggacatatcattgtgactactattggtggtagaaatggccaaccaaaacagacaattagctacatggctgagcgtgttgttggtcacggatcttttggtgttgtgttccaagcgaaatgtcttgagacaggagaaactgttgcgataaagaaagttttacaagataggaggtacaagaaccgtgagcttcaaaccatgaggctacttgaccatcctaatgttgtgtctctgaaacattgtttcttctcaaccactgaaaaagatgagctttacctcaatcttgttcttgagtacgttccagaaactgttcatcgtgttatcaaacactacaacaaactgaatcagagaatgcctcttatatacgtcaaactttacacttatcagatttttagagccttatcttacattcaccgatgcattggtgtgtgtcatcgtgacataaaacctcaaaacttgttggtaaatccgcacactcatcaagtaaagctatgtgattttggaagtgcaaaagtattggtaaaaggagaaccaaacatttcctacatctgctcgaggtattacagagcacctgaacttatttttggagcaaccgagtatacgacagccattgatgtctggtctgcaggatgtgttctagctgaactattgcttggacagcccttgttccctggtgagagcggtgttgatcaacttgtagagattatcaaggtcttgggaacgcctactagagaagaaatcaagtgcatgaacccaaactacacggaattcaaattccctcagattaaagctcatccatggcacaagattttccacaaacgcatgcctccagaagctgttgatttggtctcaagacttcttcaatactctcctaatctacgaagtgccgctctcgacacattagtccacccattctttgatgagttaagagacccaaacgcacgtctacctaatggacgtttccttccaccgcttttcaacttcaagcctcacgagctgaaaggtgtaccattggagatggtagctaagttagtacctgagcatgcaaggaagcagtgtccttggctcggtttg

SEQ ID NO: 1218 - protein, 405 aa, Arabidopsis thaliana
  AT5G26751.1
MASVGIAPNPGARDSTGVDKLPEEMNDMKIRDDKEMEATVVDGNGTETGHIIVTTIGGRNGQPKQTISYMAERVVGHGSFGVVFQAKCLETGETVAIKKVLQDRRYKNRELQTMRLLDHPNVVSLKHCFFSTTEKDELYLNLVLEYVPETVHRVIKHYNKLNQRMPLIYVKLYTYQIFRALSYIHRCIGVCHRDIKPQNLLVNPHTHQVKLCDFGSAKVLVKGEPNISYICSRYYRAPELIFGATEYTTAIDVWSAGCVLAELLLGQPLFPGESGVDQLVEIIKVLGTPTREEIKCMNPNYTEFKFPQIKAHPWHKIFHKRMPPEAVDLVSRLLQYSPNLRSAALDTLVHPFFDELRDPNARLPNGRFLPPLFNFKPHELKGVPLEMVAKLVPEHARKQCPWLGL

SEQ ID NO: 1219 - DNA, 1224 bp, Brachypodium distachyon
  Bradi2g08890.1
atggcttcagtaggcatagttccgtccgggcagaagaacagtagcagtaccagcatgggtgtggagaagttacccgatcaaatgaatgatttgaagataagagatgataaggaagtggaagcgactattattaatggcaaggggacagaaactggtcacattattgtcacaactactggtggcagaaatggtcaaccgaaacagactgtgagctacatggctgaacgtattgtaggtcaaggatcatttgggattgtctttcaggctaaatgtttggagacaggtgaaactgttgctataaagaaggttcttcaggataagcgctacaagaatcgtgagctgcaaaccatgcgccttcttgaccacccaaatgttgtagctctgaagcattgtttcttttctacaactgagaaggatgaactatatctaaacttggttctggagtatgtgcctgagactgttcatcgtgttgtgaagcattacaacaagatgaaccagcgcatgccacttatctatgtgaagctgtacacgtaccagatatgcagggcactggcttacattcatggcagcattggagtttgccacagagatatcaagccacaaaatcttctggtaaacccacatacccatcagctcaaactatgtgactttgggagcgcaaaagttctggtcaaaggagaaccaaacatatcgtacatttgctcccgatactatagggctccagagctcatatttggtgccactgagtacactacggccattgacatttggtctgctggatgtgttcttgctgagcttatgttagggcagcctctgtttcctggtgaaagtggagtagaccagcttgttgaaatcatcaaggtccttggtacccctacaagggaagagattaaatgcatgaacccaaattacacggagttcaaattcccacagattaaagcacacccatggcacaaggtatttcataaaaggatgcccccagaagctgttgatcttgtctctcggctcctccagtactcacccaacctaagatgcactgctgtggaggcacttattcaccccttctttgatgagcttcgggacccgaatacccgccttccaaatggccgctttctaccacctcttttcaacttcaaacctaacgaactgaaaggaaccccagttgatattgtggccaaattgatcccagagcatgcgagaaagcagtgctcgcatgcaggattg

SEQ ID NO: 1220 - protein, 408 aa, Brachypodium distachyon
  Bradi2g08890.1
MASVGIVPSGQKNSSSTSMGVEKLPDQMNDLKIRDDKEVEATIINGKGTETGHIIVTTTGGRNGQPKQTVSYMAERIVGQGSFGIVFQAKCLETGETVAIKKVLQDKRYKNRELQTMRLLDHPNVVALKHCFFSTTEKDELYLNLVLEYVPETVHRVVKHYNKMNQRMPLIYVKLYTYQICRALAYIHGSIGVCHRDIKPQNLLVNPHTHQLKLCDFGSAKVLVKGEPNISYICSRYYRAPELIFGATEYTTAIDIWSAGCVLAELMLGQPLFPGESGVDQLVEIIKVLGTPTREEIKCMNPNYTEFKFPQIKAHPWHKVFHKRMPPEAVDLVSRLLQYSPNLRCTAVEALIHPFFDELRDPNTRLPNGRFLPPLFNFKPNELKGTPVDIVAKLIPEHARKQCSHAGL

SEQ ID NO: 1221 - DNA, 1224 bp, Brachypodium distachyon; identical to SEQ ID NO: 1219
  Bradi2g08890.3

SEQ ID NO: 1222 - protein, 408 aa, Brachypodium distachyon; identical to SEQ ID NO: 1220
  Bradi2g08890.3

SEQ ID NO: 1223 - DNA, 1224 bp, Oryza sativa
  LOC_Os01g14860.1
atgggttcagtaggggttgcgccgtctgggttaaagaacagcagtagcaccagcatgggtgctgagaagttgcctgatcagatgcatgatctgaagataagggacgataaggaagttgaagcgactattattaacggcaagggaacagaaaccggccacataattgtcacaactactggtggcagaaatggtcagccgaaacagacagttagctacatggctgagcgtattgtagggcaaggttcatttgggattgtcttccaggcaaaatgtctggagacaggtgagacagttgctatcaagaaggttcttcaggataagcgctacaagaaccgtgagcttcagaccatgcgccttcttgaccacccaaatgttgtagctctgaagcactgtttcttctctacaactgagaaggatgaactgtatctaaacttggttcttgagtatgtgcctgaaactgttcatcgtgttgtgaagcattacaacaagatgaaccagcgtatgccacttatctatgtgaagctgtatatgtaccagatttgtagggcattagcttacatccataatagcatcggagtttgccacagagatatcaagccacagaatcttctggtaaacccacatacccatcaactcaagctatgtgactttgggagtgcaaaagttctggtcaagggagaaccgaacatatcgtacatttgctcccgatactatagggctccggagctcatatttggtgccaccgaatacactacagctattgacatctggtctgctggatgtgttcttgctgaacttatgttagggcagcctctgtttcctggtgaaagtggtgtagaccaacttgtggaaatcatcaaggtccttggaacacctacaagggaggaaattaaatgcatgaatccaaactataccgagttcaagtttccacagattaaagcacacccatggcacaaggtattccataaaaggttgcctccagaagctgttgatcttgtctctaggctgctccagtactcacccaacctaagatgcactgctgtggaagcacttgttcacccattctttgatgagcttcgagaccctaatgctcgccttccgaatggccgctttttgcctcctctcttcaacttcaagcctcatgaactgaaaggaatcccatcagatattatggcgaaattgatcccagaacatgtgaagaagcaatgctcctatgcaggagta

SEQ ID NO: 1224 - protein, 408 aa, Oryza sativa
  LOC_Os01g14860.1
MGSVGVAPSGLKNSSSTSMGAEKLPDQMHDLKIRDDKEVEATIINGKGTETGHIIVTTTGGRNGQPKQTVSYMAERIVGQGSFGIVFQAKCLETGETVAIKKVLQDKRYKNRELQTMRLLDHPNVVALKHCFFSTTEKDELYLNLVLEYVPETVHRVVKHYNKMNQRMPLIYVKLYMYQICRALAYIHNSIGVCHRDIKPQNLLVNPHTHQLKLCDFGSAKVLVKGEPNISYICSRYYRAPELIFGATEYTTAIDIWSAGCVLAELMLGQPLFPGESGVDQLVEIIKVLGTPTREEIKCMNPNYTEFKFPQIKAHPWHKVFHKRLPPEAVDLVSRLLQYSPNLRCTAVEALVHPFFDELRDPNARLPNGRFLPPLFNFKPHELKGIPSDIMAKLIPEHVKKQCSYAGV

SEQ ID NO: 1225 - DNA, 1224 bp, Oryza sativa; identical to SEQ ID NO: 1223
  LOC_Os01g14860.2

SEQ ID NO: 1226 - protein, 408 aa, Oryza sativa; identical to SEQ ID NO: 1224
  LOC_Os01g14860.2

SEQ ID NO: 1227 - DNA, 1224 bp, Oryza sativa; identical to SEQ ID NO: 1223
  LOC_Os01g14860.3

SEQ ID NO: 1228 - protein, 408 aa, Oryza sativa; identical to SEQ ID NO: 1224
  LOC_Os01g14860.3

SEQ ID NO: 1229 - DNA, 1008 bp, Oryza sativa
  LOC_Os01g14860.4
atggctgagcgtattgtagggcaaggttcatttgggattgtcttccaggcaaaatgtctggagacaggtgagacagttgctatcaagaaggttcttcaggataagcgctacaagaaccgtgagcttcagaccatgcgccttcttgaccacccaaatgttgtagctctgaagcactgtttcttctctacaactgagaaggatgaactgtatctaaacttggttcttgagtatgtgcctgaaactgttcatcgtgttgtgaagcattacaacaagatgaaccagcgtatgccacttatctatgtgaagctgtatatgtaccagatttgtagggcattagcttacatccataatagcatcggagtttgccacagagatatcaagccacagaatcttctggtaaacccacatacccatcaactcaagctatgtgactttgggagtgcaaaagttctggtcaagggagaaccgaacatatcgtacatttgctcccgatactatagggctccggagctcatatttggtgccaccgaatacactacagctattgacatctggtctgctggatgtgttcttgctgaacttatgttagggcagcctctgtttcctggtgaaagtggtgtagaccaacttgtggaaatcatcaaggtccttggaacacctacaagggaggaaattaaatgcatgaatccaaactataccgagttcaagtttccacagattaaagcacacccatggcacaaggtattccataaaaggttgcctccagaagctgttgatcttgtctctaggctgctccagtactcacccaacctaagatgcactgctgtggaagcacttgttcacccattctttgatgagcttcgagaccctaatgctcgccttccgaatggccgctttttgcctcctctcttcaacttcaagcctcatgaactgaaaggaatcccatcagatattatggcgaaattgatcccagaacatgtgaagaagcaatgctcctatgcaggagta

SEQ ID NO: 1230 - protein, 336 aa, Oryza sativa
  LOC_Os01g14860.4
MAERIVGQGSFGIVFQAKCLETGETVAIKKVLQDKRYKNRELQTMRLLDHPNVVALKHCFFSTTEKDELYLNLVLEYVPETVHRVVKHYNKMNQRMPLIYVKLYMYQICRALAYIHNSIGVCHRDIKPQNLLVNPHTHQLKLCDFGSAKVLVKGEPNISYICSRYYRAPELIFGATEYTTAIDIWSAGCVLAELMLGQPLFPGESGVDQLVEIIKVLGTPTREEIKCMNPNYTEFKFPQIKAHPWHKVFHKRLPPEAVDLVSRLLQYSPNLRCTAVEALVHPFFDELRDPNARLPNGRFLPPLFNFKPHELKGIPSDIMAKLIPEHVKKQCSYAGV

SEQ ID NO: 1231 - DNA, 1206 bp, Zea mays
  GRMZM2G024151_T01
atggcttcagctggtgtagccccatctgggtacaaaaacagcagcagcactagcattggtgccgagaagttgcaagatcagatgaacgagctaaagattagagatgataaggaagttgaagcaaccataattaatgggaaagggactgaaactgggcacataattgtcaccactactggtggcaagaatggtcaaccaaaacagacagtgagctacatggctgagcgcattgtaggtcaaggttcttttgggatcgtcttccaggctaagtgtttggagacgggtgagactgttgccataaagaaggttcttcaggataagcgttacaagaaccgcgagttgcagaccatgcgccttcttgaccaccctaatgttgttgctttgaagcattgcttcttttcaactaccgagaaggatgagctttatctgaacttggtccttgagtatgtgccggagacagttcatcgagttgtgaagcatcacaacaagatgaaccaacgcatgccacttatttatgtgaagctgtatatgtaccagatatgtagggcattggcttacattcatggcactattggtgtctgccacagagatattaagccacaaaaccttctggtgaacccacacacccaccagcttaaactatgtgactttggcagtgcaaaagttctggtcaagggggaaccaaacatatcgtacatctgctcccgatactatagggctccagagctcatatttggtgccactgagtataccacagcgattgacatttggtctgctggatgtgttcttgctgagcttatgctagggcagcctttgtttccgggtgaaagtggtgtggaccaacttgttgaaatcatcaaggtcctcggtacgccaacaagggaagaaattaaatgcatgaacccaaattacacagagtttaagttcccacaaatcaaagcacacccatggcacaaggtattccacaaaaggatgccgccagaagctgttgatctggtctctcggctactccagtactccccaaatctgagatgcactgctatggaggcacttgttcacccattctttgatgagcttcgagatcctaatactcgccttccaaatggtcgctttttgccaccactattcaatttcaagcctcacggtatgtttcatgcctacataattcaacatcgttatcatagctgctacaaccaggtagcagtg

SEQ ID NO: 1232 - protein, 402 aa, Zea mays
  GRMZM2G024151_T01
MASAGVAPSGYKNSSSTSIGAEKLQDQMNELKIRDDKEVEATIINGKGTETGHIIVTTTGGKNGQPKQTVSYMAERIVGQGSFGIVFQAKCLETGETVAIKKVLQDKRYKNRELQTMRLLDHPNVVALKHCFFSTTEKDELYLNLVLEYVPETVHRVVKHHNKMNQRMPLIYVKLYMYQICRALAYIHGTIGVCHRDIKPQNLLVNPHTHQLKLCDFGSAKVLVKGEPNISYICSRYYRAPELIFGATEYTTAIDIWSAGCVLAELMLGQPLFPGESGVDQLVEIIKVLGTPTREEIKCMNPNYTEFKFPQIKAHPWHKVFHKRMPPEAVDLVSRLLQYSPNLRCTAMEALVHPFFDELRDPNTRLPNGRFLPPLFNFKPHGMFHAYIIQHRYHSCYNQVAV

SEQ ID NO: 1233 - DNA, 1224 bp, Zea mays
  GRMZM2G024151_T02
atggcttcagctggtgtagccccatctgggtacaaaaacagcagcagcactagcattggtgccgagaagttgcaagatcagatgaacgagctaaagattagagatgataaggaagttgaagcaaccataattaatgggaaagggactgaaactgggcacataattgtcaccactactggtggcaagaatggtcaaccaaaacagacagtgagctacatggctgagcgcattgtaggtcaaggttcttttgggatcgtcttccaggctaagtgtttggagacgggtgagactgttgccataaagaaggttcttcaggataagcgttacaagaaccgcgagttgcagaccatgcgccttcttgaccaccctaatgttgttgctttgaagcattgcttcttttcaactaccgagaaggatgagctttatctgaacttggtccttgagtatgtgccggagacagttcatcgagttgtgaagcatcacaacaagatgaaccaacgcatgccacttatttatgtgaagctgtatatgtaccagatatgtagggcattggcttacattcatggcactattggtgtctgccacagagatattaagccacaaaaccttctggtgaacccacacacccaccagcttaaactatgtgactttggcagtgcaaaagttctggtcaagggggaaccaaacatatcgtacatctgctcccgatactatagggctccagagctcatatttggtgccactgagtataccacagcgattgacatttggtctgctggatgtgttcttgctgagcttatgctagggcagcctttgtttccgggtgaaagtggtgtggaccaacttgttgaaatcatcaaggtcctcggtacgccaacaagggaagaaattaaatgcatgaacccaaattacacagagtttaagttcccacaaatcaaagcacacccatggcacaaggtattccacaaaaggatgccgccagaagctgttgatctggtctctcggctactccagtactccccaaatctgagatgcactgctatggaggcacttgttcacccattctttgatgagcttcgagatcctaatactcgccttccaaatggtcgctttttgccaccactattcaatttcaagcctcacgaacttaaaggagtcccatcagacattgtcgcgaaattgattccagaacatgcaaagaagcaatgctcctatgttggattg

SEQ ID NO: 1234 - protein, 408 aa, Zea mays
  GRMZM2G024151_T02
MASAGVAPSGYKNSSSTSIGAEKLQDQMNELKIRDDKEVEATIINGKGTETGHIIVTTTGGKNGQPKQTVSYMAERIVGQGSFGIVFQAKCLETGETVAIKKVLQDKRYKNRELQTMRLLDHPNVVALKHCFFSTTEKDELYLNLVLEYVPETVHRVVKHHNKMNQRMPLIYVKLYMYQICRALAYIHGTIGVCHRDIKPQNLLVNPHTHQLKLCDFGSAKVLVKGEPNISYICSRYYRAPELIFGATEYTTAIDIWSAGCVLAELMLGQPLFPGESGVDQLVEIIKVLGTPTREEIKCMNPNYTEFKFPQIKAHPWHKVFHKRMPPEAVDLVSRLLQYSPNLRCTAMEALVHPFFDELRDPNTRLPNGRFLPPLFNFKPHELKGVPSDIVAKLIPEHAKKQCSYVGL

SEQ ID NO: 1235 - DNA, 684 bp, Zea mays
  GRMZM2G129482_T01
atgcaccaacacatgccacttatttatgtgaagctttatatgtaccagatatgtagagcattggcttacattcatgatgaaattgtttggtacttagaaattgattttcaaacttcagtacaggtgaacccacacacccaccagcttaaactatgtgactttggtagtgcaaaagttctggtcaagggggaaccaaacatatcatacatctgctcgcgatactatagggctccagagctcatatttggtgccactgagtataccacagcgattgacatttggtctgctggttgtgttcttgctgagcttatgctagggcaggtccttggtactccaacaagggaagaaattaaatgcatgaacccgaattgcacagagtttaagttcccacaaatcaaagcacacccatggcacaaggtattcaacaaaaggatgccgccagaagctgttgatctggtctctcggctactccagtactccccaaatctgagatgcactgctgtggaggcgcttgtccacccattctttgacgagcttcgagatcctaatactcgtcttccaaatggccgcttcctgccaccccttttcaacttcaagcctcacgaattgaaaggagtcccagcagacattgttgcgagattggttccagaacatgcgaagaagcaatgctcttatgttggatcg

SEQ ID NO: 1236 - protein, 228 aa, Zea mays
  GRMZM2G129482_T01
MHQHMPLIYVKLYMYQICRALAYIHDEIVWYLEIDFQTSVQVNPHTHQLKLCDFGSAKVLVKGEPNISYICSRYYRAPELIFGATEYTTAIDIWSAGCVLAELMLGQVLGTPTREEIKCMNPNCTEFKFPQIKAHPWHKVFNKRMPPEAVDLVSRLLQYSPNLRCTAVEALVHPFFDELRDPNTRLPNGRFLPPLFNFKPHELKGVPADIVARLVPEHAKKQCSYVGS

SEQ ID NO: 1237 - DNA, 1350 bp, Zea mays
  GRMZM5G835235_T01
atggcttcagctggtgttgccccttctgggtacaagaacagcagcagcaccagcattggtgccgaaaagttgcaagatcacatgaacgagctaaagattagagatgataaggaagttgaagcaaccataattaatgggaaagggaccgaaactgggcacataattgtcaccactactggtggcaagaatggtcaaccaaaacagacagtgagctacatggctgagcgcattgtaggtcaaggttcttttgggattgtcttccaggccaagtgtttggaaacgggtgagactgttgccataaagaaggttcttcaagacaagcgttacaagaaccgcgaactgcagaccatgcgcctccttgaccaccctaatgttgttgctttgaagcattgcttcttttcaacaactgagaaggatgagctttatctaaatttggtccttgagtatgttccggagacagttcatcgagttgtgaaacatcacaacaagatgcaccaacgcatgccacttatttatgtgaagctttatatgtaccagatatgtagagcattggcttacattcatggtactatcggtgtctgccacagagatattaagccacaaaatcttctggtgaacccacacacccaccagcttaaaatatgtgactttggtagtgcaaaagttctggtcaagggggaaccaaacatatcatacatctgctcgcgatactatagggctccagagctcatatttggtgccactgagtataccacagcgattgacatttggtctgctggttgtgttcttgctgagcttatgctagggcagcctttgtttccaggtgaaagtggtgtggaccaactcgtcgaaatcatcaaggtccttggtactccaacaagggaagaaattaaatgcatgaacccgaattacacagagtttaagttcccacaaatcaaagctcacccatggcacaaggtattcaacaaaaggatgccgccagaagctgttgatctggtctctcggctactccagtactccccaaatctgagatgcactgctgtggaggcgcttgtccacccattctttgacgagcttcgagatcctaatactcgtcttccaaatggccgcttcctgccaccccttttcaacttcaagcctcacggtatgtttcatgcctactcgtttcagcattattgtcgatgctgttacagccagctaaatgtgtatctccaagtttgttctttgtatatccaccagctcacatgcttctgccacttctgttctgcagaattgaaaggagtcccagcagacattgttgcgaaattggttccagaacatgcgaagaagcaatgctcttatgttggatcg

SEQ ID NO: 1238 - protein, 450 aa, Zea mays
  GRMZM5G835235_T01
MASAGVAPSGYKNSSSTSIGAEKLQDHMNELKIRDDKEVEATIINGKGTETGHIIVTTTGGKNGQPKQTVSYMAERIVGQGSFGIVFQAKCLETGETVAIKKVLQDKRYKNRELQTMRLLDHPNVVALKHCFFSTTEKDELYLNLVLEYVPETVHRVVKHHNKMHQRMPLIYVKLYMYQICRALAYIHGTIGVCHRDIKPQNLLVNPHTHQLKICDFGSAKVLVKGEPNISYICSRYYRAPELIFGATEYTTAIDIWSAGCVLAELMLGQPLFPGESGVDQLVEIIKVLGTPTREEIKCMNPNYTEFKFPQIKAHPWHKVFNKRMPPEAVDLVSRLLQYSPNLRCTAVEALVHPFFDELRDPNTRLPNGRFLPPLFNFKPHGMFHAYSFQHYCRCCYSQLNVYLQVCSLYIHQLTCFCHFCSAELKGVPADIVAKLVPEHAKKQCSYVGS

SEQ ID NO: 1239 - DNA, 1224 bp, Zea mays
  GRMZM5G835235_T04
atggcttcagctggtgttgccccttctgggtacaagaacagcagcagcaccagcattggtgccgaaaagttgcaagatcacatgaacgagctaaagattagagatgataaggaagttgaagcaaccataattaatgggaaagggaccgaaactgggcacataattgtcaccactactggtggcaagaatggtcaaccaaaacagacagtgagctacatggctgagcgcattgtaggtcaaggttcttttgggattgtcttccaggccaagtgtttggaaacgggtgagactgttgccataaagaaggttcttcaagacaagcgttacaagaaccgcgaactgcagaccatgcgcctccttgaccaccctaatgttgttgctttgaagcattgcttcttttcaacaactgagaaggatgagctttatctaaatttggtccttgagtatgttccggagacagttcatcgagttgtgaaacatcacaacaagatgcaccaacgcatgccacttatttatgtgaagctttatatgtaccagatatgtagagcattggcttacattcatggtactatcggtgtctgccacagagatattaagccacaaaatcttctggtgaacccacacacccaccagcttaaaatatgtgactttggtagtgcaaaagttctggtcaagggggaaccaaacatatcatacatctgctcgcgatactatagggctccagagctcatatttggtgccactgagtataccacagcgattgacatttggtctgctggttgtgttcttgctgagcttatgctagggcagcctttgtttccaggtgaaagtggtgtggaccaactcgtcgaaatcatcaaggtccttggtactccaacaagggaagaaattaaatgcatgaacccgaattacacagagtttaagttcccacaaatcaaagctcacccatggcacaaggtattcaacaaaaggatgccgccagaagctgttgatctggtctctcggctactccagtactccccaaatctgagatgcactgctgtggaggcgcttgtccacccattctttgacgagcttcgagatcctaatactcgtcttccaaatggccgcttcctgccaccccttttcaacttcaagcctcacgaattgaaaggagtcccagcagacattgttgcgaaattggttccagaacatgcgaagaagcaatgctcttatgttggatcg

SEQ ID NO: 1240 - protein, 408 aa, Zea mays
  GRMZM5G835235_T04
MASAGVAPSGYKNSSSTSIGAEKLQDHMNELKIRDDKEVEATIINGKGTETGHIIVTTTGGKNGQPKQTVSYMAERIVGQGSFGIVFQAKCLETGETVAIKKVLQDKRYKNRELQTMRLLDHPNVVALKHCFFSTTEKDELYLNLVLEYVPETVHRVVKHHNKMHQRMPLIYVKLYMYQICRALAYIHGTIGVCHRDIKPQNLLVNPHTHQLKICDFGSAKVLVKGEPNISYICSRYYRAPELIFGATEYTTAIDIWSAGCVLAELMLGQPLFPGESGVDQLVEIIKVLGTPTREEIKCMNPNYTEFKFPQIKAHPWHKVFNKRMPPEAVDLVSRLLQYSPNLRCTAVEALVHPFFDELRDPNTRLPNGRFLPPLFNFKPHELKGVPADIVAKLVPEHAKKQCSYVGS

SEQ ID NO: 1241 - DNA, 1119 bp, Zea mays
  GRMZM5G835235_T03
atggcttcagctggtgttgccccttctgggtacaagaacagcagcagcaccagcattggtgccgaaaagttgcaagatcacatgaacgagctaaagattagagatgataaggaagttgaagcaaccataattaatgggaaagggaccgaaactgggcacataattgtcaccactactggtggcaagaatggtcaaccaaaacagacagtgagctacatggctgagcgcattgtaggtcaaggttcttttgggattgtcttccaggccaagtgtttggaaacgggtgagactgttgccataaagaaggttcttcaagacaagcgttacaagaaccgcgaactgcagaccatgcgcctccttgaccaccctaatgttgttgctttgaagcattgcttcttttcaacaactgagaaggatgagctttatctaaatttggtccttgagtatgttccggagacagttcatcgagttgtgaaacatcacaacaagatgcaccaacgcatgccacttatttatgtgaagctttatatgtaccagatatgtagagcattggcttacattcatggtactatcggtgtctgccacagagatattaagccacaaaatcttctggtgaacccacacacccaccagcttaaaatatgtgactttggtagtgcaaaagttctggtcaagggggaaccaaacatatcatacatctgctcgcgatactatagggctccagagctcatatttggtgccactgagtataccacagcgattgacatttggtctgctggttgtgttcttgctgagcttatgctagggcagcctttgtttccaggtgaaagtggtgtggaccaactcgtcgaaatcatcaaggtccttggtactccaacaagggaagaaattaaatgcatgaacccgaattacacagagtttaagttcccacaaatcaaagctcacccatggcacaaggtattcaacaaaaggatgccgccagaagctgttgatctggtctctcggctactccagtactccccaaatctgagatgcactgaattgaaaggagtcccagcagacattgttgcgaaattggttccagaacatgcgaagaagcaatgctcttatgttggatcg

SEQ ID NO: 1242 - protein, 373 aa, Zea mays
  GRMZM5G835235_T03
MASAGVAPSGYKNSSSTSIGAEKLQDHMNELKIRDDKEVEATIINGKGTETGHIIVTTTGGKNGQPKQTVSYMAERIVGQGSFGIVFQAKCLETGETVAIKKVLQDKRYKNRELQTMRLLDHPNVVALKHCFFSTTEKDELYLNLVLEYVPETVHRVVKHHNKMHQRMPLIYVKLYMYQICRALAYIHGTIGVCHRDIKPQNLLVNPHTHQLKICDFGSAKVLVKGEPNISYICSRYYRAPELIFGATEYTTAIDIWSAGCVLAELMLGQPLFPGESGVDQLVEIIKVLGTPTREEIKCMNPNYTEFKFPQIKAHPWHKVFNKRMPPEAVDLVSRLLQYSPNLRCTELKGVPADIVAKLVPEHAKKQCSYVGS

SEQ ID NO: 1243 - DNA, 960 bp, Zea mays
  GRMZM5G835235_T02
atggcttcagctggtgttgccccttctgggtacaagaacagcagcagcaccagcattggtgccgaaaagttgcaagatcacatgaacgagctaaagattagagatgataaggaagttgaagcaaccataattaatgggaaagggaccgaaactgggcacataattgtcaccactactggtggcaagaatggtcaaccaaaacagacagtgagctacatggctgagcgcattgtaggtcaaggttcttttgggattgtcttccaggccaagtgtttggaaacgggtgagactgttgccataaagaaggttcttcaagacaagcgttacaagaaccgcgaactgcagaccatgcgcctccttgaccaccctaatgttgttgctttgaagcattgcttcttttcaacaactgagaaggatgagctttatctaaatttggtccttgagtatgttccggagacagttcatcgagttgtgaaacatcacaacaagatgcaccaacgcatgccacttatttatgtgaagctttatatgtaccagatatgtagagcattggcttacattcatggtactatcggtgtctgccacagagatattaagccacaaaatcttctggtgaacccacacacccaccagcttaaaatatgtgactttggtagtgcaaaagttctggtcaagggggaaccaaacatatcatacatctgctcgcgatactatagggctccagagctcatatttggtgccactgagtataccacagcgattgacatttggtctgctggttgtgttcttgctgagcttatgctagggcagcctttgtttccaggtgaaagtggtgtggaccaactcgtcgaaatcatcaaggtccttggtactccaacaagggaagaaattaaatgcatgaacccgaattacacagagtttaagttcccacaaatcaaagctcacccatggcacaaggtg

SEQ ID NO: 1244 - protein, 320 aa, Zea mays
  GRMZM5G835235_T02
MASAGVAPSGYKNSSSTSIGAEKLQDHMNELKIRDDKEVEATIINGKGTETGHIIVTTTGGKNGQPKQTVSYMAERIVGQGSFGIVFQAKCLETGETVAIKKVLQDKRYKNRELQTMRLLDHPNVVALKHCFFSTTEKDELYLNLVLEYVPETVHRVVKHHNKMHQRMPLIYVKLYMYQICRALAYIHGTIGVCHRDIKPQNLLVNPHTHQLKICDFGSAKVLVKGEPNISYICSRYYRAPELIFGATEYTTAIDIWSAGCVLAELMLGQPLFPGESGVDQLVEIIKVLGTPTREEIKCMNPNYTEFKFPQIKAHPWHKV

SEQ ID NO: 1245 - DNA, 1224 bp, Setaria italica
  Si001664m
atggcttcagcaggtgtagccccatctgggtacaagcacagcagcagcaccaacgttggtgctgataagttgcaggatcacatgaacgagctaaagattagagatgataaggaagttgaagcaaccataattaatgggaaaggaacagaaactgggcacataattgtgactactactggtggcaagaatggtcaaccgaaacagacggtgagctacatggctgagcgcattgtaggccaaggttcttttgggattgtcttccaggctaaatgcttggagacgggtgagactgttgccataaagaaggttcttcaggataagcgttacaagaaccgtgagctgcagaccatgcgccttcttgaccaccctaatgttgtcgctttgaagcattgcttcttttcaactaccgagaaggatgaactgtatctaaacttggttcttgagtatgtgcctgagactgttcatcgagtcgtgaaacatcacaacaagatgaaccaacgtatgccacttatttatgtgaagctgtatatgtaccagatatgtagggcactggcttacattcatggtagtattggtgtttgccacagagatatcaagccacaaaaccttctggtgaacccacacactcaccagcttaaactatgtgactttggaagtgcaaaagttctggtcaagggggaacccaacatatcatacatctgttcccgatactacagggcacctgagctcatatttggtgccactgagtacactacagcaattgacatttggtctgctggatgtgttcttgctgagcttatgctagggcagcctttgtttcccggtgaaagtggtgtggaccaacttgttgaaatcatcaaggtccttggtacccctacaagggaagaaattaaatgcatgaacccgaactacacagagtttaaattcccacaaatcaaagcacacccatggcacaaggtgtttcacaaaaggatgccaccagaagctgttgatctggtctcccggctgctccagtactcccccaatctgagatgcactgctgttgaggcacttgttcacccattctttgatgagcttcgagaccctaatacccgtcttccaaatggccgctttctaccaccccttttcaacttcaagccgcatgaactgaaaggagtcccagcagacattgtcgcgaaattgatcccagaacacgcaaagaagcaatgcccctatgttggattg

SEQ ID NO: 1246 - protein, 408 aa, Setaria italica
  Si001664m
MASAGVAPSGYKHSSSTNVGADKLQDHMNELKIRDDKEVEATIINGKGTETGHIIVTTTGGKNGQPKQTVSYMAERIVGQGSFGIVFQAKCLETGETVAIKKVLQDKRYKNRELQTMRLLDHPNVVALKHCFFSTTEKDELYLNLVLEYVPETVHRVVKHHNKMNQRMPLIYVKLYMYQICRALAYIHGSIGVCHRDIKPQNLLVNPHTHQLKLCDFGSAKVLVKGEPNISYICSRYYRAPELIFGATEYTTAIDIWSAGCVLAELMLGQPLFPGESGVDQLVEIIKVLGTPTREEIKCMNPNYTEFKFPQIKAHPWHKVFHKRMPPEAVDLVSRLLQYSPNLRCTAVEALVHPFFDELRDPNTRLPNGRFLPPLFNFKPHELKGVPADIVAKLIPEHAKKQCPYVGL

SEQ ID NO: 1247 - DNA, 1122 bp, Setaria italica
  Si001882m
atggcttcagcaggtgtagccccatctgggtacaagcacagcagcagcaccaacgttggtgctgataagttgcaggatcacatgaacgagctaaagattagagatgataaggaagttgaagcaaccataattaatgggaaaggaacagaaactgggcacataattgtgactactactggtggcaagaatggtcaaccgaaacagacggtgagctacatggctgagcgcattgtaggccaaggttcttttgggattgtcttccaggctaaatgcttggagacgggtgagactgttgccataaagaaggttcttcaggataagcgttacaagaaccgtgagctgcagaccatgcgccttcttgaccaccctaatgttgtcgctttgaagcattgcttcttttcaactaccgagaaggatgaactgtatctaaacttggttcttgagtatgtgcctgagactgttcatcgagtcgtgaaacatcacaacaagatgaaccaacgtatgccacttatttatgtgaagctgtatatgtaccagatatgtagggcactggcttacattcatggtagtattggtgtttgccacagagatatcaagccacaaaaccttctggtgaacccacacactcaccagcttaaactatgtgactttggaagtgcaaaagttctggtcaagggggaacccaacatatcatacatctgttcccgatactacagggcacctgagctcatatttggtgccactgagtacactacagcaattgacatttggtctgctggatgtgttcttgctgagcttatgctagggcagcctttgtttcccggtgaaagtggtgtggaccaacttgttgaaatcatcaaggtccttggtacccctacaagggaagaaattaaatgcatgaacccgaactacacagagtttaaattcccacaaatcaaagcacacccatggcacaaggtgtttcacaaaaggatgccaccagaagctgttgatctggtctcccggctgctccagtactcccccaatctgagatgcactgctgtaagtaaatgtcactgcacattacatagtggaaatgcgcatggcatcggaccactgttccaattcctgcattttccttgt

SEQ ID NO: 1248 - protein, 374 aa, Setaria italica
  Si001882m
MASAGVAPSGYKHSSSTNVGADKLQDHMNELKIRDDKEVEATIINGKGTETGHIIVTTTGGKNGQPKQTVSYMAERIVGQGSFGIVFQAKCLETGETVAIKKVLQDKRYKNRELQTMRLLDHPNVVALKHCFFSTTEKDELYLNLVLEYVPETVHRVVKHHNKMNQRMPLIYVKLYMYQICRALAYIHGSIGVCHRDIKPQNLLVNPHTHQLKLCDFGSAKVLVKGEPNISYICSRYYRAPELIFGATEYTTAIDIWSAGCVLAELMLGQPLFPGESGVDQLVEIIKVLGTPTREEIKCMNPNYTEFKFPQIKAHPWHKVFHKRMPPEAVDLVSRLLQYSPNLRCTAVSKCHCTLHSGNAHGIGPLFQFLHFPC

SEQ ID NO: 1249 - DNA, 1227 bp, Brachypodium distachyon
  Bradi2g11370.1
atgacatcaataggtctagtacatccttcatcaggttttcaggaaacaagtactagtggagcgaatgatcgactaccagaggagataaacgagatgaacataagagattgcaaggaagttgaagctgtggttgtcaatggcagtgtgatggacataggtcatattatcgtgacggctgtcggcggaagaaatgggcagccaaagcagacatttagttacatggctgagcgtgttgtggggcatggttcatttggagttgtctttcaggcaaagtgtctggaaactggtgagagaatagctataaagaaagttcttcaagatgcgaggtataagaaccgtgagctgcaaactatgcaagttcttgatcacccaaatgttgtatgcttgaagcattacttttactcaacaactgagaaggatgagcaatacctcaatttggtacttgaatacgtgccagaaactgttcatcgtgttattaaacattacaataagatgaaccaacgcatgccattgatatatgtcaaactttatatctatcagatctgtagagctttatcatacattcataactgcgtaggagtatgccacagagacataaaaccacaaaatattctggtgaacccccatactcatcagctgaaactgtgtgactttggcagtgcaaaagttttggtaaaaggcgagccaaatatttcatatatctgctctagatactacagagctcctgagctcatatttggtgctacagagtacacaacagctattgacgtgtggtcagctggttgtgttcttgctgaactccttctggggcagcctgtttttcctggggacagtggtgttgaccagcttgttgaaattatcaaggttctgggtactccgacacgtgaagaaattaaacgtatgaacccaaactacactgagttcaagttcccccaaatcaaagctcacccatggcacaagatcttcaataaaagaatgccagctgaagctgtagatcttgtttctcgtcttctgcagtactcaccaaacctccggtcaactgcattggaggtattagtccatccattctttgatgaactacgggatccaaacacccgcttaccgaatggccgccctcttcctcctctcttcaattttaagcctcgtgagttgaaaggagcacaaatggagtttcttgtgaagttggtaccgcagcatgctaagaagcaatgtgccttcttaggacta

SEQ ID NO: 1250 - protein, 409 aa, Brachypodium distachyon
  Bradi2g11370.1
MTSIGLVHPSSGFQETSTSGANDRLPEEINEMNIRDCKEVEAVVVNGSVMDIGHIIVTAVGGRNGQPKQTFSYMAERVVGHGSFGVVFQAKCLETGERIAIKKVLQDARYKNRELQTMQVLDHPNVVCLKHYFYSTTEKDEQYLNLVLEYVPETVHRVIKHYNKMNQRMPLIYVKLYIYQICRALSYIHNCVGVCHRDIKPQNILVNPHTHQLKLCDFGSAKVLVKGEPNISYICSRYYRAPELIFGATEYTTAIDVWSAGCVLAELLLGQPVFPGDSGVDQLVEIIKVLGTPTREEIKRMNPNYTEFKFPQIKAHPWHKIFNKRMPAEAVDLVSRLLQYSPNLRSTALEVLVHPFFDELRDPNTRLPNGRPLPPLFNFKPRELKGAQMEFLVKLVPQHAKKQCAFLGL

SEQ ID NO: 1251 - DNA, 1224 bp, Oryza sativa
  LOC_Os01g19150.1
atgacatcggtgggtctagtagattcttcatcaggtttcccggaaacgagtactagtggagccactgatcgtctgacagatgatatcagcgagatgagcataagagataaggaagttgaagctgtagtggtcagtggcaatagtatggacataggtcacactattgtgacaactgttggtggaagaaatgggcagccaaagcagacaattagttacatcgcagagcgtgctgttgggcgtggttcatttggagttgtcttccaggctaagtgtctagaaactggtgagagagttgctgtaaagaaagttcttcaagatgcgagatacaagaaccgggagctgcaaacgatgcaagttctcgatcacccaaatgttgcatgcttgaagcattacttttgctcgactactgcgaaggaggagctatacctcaacttggttcttgaatatgtgccagaaactgttcatcgtgttattagacattacaataagatgagccaacgcatgccattgatttatgttaaactttatatgtaccagatttgtagggctttggcatacattcataactgtgtgggagtatgccacagagatataaagccacagaatatattggtgaatccacataatcatcagttgaaattgtgtgactttggcagtgcaaaagtcctggtgaaaggggaaccaaatatttcatatatctgttctagatactacagagccccagaactcatatttggggctacagagtacacgacagctattgatgtgtggtctgctggctgtgttcttgctgaactacttctagggcagcctgtttttcctggtgacagtggcgtcgaccaacttgttgaaattatcaaggtactgggtactccaacaagggaagaaatcaaacatatgaatccgaactacactgagtttaagttcccccaaatcaaagctcacccatggcacaagatctttcataaaagaatgccatctgaagctgtagatcttgtgtctcggcttctgcagtactcaccacacctccggtgcagtgcattggaggtgttaattcatccattcttcgatgaactacgagatccaaatgctcgcttaccaaatggccgtactcttcccccactattcaatttcaagcctcgtgagctgaaaggagcatcaatggaatttcttgtgaagttggttccacagcatgctaagaagcaatgtgccttcttaggatta

SEQ ID NO: 1252 - protein, 408 aa, Oryza sativa
  LOC_Os01g19150.1
MTSVGLVDSSSGFPETSTSGATDRLTDDISEMSIRDKEVEAVVVSGNSMDIGHTIVTTVGGRNGQPKQTISYIAERAVGRGSFGVVFQAKCLETGERVAVKKVLQDARYKNRELQTMQVLDHPNVACLKHYFCSTTAKEELYLNLVLEYVPETVHRVIRHYNKMSQRMPLIYVKLYMYQICRALAYIHNCVGVCHRDIKPQNILVNPHNHQLKLCDFGSAKVLVKGEPNISYICSRYYRAPELIFGATEYTTAIDVWSAGCVLAELLLGQPVFPGDSGVDQLVEIIKVLGTPTREEIKHMNPNYTEFKFPQIKAHPWHKIFHKRMPSEAVDLVSRLLQYSPHLRCSALEVLIHPFFDELRDPNARLPNGRTLPPLFNFKPRELKGASMEFLVKLVPQHAKKQCAFLGL

SEQ ID NO: 1253 - DNA, 1311 bp, Oryza sativa
  LOC_Os01g19150.2
atgacatcggtgggtctagtagattcttcatcaggtttcccggaaacgagtactagtggagccactgatcgtctgacagatgatatcagcgagatgagcataagagataaggaagttgaagctgtagtggtcagtggcaatagtatggacataggtcacactattgtgacaactgttggtggaagaaatgggcagccaaagcagacaattagttacatcgcagagcgtgctgttgggcgtggttcatttggagttgtcttccaggctaagtgtctagaaactggtgagagagttgctgtaaagaaagttcttcaagatgcgagatacaagaaccgggagctgcaaacgatgcaagttctcgatcacccaaatgttgcatgcttgaagcattacttttgctcgactactgcgaaggaggagctatacctcaacttggttcttgaatatgtgccagaaactgttcatcgtgttattagacattacaataagatgagccaacgcatgccattgatttatgttaaactttatatgtaccagatttgtagggctttggcatacattcataactgtgtgggagtatgccacagagatataaagccacagaatatattggtgaatccacataatcatcagttgaaattgtgtgactttggcagtgcaaaagtcctggtgaaaggggaaccaaatatttcatatatctgttctagatactacagagccccagaactcatatttggggctacagagtacacgacagctattgatgtgtggtctgctggctgtgttcttgctgaactacttctagggcagcctgtttttcctggtgacagtggcgtcgaccaacttgttgaaattatcaaggtactgggtactccaacaagggaagaaatcaaacatatgaatccgaactacactgagtttaagttcccccaaatcaaagctcacccatggcacaagatctttcataaaagaatgccatctgaagctgtagatcttgtgtctcggcttctgcagtactcaccacacctccggtgcagtgcagtaagtattaatgcatatatcaggaaatctcttgtaaatgtttctatgtactcattttacatcttcctttttttctcctcgcaccagttggaggtgttaattcatccattcttcgatgaactacgagatccaaatgctcgcttaccaaatggccgtactcttcccccactattcaatttcaagcctcgtgagctgaaaggagcatcaatggaatttcttgtgaagttggttccacagcatgctaagaagcaatgtgccttcttaggatta

SEQ ID NO: 1254 - protein, 437 aa, Oryza sativa
  LOC_Os01g19150.2
MTSVGLVDSSSGFPETSTSGATDRLTDDISEMSIRDKEVEAVVVSGNSMDIGHTIVTTVGGRNGQPKQTISYIAERAVGRGSFGVVFQAKCLETGERVAVKKVLQDARYKNRELQTMQVLDHPNVACLKHYFCSTTAKEELYLNLVLEYVPETVHRVIRHYNKMSQRMPLIYVKLYMYQICRALAYIHNCVGVCHRDIKPQNILVNPHNHQLKLCDFGSAKVLVKGEPNISYICSRYYRAPELIFGATEYTTAIDVWSAGCVLAELLLGQPVFPGDSGVDQLVEIIKVLGTPTREEIKHMNPNYTEFKFPQIKAHPWHKIFHKRMPSEAVDLVSRLLQYSPHLRCSAVSINAYIRKSLVNVSMYSFYIFLFFSSHQLEVLIHPFFDELRDPNARLPNGRTLPPLFNFKPRELKGASMEFLVKLVPQHAKKQCAFLGL

SEQ ID NO: 1255 - DNA, 1224 bp, Oryza sativa; identical to SEQ ID NO: 1251
  LOC_Os01g19150.5

SEQ ID NO: 1256 - protein, 408 aa, Oryza sativa; identical to SEQ ID NO: 1252
  LOC_Os01g19150.5

SEQ ID NO: 1257 - DNA, 876 bp, Oryza sativa
  LOC_Os01g19150.3
atgcaagttctcgatcacccaaatgttgcatgcttgaagcattacttttgctcgactactgcgaaggaggagctatacctcaacttggttcttgaatatgtgccagaaactgttcatcgtgttattagacattacaataagatgagccaacgcatgccattgatttatgttaaactttatatgtaccagatttgtagggctttggcatacattcataactgtgtgggagtatgccacagagatataaagccacagaatatattggtgaatccacataatcatcagttgaaattgtgtgactttggcagtgcaaaagtcctggtgaaaggggaaccaaatatttcatatatctgttctagatactacagagccccagaactcatatttggggctacagagtacacgacagctattgatgtgtggtctgctggctgtgttcttgctgaactacttctagggcagcctgtttttcctggtgacagtggcgtcgaccaacttgttgaaattatcaaggtactgggtactccaacaagggaagaaatcaaacatatgaatccgaactacactgagtttaagttcccccaaatcaaagctcacccatggcacaagatctttcataaaagaatgccatctgaagctgtagatcttgtgtctcggcttctgcagtactcaccacacctccggtgcagtgcattggaggtgttaattcatccattcttcgatgaactacgagatccaaatgctcgcttaccaaatggccgtactcttcccccactattcaatttcaagcctcgtgagctgaaaggagcatcaatggaatttcttgtgaagttggttccacagcatgctaagaagcaatgtgccttcttaggatta

SEQ ID NO: 1258 - protein, 292 aa, Oryza sativa
  LOC_Os01g19150.3
MQVLDHPNVACLKHYFCSTTAKEELYLNLVLEYVPETVHRVIRHYNKMSQRMPLIYVKLYMYQICRALAYIHNCVGVCHRDIKPQNILVNPHNHQLKLCDFGSAKVLVKGEPNISYICSRYYRAPELIFGATEYTTAIDVWSAGCVLAELLLGQPVFPGDSGVDQLVEIIKVLGTPTREEIKHMNPNYTEFKFPQIKAHPWHKIFHKRMPSEAVDLVSRLLQYSPHLRCSALEVLIHPFFDELRDPNARLPNGRTLPPLFNFKPRELKGASMEFLVKLVPQHAKKQCAFLGL

SEQ ID NO: 1259 - DNA, 669 bp, Oryza sativa
  LOC_Os01g19150.4
atgcaagttctcgatcacccaaatgttgcatgcttgaagcattacttttgctcgactactgcgaaggaggagctatacctcaacttggttcttgaatatgtgccagaaactgttcatcgtgttattagacattacaataagatgagccaacgcatgccattgatttatgttaaactttatatgtaccagatttgtagggctttggcatacattcataactgtgtgggagtatgccacagagatataaagccacagaatatattggtgaatccacataatcatcagttgaaattgtgtgactttggcagtgcaaaagtcctggtgaaaggggaaccaaatatttcatatatctgttctagatactacagagccccagaactcatatttggggctacagagtacacgacagctattgatgtgtggtctgctggctgtgttcttgctgaactacttctagggcagcctgtttttcctggtgacagtggcgtcgaccaacttgttgaaattatcaaggtactgggtactccaacaagggaagaaatcaaacatatgaatccgaactacactgagtttaagttcccccaaatcaaagctcacccatggcacaagatcttgtgtctcggcttctgcagtactcaccacacctccggtgcagtgcattggaggtgt

SEQ ID NO: 1260 - protein, 223 aa, Oryza sativa
  LOC_Os01g19150.4
MQVLDHPNVACLKHYFCSTTAKEELYLNLVLEYVPETVHRVIRHYNKMSQRMPLIYVKLYMYQICRALAYIHNCVGVCHRDIKPQNILVNPHNHQLKLCDFGSAKVLVKGEPNISYICSRYYRAPELIFGATEYTTAIDVWSAGCVLAELLLGQPVFPGDSGVDQLVEIIKVLGTPTREEIKHMNPNYTEFKFPQIKAHPWHKILCLGFCSTHHTSGAVHWRC

SEQ ID NO: 1261 - DNA, 1224 bp, Setaria italica
  Si001662m
atgacatcagtaggtctactgaatccctcatcaggttatgaagctagtactagtggcgccactgatagattgccagatgagatgaatgggatgagcataagagatgaaaaggaagttgaagctgttgttgtcaatggcaatgggatggaggttggtcataccatcgtaacatctgttggtggaagaaattcgcagccaaggcagactattagttacatggcagagcgtattgtggggcaaggttcatttggagttgtcttccaggcccggtgtctggaaactagtgagagagtagctataaagaaagttcttcaagatgtgaggtacaagaaccgtgaactgcaaacaatgcaagttcttgatcaccctaatgttgtatgcttgaagcattacttttgctcaacaactgataaggaagagctttacctcaatttggtgcttgaatatgtgccagaaactgttcaccgtgttattaaacattacaataaaatgaatcaacggatgccgttgatatatgtcaaactctatatgtaccagatttgtagagctttggcatacatgcataattgtgtaggagtatgccacagagatataaagccacaaaatattctggtgaacccacatactcatcaactgaaattgtgtgattttggcagtgcgaaagtcttggtacgaggggaaccaaatatttcatatatctgttctagatactacagagctccagagctcatatttggtgctacagagtacacgacagctattgatgtgtggtctgctggctgtgttcttgctgaacttcttctagggcagcctgtttttcctggggatagtggcgtcgatcagcttgttgaaattatcaaggttctaggtactccaacacgagatgaaattaagcgcatgaacccaaactatactgagtttaagttcccacaaatcaaagctcacccatggcacaagatcttccacaaaagaatgccatctgaagctgtagatcttgtttcacggctcctacagtactcaccaaacctccggtgcactgcattggaggctttaatccatccattctttgatgaactacgtgatccgaatgcccgattaccgaatggtcgttctcttccccatctcttcaattttaagcctaatgagttaagaggagtaccgatggagtttctcatgaaattaattcctcagcatgctaagaagcaatgtgccttcttaggaata

SEQ ID NO: 1262 - protein, 408 aa, Setaria italica
  Si001662m
MTSVGLLNPSSGYEASTSGATDRLPDEMNGMSIRDEKEVEAVVVNGNGMEVGHTIVTSVGGRNSQPRQTISYMAERIVGQGSFGVVFQARCLETSERVAIKKVLQDVRYKNRELQTMQVLDHPNVVCLKHYFCSTTDKEELYLNLVLEYVPETVHRVIKHYNKMNQRMPLIYVKLYMYQICRALAYMHNCVGVCHRDIKPQNILVNPHTHQLKLCDFGSAKVLVRGEPNISYICSRYYRAPELIFGATEYTTAIDVWSAGCVLAELLLGQPVFPGDSGVDQLVEIIKVLGTPTRDEIKRMNPNYTEFKFPQIKAHPWHKIFHKRMPSEAVDLVSRLLQYSPNLRCTALEALIHPFFDELRDPNARLPNGRSLPHLFNFKPNELRGVPMEFLMKLIPQHAKKQCAFLGI

SEQ ID NO: 1263 - DNA, 1224 bp, Setaria italica; identical to SEQ ID NO: 1261
  Si001663m

SEQ ID NO: 1264 - protein, 408 aa, Setaria italica; identical to SEQ ID NO: 1262
  Si001663m

SEQ ID NO: 1265 - DNA, 1233 bp, Brachypodium distachyon
  Bradi2g38590.1
atggcctcggtgggtgcggtgcgtccttcgtccatgggctttcagaatgacacaagtaccagtggtgatgccgacaggcttccgaatgagatgggcaatatgagcattagggatgataaggacattgaagatatagtagtcaacggcaatgggacagaaccaggccatatcatagtcacaagcattgagggaagaaatgggcaggcaaaacagaccattagctacatggctgagcgcgtggttggccatgggtcatttggaactgttttccaggccaagtgtctggaaactggggagactgtagctataaagaaggttcttcaagacaagagatacaagaaccgtgagctacagacgatgcgagttcttgaccacccaaatgttgtgtctttgaagcattgttttttctcaaagaccgagaaggaggagctttatctcaacttggttcttgagtatgtgccggagacagctcatcgtgtcattaaacattactacaagatgaaccaacgcatgcctttgatatatgcaaaattatacatgtatcagatatgtagatctttggcatacattcataactgcattggagtgtgtcacagggacatcaagcctcaaaatcttctggtgaatccacatacgcatcagttgaaattgtgcgactttggcagcgcgaaagtgttggtaaaaggagaaccaaacatttcctatatctgttcaaggtactacagagccccagagctcatatttggtgctactgaatacacaacggcaattgatgtttggtctgctggttgtgtccttgctgaactccttctaggacagcctatattccccggcgacagtggtgttgatcagcttgttgaaatcatcaaggttctaggtacccctacaagagaagaaattaagtgcatgaatccaaattataccgagtttaaattcccgcaaatcaaagctcacccatggcacaagatcttccataaaagaatgcctgctgaagcagtagatcttgtttctagacttttgcaatattcaccaagcctccggtcaactgctttggaagcattaatacatccattcttcgatgaactccgggatccaaacacccgcttaccaaatgggcgtttccttcctcccctcttcaacttcaaggcccatgagctgaagggcgtgccaatggacatcttggtgaagctcgttcctgaacatgctcggaagcaatgtacctttgtaggatgg

SEQ ID NO: 1266 - protein, 411 aa, Brachypodium distachyon
  Bradi2g38590.1
MASVGAVRPSSMGFQNDTSTSGDADRLPNEMGNMSIRDDKDIEDIVVNGNGTEPGHIIVTSIEGRNGQAKQTISYMAERVVGHGSFGTVFQAKCLETGETVAIKKVLQDKRYKNRELQTMRVLDHPNVVSLKHCFFSKTEKEELYLNLVLEYVPETAHRVIKHYYKMNQRMPLIYAKLYMYQICRSLAYIHNCIGVCHRDIKPQNLLVNPHTHQLKLCDFGSAKVLVKGEPNISYICSRYYRAPELIFGATEYTTAIDVWSAGCVLAELLLGQPIFPGDSGVDQLVEIIKVLGTPTREEIKCMNPNYTEFKFPQIKAHPWHKIFHKRMPAEAVDLVSRLLQYSPSLRSTALEALIHPFFDELRDPNTRLPNGRFLPPLFNFKAHELKGVPMDILVKLVPEHARKQCTFVGW

SEQ ID NO: 1267 - DNA, 1233 bp, Oryza sativa
  LOC_Os05g04340.1
atggcctcggtaggtgtggtgcgttcttccttggggtttcagaacgaaacaagtacaagtggcgatgccgaccgacttccgaatgagatgagcaatatgagtataagggatgataataaggacattgacgacatagttgtcaatggcaatgggacagaacctggtcatgttattgtgacaagcattgatggaagaaatggacaggctaaacagaccattagctacatggccgagcgtgtcgtaggtcatggatcctttggaactgttttccaggccaagtgcctggaaaccggtgagactgtggctataaagaaggttcttcaagacaagagatataagaaccgtgagctgcaaacaatgcgagttcttgaccacccaaatgtggtgtcactaaagcattgttttttctcaaagactgagaaggaggagctttacctcaatttggtgcttgagtatgtgccagagactgctcaccgtgtaattaaacattacaacaagatgaaccaacgcatgccattgatatatgcaaaactatacatgtatcagatatgcagagctttggcgtacattcacaacaccattggcgtgtgtcacagggatatcaagccacaaaatcttctggtgaacccacatactcatcagctgaaattatgtgacttcggcagcgcgaaagtcttggtaaaaggagaaccaaatatttcttacatctgttcaaggtactacagagctccagagctcatatttggtgctactgaatacacaacagcgattgatgtttggtctgccggttgtgtgcttgctgaactcctcctggggcagcctctattccctggcgacagtggcgttgatcagcttgttgaaatcatcaaggttctgggtacccctacacgagaggagattaagtgcatgaacccaaattacaccgagtttaaatttccgcaaatcaaagctcacccatggcacaagatcttccataaaagaatgcctgctgaagcagtcgatctcgtctccaggcttttgcagtattcaccatacctccggtccactgcttcggaagcattgatccatcccttcttcgatgaactccgtgatccaaacacccgcttaccgaacggccgtttccttcctcctctcttcaacttcaagccccatgaactgaagggtatgccaatggaattcctggtgaagcttatccccgaacatgctcgaaagcaatgcgcgtttgtaggatgg

SEQ ID NO: 1268 - protein, 411 aa, Oryza sativa
  LOC_Os05g04340.1
MASVGVVRSSLGFQNETSTSGDADRLPNEMSNMSIRDDNKDIDDIVVNGNGTEPGHVIVTSIDGRNGQAKQTISYMAERVVGHGSFGTVFQAKCLETGETVAIKKVLQDKRYKNRELQTMRVLDHPNVVSLKHCFFSKTEKEELYLNLVLEYVPETAHRVIKHYNKMNQRMPLIYAKLYMYQICRALAYIHNTIGVCHRDIKPQNLLVNPHTHQLKLCDFGSAKVLVKGEPNISYICSRYYRAPELIFGATEYTTAIDVWSAGCVLAELLLGQPLFPGDSGVDQLVEIIKVLGTPTREEIKCMNPNYTEFKFPQIKAHPWHKIFHKRMPAEAVDLVSRLLQYSPYLRSTASEALIHPFFDELRDPNTRLPNGRFLPPLFNFKPHELKGMPMEFLVKLIPEHARKQCAFVGW

SEQ ID NO: 1269 - DNA, 1137 bp, Oryza sativa
  LOC_Os05g04340.2
atggcctcggtaggtgtggtgcgttcttccttggggtttcagaacgaaacaagtacaagtggcgatgccgaccgacttccgaatgagatgagcaatatgagtataagggatgataataaggacattgacgacatagttgtcaatggcaatgggacagaacctggtcatgttattgtgacaagcattgatggaagaaatggacaggctaaacagaccattagctacatggccgagcgtgtcgtaggtcatggatcctttggaactgttttccaggccaagtgcctggaaaccggtgagactgtggctataaagaaggttcttcaagacaagagatataagaaccgtgagctgcaaacaatgcgagttcttgaccacccaaatgtggtgtcactaaagcattgttttttctcaaagactgagaaggaggagctttacctcaatttggtgcttgagtatgtgccagagactgctcaccgtgtaattaaacattacaacaagatgaaccaacgcatgccattgatatatgcaaaactatacatgtatcagatatgcagagctttggcgtacattcacaacaccattggcgtgtgtcacagggatatcaagccacaaaatcttctggtgaacccacatactcatcagctgaaattatgtgacttcggcagcgcgaaagtcttggtaaaaggagaaccaaatatttcttacatctgttcaaggtactacagagctccagagctcatatttggtgctactgaatacacaacagcgattgatgtttggtctgccggttgtgtgcttgctgaactcctcctggggcagcctctattccctggcgacagtggcgttgatcagcttgttgaaatcatcaaggttctgggtacccctacacgagaggagattaagtgcatgaacccaaattacaccgagtttaaatttccgcaaatcaaagctcacccatggcacaagatcttccataaaagaatgcctgctgaagcagtcgatctcgtctccaggcttttgcagtattcaccatacctccggtccactgctgtgagtgttgtcgttgcactatttgagccaacaccattttttagagaaagttttagttcttggcatcactattgtgttacatttttc

SEQ ID NO: 1270 - protein, 379 aa, Oryza sativa
  LOC_Os05g04340.2
MASVGVVRSSLGFQNETSTSGDADRLPNEMSNMSIRDDNKDIDDIVVNGNGTEPGHVIVTSIDGRNGQAKQTISYMAERVVGHGSFGTVFQAKCLETGETVAIKKVLQDKRYKNRELQTMRVLDHPNVVSLKHCFFSKTEKEELYLNLVLEYVPETAHRVIKHYNKMNQRMPLIYAKLYMYQICRALAYIHNTIGVCHRDIKPQNLLVNPHTHQLKLCDFGSAKVLVKGEPNISYICSRYYRAPELIFGATEYTTAIDVWSAGCVLAELLLGQPLFPGDSGVDQLVEIIKVLGTPTREEIKCMNPNYTEFKFPQIKAHPWHKIFHKRMPAEAVDLVSRLLQYSPYLRSTAVSVVVALFEPTPFFRESFSSWHHYCVTFF

SEQ ID NO: 1271 - DNA, 1020 bp, Zea mays
  GRMZM2G155836_T01
atggcctcggtgggcgtggcacgctcttctttgggatttcagaatggcacaagttctagcagtgacccagatcgtcttcccaacgagttgggcagtatgagcataagggacgacaaggacgttgaagatattgtagtcaatggcaatggggcggagcctggtcatatcatagtgaccagcattgatgggagaaatgggcaggcaaagcagaccattagttacatggctgagcgggtggtaggtcatgggtccttcggaaccgttttccaggccaagtgtcttgaaactggtgagaccgtagctataaaaaaggttcttcaagacaagagatacaagaatcgtgagctgcaaaccatgcgagtgcttgaccacccaaatgtggtggctctaaagcactgtttcttctcaaagactgagaaagaggagctttacctcaatttggtgcttgagtatgtaccggagactgctcatcgtgtcatcaaacattacaacaagatgaaccagcgcatgcctttgatttatgcaaaactgtatatgtatcagatttgtagagccttggcatacattcacaacagcattggagtgtgccacagggacattaagccgcaaaatctcctggttaatcctcatacccatcagctaaaattgtgtgactttggcagcgcgaaagttctggtaaaaggcgaaccaaacatttcttacatctgttctaggtactacagagctccagagctcatatttggtgctactgaatacacaacagccattgatgtttggtctgctggctgtgtgctcgctgagctgcttctaggacagcctctgttccctggagaaagcggtgttgatcagcttgttgaaatcatcaaggttctgggcacacccacacgtgaagaaattaagtgcatgaatccaaattataccgagtttaaattcccgcaaatcaaagctcacccatggcataagatattccgtttaaagatgcctgctgaagcggtagatctcgtgtccaggcttctacga

SEQ ID NO: 1272 - protein, 341 aa, Zea mays
  GRMZM2G155836_T01
MASVGVARSSLGFQNGTSSSSDPDRLPNELGSMSIRDDKDVEDIVVNGNGAEPGHIIVTSIDGRNGQAKQTISYMAERVVGHGSFGTVFQAKCLETGETVAIKKVLQDKRYKNRELQTMRVLDHPNVVALKHCFFSKTEKEELYLNLVLEYVPETAHRVIKHYNKMNQRMPLIYAKLYMYQICRALAYIHNSIGVCHRDIKPQNLLVNPHTHQLKLCDFGSAKVLVKGEPNISYICSRYYRAPELIFGATEYTTAIDVWSAGCVLAELLLGQPLFPGESGVDQLVEIIKVLGTPTREEIKCMNPNYTEFKFPQIKAHPWHKIFRLKMPAEAVDLVSRLLRI

SEQ ID NO: 1273 - DNA, 1230 bp, Setaria italica
  Si022194m
atggcctcggcaggtgtggcacgctcttctttgggatttcagaatgacacaagttctagtagtgacgcagatcgacttccaaacgagttgggcaatatgagcataagggatgataaggacattgaagatattgtagtcaatggcaatggaacagagccaggtcatatcatagtgacaagcattgatgggagaaatgggcaggctaagcagaccatcagctacatggccgagcgagtggtaggtcatgggtccttcgggactgttttccaggccaagtgtctggaaactggtgagactgtagctataaaaaaggttcttcaagacaagagatataagaaccgtgagctgcaaactatgcgagtgcttgaccacccaaatgtggtggctctaaagcactgtttcttctcaaagactgaaaaggaggagctttaccttaatttggtgcttgagtatgtgccagagactgctcatcgtgtcattaaacattataacaagatgaaccagcgcatgcctttgatatatgcaaaactttacatgtatcagatctgtagagctttggcatacattcataactgcatcggagtgtgccatagggacattaagccgcaaaatctcctggtgaatcctcatactcatcagttgaaattgtgtgactttggcagcgcgaaagttctggtaaaaggagaaccaaatatttcttacatatgttctaggtactacagagcaccagagctcatatttggtgctactgaatacacaacagcaattgatgtttggtctgccggatgtgttcttgctgagctgcttctaggacagcctctattccctggagacagtggtgttgatcagctagttgaaatcatcaaggttctgggtacacccacacgtgaagaaatcaaatgcatgaatccaaattataccgagtttaaattcccacaaatcaaagctcacccatggcataagattttccataaaaggatgcctgctgaagcagttgatcttgtgtccaggcttctgcagtactcacctaaccttcggtccactgcattggaagcattgatccatcctttctttgatgagcttcgggatccaaacacgcgcttaccaaacggccgtttccttccacctctattcaacttcaagccccatgagctgaagagtatgccaatggacttcctggtgaagttgatccctgagcatgcacggaagcagtgcgcctttgtaggatgg

SEQ ID NO: 1274 - protein, 410 aa, Setaria italica
  Si022194m
MASAGVARSSLGFQNDTSSSSDADRLPNELGNMSIRDDKDIEDIVVNGNGTEPGHIIVTSIDGRNGQAKQTISYMAERVVGHGSFGTVFQAKCLETGETVAIKKVLQDKRYKNRELQTMRVLDHPNVVALKHCFFSKTEKEELYLNLVLEYVPETAHRVIKHYNKMNQRMPLIYAKLYMYQICRALAYIHNCIGVCHRDIKPQNLLVNPHTHQLKLCDFGSAKVLVKGEPNISYICSRYYRAPELIFGATEYTTAIDVWSAGCVLAELLLGQPLFPGDSGVDQLVEIIKVLGTPTREEIKCMNPNYTEFKFPQIKAHPWHKIFHKRMPAEAVDLVSRLLQYSPNLRSTALEALIHPFFDELRDPNTRLPNGRFLPPLFNFKPHELKSMPMDFLVKLIPEHARKQCAFVGW

SEQ ID NO: 1275 - DNA, 1227 bp, Eucalyptus grandis
  Eucgr.H01313.1
atggcatcggtcggtgtcccacgtgcttctggtttgagagatactagtggatatgctcttggtgcacataggttgccagaagagatgaatgacatgaaaatcagggatgaaagagagatggaagcaacggttattgatggtaatgggacagagacaggtcatattatagtgacaactattggtggtagaaatggccagccaaagcagacaataagctatatggctgagcgagcagttggacaaggatcatttggagtggtgtttcaggcaaaatgcttagagacaggcgaaacagtggctattaagaaggttcttcaagataagaggtataagaatcgggaattgcaaacaatgcgtctccttgaccatcccaatgtggtgttcttgaagcattgcttcttctcaacgagcgaaaaggatgagctatatctgaacctcgttctggagtatgtacctgaaacagttcaccgtgtgatcaagcactacaacaagctgaatcaaaggatgcctctaatttatgtgaaactttatgcatatcagatcttcagggcattgtcgtacattcactgcagtattggagtgtgccatcgggatatcaaacctcaaaatcttttagtaaatcctcatacccaccaggtcaagctatgtgattttggaagtgcaaaagtattggtaaaaggggagccaaatatatcgtacatctgctcgaggtactatagggctcctgagcttatttttggagcaactgaatatacaacggctattgacatctggtctgccggctgcgtactggctgagctattacttggacaacctctgtttcctggcgagagtggagtggatcagctggttgagattatcaaggttctaggcaccccaactagagaagaaatcaagtgcatgaatcctaattatacggagttcaaattccctcagataaaagctcacccatggcacaagatattccacaaacgcatgcctcctgaagctgttgatttggtttcaagattactccagtattctccgaacctacggtgcacagctctggatgccttaatccatcctttctttgatgagttacgtgatcccaatgcccgcttgccaaatggactatttcttccgccactgttcagctttaaatctaatgaactaaaaggagtgccagttgaggtgttggcgaagttgatcccggagcatgctaggaagcagtgttcctctctagggttg

SEQ ID NO: 1276 - protein, 409 aa, Eucalyptus grandis
  Eucgr.H01313.1
MASVGVPRASGLRDTSGYALGAHRLPEEMNDMKIRDEREMEATVIDGNGTETGHIIVTTIGGRNGQPKQTISYMAERAVGQGSFGVVFQAKCLETGETVAIKKVLQDKRYKNRELQTMRLLDHPNVVFLKHCFFSTSEKDELYLNLVLEYVPETVHRVIKHYNKLNQRMPLIYVKLYAYQIFRALSYIHCSIGVCHRDIKPQNLLVNPHTHQVKLCDFGSAKVLVKGEPNISYICSRYYRAPELIFGATEYTTAIDIWSAGCVLAELLLGQPLFPGESGVDQLVEIIKVLGTPTREEIKCMNPNYTEFKFPQIKAHPWHKIFHKRMPPEAVDLVSRLLQYSPNLRCTALDALIHPFFDELRDPNARLPNGLFLPPLFSFKSNELKGVPVEVLAKLIPEHARKQCSSLGL

SEQ ID NO: 1277 - DNA, 1227 bp, Eucalyptus grandis; identical to SEQ ID NO: 1275
  Eucgr.H01313.2

SEQ ID NO: 1278 - protein, 409 aa, Eucalyptus grandis; identical to SEQ ID NO: 1276
  Eucgr.H01313.2

SEQ ID NO: 1279 - DNA, 1227 bp, Eucalyptus grandis; identical to SEQ ID NO: 1275
  Eucgr.H01313.4

SEQ ID NO: 1280 - protein, 409 aa, Eucalyptus grandis; identical to SEQ ID NO: 1276
  Eucgr.H01313.4

SEQ ID NO: 1281 - DNA, 1227 bp, Eucalyptus grandis; identical to SEQ ID NO: 1275
  Eucgr.H01313.5

SEQ ID NO: 1282 - protein, 409 aa, Eucalyptus grandis; identical to SEQ ID NO: 1276
  Eucgr.H01313.5

SEQ ID NO: 1283 - DNA, 1227 bp, Eucalyptus grandis; identical to SEQ ID NO: 1275
  Eucgr.H01313.3

SEQ ID NO: 1284 - protein, 409 aa, Eucalyptus grandis; identical to SEQ ID NO: 1276
  Eucgr.H01313.3

SEQ ID NO: 1285 - DNA, 1239 bp, Eucalyptus grandis
  Eucgr.B01797.1
atgcctgtgcatctgatggcttcagtgggcatcgcacctaatagtgtgagggaacctagtggtcagagtgttggtgttgataggttacctgaagagatgaatgagatgaaaatcagggatgacaaagaaatggaaacgacagtagttgacggtaatggcacagaggcaggtcacatcatcgtaacaactattggtggcagaaatggtcagcccaagcagacgataagttacatggctgagcgagtggttggacaagggtcttttggggttgtttttcaggcaaagtgcttggaaactggtgaaactgttgctataaagaaggttcttcaagacaagaggtacaagaatcgggagttgcaaacgatgcgtcttcttgaccacccaaatgttgtctcattgaagcattgctttttctcggagactgaaaaggatgaactgtatcttaacttggtacttgagtatgtgccagagactgttcatcgtgtcattaagcactataacaagttaaaccaaaggatgcccataatatatgtgaaactttacacatatcagatattcagggccttgtcttacattcatcgttgtattggagtttgtcaccgggacattaaacctcaaaatctcttggtaaatcctcatacgcaccaagtcaaattatgtgattttggaagtgcaaaagtattggttaaaggggagccaaatatatcctacatctgctcaagatattatagggcacctgaactgatatttggtgcaactgaatatactacagctattgacatctggtctgctggctgtgtgttggcggagctgctgcttggacagcctctctttcctggtgagagcggggtcgaccagctggtggagattatcaaaattttgggcactccaaccagggaggaaattaaatgcatgaaccccaattacacagagtttaaattccctcagataaaagcgcacccatggcacaagatattccacaagcgaatgccccccgaagctgttgatttagtttcaagattgctgcaatattctcccaatctgcgatgctcagctcttgatgctttgacgcatcccttcttcaacgagctacgcgatcccagcactcggctaccaaatggacggttcctgccacctcttttcaattttaaggctcacgaattgaagaatatccctgcggaagtccagttgaaattggtcccggaacacgcgaggaagcagtgtccgtttcttgggttg

SEQ ID NO: 1286 - protein, 413 aa, Eucalyptus grandis
  Eucgr.B01797.1
MPVHLMASVGIAPNSVREPSGQSVGVDRLPEEMNEMKIRDDKEMETTVVDGNGTEAGHIIVTTIGGRNGQPKQTISYMAERVVGQGSFGVVFQAKCLETGETVAIKKVLQDKRYKNRELQTMRLLDHPNVVSLKHCFFSETEKDELYLNLVLEYVPETVHRVIKHYNKLNQRMPIIYVKLYTYQIFRALSYIHRCIGVCHRDIKPQNLLVNPHTHQVKLCDFGSAKVLVKGEPNISYICSRYYRAPELIFGATEYTTAIDIWSAGCVLAELLLGQPLFPGESGVDQLVEIIKILGTPTREEIKCMNPNYTEFKFPQIKAHPWHKIFHKRMPPEAVDLVSRLLQYSPNLRCSALDALTHPFFNELRDPSTRLPNGRFLPPLFNFKAHELKNIPAEVQLKLVPEHARKQCPFLGL

SEQ ID NO: 1287 - DNA, 1239 bp, Eucalyptus grandis; identical to SEQ ID NO: 1285
  Eucgr.B01797.2

SEQ ID NO: 1288 - protein, 413 aa, Eucalyptus grandis; identical to SEQ ID NO: 1286
  Eucgr.B01797.2

SEQ ID NO: 1289 - DNA, 1239 bp, Eucalyptus grandis; identical to SEQ ID NO: 1285
  Eucgr.B01797.4

SEQ ID NO: 1290 - protein, 413 aa, Eucalyptus grandis; identical to SEQ ID NO: 1286
  Eucgr.B01797.4

SEQ ID NO: 1291 - DNA, 1239 bp, Eucalyptus grandis; identical to SEQ ID NO: 1285
  Eucgr.B01797.3

SEQ ID NO: 1292 - protein, 413 aa, Eucalyptus grandis; identical to SEQ ID NO: 1286
  Eucgr.B01797.3

SEQ ID NO: 1293 - DNA, 1110 bp, Eucalyptus grandis
  Eucgr.B01797.5
atggaaacgacagtagttgacggtaatggcacagaggcaggtcacatcatcgtaacaactattggtggcagaaatggtcagcccaagcagacgataagttacatggctgagcgagtggttggacaagggtcttttggggttgtttttcaggcaaagtgcttggaaactggtgaaactgttgctataaagaaggttcttcaagacaagaggtacaagaatcgggagttgcaaacgatgcgtcttcttgaccacccaaatgttgtctcattgaagcattgctttttctcggagactgaaaaggatgaactgtatcttaacttggtacttgagtatgtgccagagactgttcatcgtgtcattaagcactataacaagttaaaccaaaggatgcccataatatatgtgaaactttacacatatcagatattcagggccttgtcttacattcatcgttgtattggagtttgtcaccgggacattaaacctcaaaatctcttggtaaatcctcatacgcaccaagtcaaattatgtgattttggaagtgcaaaagtattggttaaaggggagccaaatatatcctacatctgctcaagatattatagggcacctgaactgatatttggtgcaactgaatatactacagctattgacatctggtctgctggctgtgtgttggcggagctgctgcttggacagcctctctttcctggtgagagcggggtcgaccagctggtggagattatcaaaattttgggcactccaaccagggaggaaattaaatgcatgaaccccaattacacagagtttaaattccctcagataaaagcgcacccatggcacaagatattccacaagcgaatgccccccgaagctgttgatttagtttcaagattgctgcaatattctcccaatctgcgatgctcagctcttgatgctttgacgcatcccttcttcaacgagctacgcgatcccagcactcggctaccaaatggacggttcctgccacctcttttcaattttaaggctcacgaattgaagaatatccctgcggaagtccagttgaaattggtcccggaacacgcgaggaagcagtgtccgtttcttgggttg

SEQ ID NO: 1294 - protein, 370 aa, Eucalyptus grandis
  Eucgr.B01797.5
METTVVDGNGTEAGHIIVTTIGGRNGQPKQTISYMAERVVGQGSFGVVFQAKCLETGETVAIKKVLQDKRYKNRELQTMRLLDHPNVVSLKHCFFSETEKDELYLNLVLEYVPETVHRVIKHYNKLNQRMPIIYVKLYTYQIFRALSYIHRCIGVCHRDIKPQNLLVNPHTHQVKLCDFGSAKVLVKGEPNISYICSRYYRAPELIFGATEYTTAIDIWSAGCVLAELLLGQPLFPGESGVDQLVEIIKILGTPTREEIKCMNPNYTEFKFPQIKAHPWHKIFHKRMPPEAVDLVSRLLQYSPNLRCSALDALTHPFFNELRDPSTRLPNGRFLPPLFNFKAHELKNIPAEVQLKLVPEHARKQCPFLGL

SEQ ID NO: 1295 - DNA, 879 bp, Eucalyptus grandis
  Eucgr.B01797.6
atgcctgtgcatctgatggcttcagtgggcatcgcacctaatagtgtgagggaacctagtggtcagagtgttggtgttgataggttacctgaagagatgaatgagatgaaaatcagggatgacaaagaaatggaaacgacagtagttgacggtaatggcacagaggcaggtcacatcatcgtaacaactattggtggcagaaatggtcagcccaagcagacgataagttacatggctgagcgagtggttggacaagggtcttttggggttgtttttcaggcaaagtgcttggaaactggtgaaactgttgctataaagaaggttcttcaagacaagaggtacaagaatcgggagttgcaaacgatgcgtcttcttgaccacccaaatgttgtctcattgaagcattgctttttctcggagactgaaaaggatgaactgtatcttaacttggtacttgagtatgtgccagagactgttcatcgtgtcattaagcactataacaagttaaaccaaaggatgcccataatatatgtgaaactttacacatatcagatattcagggccttgtcttacattcatcgttgtattggagtttgtcaccgggacattaaacctcaaaatctcttggtaaatcctcatacgcaccaagtcaaattatgtgattttggaagtgcaaaagtattggttaaaggggagccaaatatatcctacatctgctcaagatattatagggcacctgaactgatatttggtgcaactgaatatactacagctattgacatctggtctgctggctgtgtgttggcggagctgctgcttggacaggtatgctacttgacttgttggacttgggattctttcttgcttttatggaaaaac

SEQ ID NO: 1296 - protein, 293 aa, Eucalyptus grandis
  Eucgr.B01797.6
MPVHLMASVGIAPNSVREPSGQSVGVDRLPEEMNEMKIRDDKEMETTVVDGNGTEAGHIIVTTIGGRNGQPKQTISYMAERVVGQGSFGVVFQAKCLETGETVAIKKVLQDKRYKNRELQTMRLLDHPNVVSLKHCFFSETEKDELYLNLVLEYVPETVHRVIKHYNKLNQRMPIIYVKLYTYQIFRALSYIHRCIGVCHRDIKPQNLLVNPHTHQVKLCDFGSAKVLVKGEPNISYICSRYYRAPELIFGATEYTTAIDIWSAGCVLAELLLGQVCYLTCWTWDSFLLLWKN

SEQ ID NO: 1297 - DNA, 1218 bp, Glycine max
  Glyma03g38850.1
atggcttcagttggtgtggcaccaacatcatcaggcttgagagaatccagtggtgttgatagattgcctgaggagatgaatgatatgagaattagggacgataaagaaatggaagccaccgttgtcgatggtaacggaacggagaccggacatatcattgttactaccattgggggtagaaatggtcaaccgaagcagactataagctatatggcagagaggattgttgggcatggatcatttggggttgtcttccaagctaaatgcttggagactggtgaaactgtggctatcaaaaaagttcttcaagacaagaggtataaaaaccgggagctgcaaacaatgcgccttcttgaccacccaaatgttgtctgtttgaagcattgtttcttttcaaccactgaaaaggatgaactataccttaatttggtacttgagtatgttcctgaaacagttaatcgtgtgatcaaacattacaacaagttgaaccaacggatgcctctgatatatgtaaaactctatacataccagatctttagggcactatcttatattcatcgttgcattggagtctgccatcgggatatcaagcctcaaaatctattggttaatccgcacactcaccaggttaaaatatgtgactttggaagtgcaaaagtcttggtgaaaggcgaaccaaatatatcgtacatatgttctagatattatagagcacctgagcttatatttggagcaactgaatatactacagctattgacatttggtcagttggctgtgtattggctgagcttatgcttggacagcccttgttccccggtgagagtggagttgatcagcttgttgagatcatcaaggttctgggaactccaacaagggaagagataaagtgcatgaatcctaactacacggaatttaaattcccacagattaaagcgcatccatggcacaagatctttcacaagcgcatgcctccagaagctgttgatctggtatcaagactactacaatactcccctaacttgcggtgcactgctttagataccttgacccatcctttctttgatgaacttcgtgacccaaacactcgcttgccaaatggtcgtttccttccaccattgttcaattttaaatctcatgaattgaagggagtcccagttgagattttggtgaaattgattccagaacatgcgaggaagcagtgcccgtttcttggcttg

SEQ ID NO: 1298 - protein, 406 aa, Glycine max
  Glyma03g38850.1
MASVGVAPTSSGLRESSGVDRLPEEMNDMRIRDDKEMEATVVDGNGTETGHIIVTTIGGRNGQPKQTISYMAERIVGHGSFGVVFQAKCLETGETVAIKKVLQDKRYKNRELQTMRLLDHPNVVCLKHCFFSTTEKDELYLNLVLEYVPETVNRVIKHYNKLNQRMPLIYVKLYTYQIFRALSYIHRCIGVCHRDIKPQNLLVNPHTHQVKICDFGSAKVLVKGEPNISYICSRYYRAPELIFGATEYTTAIDIWSVGCVLAELMLGQPLFPGESGVDQLVEIIKVLGTPTREEIKCMNPNYTEFKFPQIKAHPWHKIFHKRMPPEAVDLVSRLLQYSPNLRCTALDTLTHPFFDELRDPNTRLPNGRFLPPLFNFKSHELKGVPVEILVKLIPEHARKQCPFLGL

SEQ ID NO: 1299 - DNA, 1218 bp, Glycine max; identical to SEQ ID NO: 1297
  Glyma03g38850.2

SEQ ID NO: 1300 - protein, 406 aa, Glycine max; identical to SEQ ID NO: 1298
  Glyma03g38850.2

SEQ ID NO: 1301 - DNA, 1218 bp, Glycine max
  Glyma19g41420.1
atggcttcagttggtgtggcaccaacatcatcaggcttgagagaatccagtggtgttgataggttgccagaggagatgaatgatatgagaattagggatgataaagaaatggaagccaccgttgtcgatggtaacggaacagagaccggacatattattgttactaccattgggggtagaaatggtcaaccgaagcagactataagctatatggcagagcggattgttggacatggatcatttggggttgtcttccaggctaaatgcttggagactggtgaaactgtggctatcaaaaaagttcttcaagacaagaggtataaaaaccgggagctgcaaacaatgcgccttcttgaccacccaaatgttgtctgtttgaagcattgtttcttttcaaccaccgaaaaggatgaactataccttaatttggtactggagtatgttcccgaaacagttaatcgtgtgatcaaacattataacaagttgaaccaacggatgcctctgatatatgtaaaactctatacataccagatctttagggcactctcttatattcatcgttgcattggagtctgccatcgggatatcaagcctcaaaatctattagttaatccacatactcaccaggtcaaaatatgcgactttggaagtgcaaaagtcttggtaaaaggcgaaccaaatatatcgtacatatgctctagatattatagagcacctgagcttatatttggagcaactgaatatactacagctattgacgtttggtcagttggttgtgtattggctgagcttatgcttggacagcccttgttccccggtgagagtggagttgatcagcttgttgagatcatcaaggttctgggaactccaacaagggaagagataaagtgcatgaatcctaactatacagaatttaaattcccacagattaaagcacatccatggcacaagatctttcacaagcgcatgcctccagaagctgttgatttagtatcaagactactacaatactcccctaacttgcggtgcacagctttagatgccttgacccatcctttctttgatgaacttcgtgacccaaacactcgcttgccaaatggtcgtttccttccaccattgttcaattttaaatctcatgaattgaagggagtcccagttgagattttgctgaaattgattccagaacatgcaaggaagcagtgcccgtttcttggcttg

SEQ ID NO: 1302 - protein, 406 aa, Glycine max
  Glyma19g41420.1
MASVGVAPTSSGLRESSGVDRLPEEMNDMRIRDDKEMEATVVDGNGTETGHIIVTTIGGRNGQPKQTISYMAERIVGHGSFGVVFQAKCLETGETVAIKKVLQDKRYKNRELQTMRLLDHPNVVCLKHCFFSTTEKDELYLNLVLEYVPETVNRVIKHYNKLNQRMPLIYVKLYTYQIFRALSYIHRCIGVCHRDIKPQNLLVNPHTHQVKICDFGSAKVLVKGEPNISYICSRYYRAPELIFGATEYTTAIDVWSVGCVLAELMLGQPLFPGESGVDQLVEIIKVLGTPTREEIKCMNPNYTEFKFPQIKAHPWHKIFHKRMPPEAVDLVSRLLQYSPNLRCTALDALTHPFFDELRDPNTRLPNGRFLPPLFNFKSHELKGVPVEILLKLIPEHARKQCPFLGL

SEQ ID NO: 1303 - DNA, 1155 bp, Glycine max
  Glyma19g41420.3
atggcttcagttggtgtggcaccaacatcatcaggcttgagagaatccagtggtgttgataggttgccagaggagatgaatgatatgagaattagggatgataaagaaatggaagccaccgttgtcgatggtaacggaacagagaccggacatattattgttactaccattgggggtagaaatggtcaaccgaagcagactataagctatatggcagagcggattgttggacatggatcatttggggttgtcttccaggctaaatgcttggagactggtgaaactgtggctatcaaaaaagttcttcaagacaagaggtataaaaaccgggagctgcaaacaatgcgccttcttgaccacccaaatgttgtctgtttgaagcattgtttcttttcaaccaccgaaaaggatgaactataccttaatttggtactggagtatgttcccgaaacagttaatcgtgtgatcaaacattataacaagttgaaccaacggatgcctctgatatatgtaaaactctatacataccagatctttagggcactctcttatattcatcgttgcattggagtctgccatcgggatatcaagcctcaaaatctattagttaatccacatactcaccaggtcaaaatatgcgactttggaagtgcaaaagtcttggtaaaaggcgaaccaaatatatcgtacatatgctctagatattatagagcacctgagcttatatttggagcaactgaatatactacagctattgacgtttggtcagttggttgtgtattggctgagcttatgcttggacagcccttgttccccggtgagagtggagttgatcagcttgttgagatcatcaaggttctgggaactccaacaagggaagagataaagtgcatgaatcctaactatacagaatttaaattcccacagattaaagcacatccatggcacaagatctttcacaagcgcatgcctccagaagctgttgatttagtatcaagactactacaatactcccctaacttgcggtgcacagctttagatgccttgacccatcctttctttgatgaacttcgtgacccaaacactcgcttgccaaatggtcgtttccttccaccattgttcaattttaaatctcatggtatgatagtttttgaa

SEQ ID NO: 1304 - protein, 385 aa, Glycine max
  Glyma19g41420.3
MASVGVAPTSSGLRESSGVDRLPEEMNDMRIRDDKEMEATVVDGNGTETGHIIVTTIGGRNGQPKQTISYMAERIVGHGSFGVVFQAKCLETGETVAIKKVLQDKRYKNRELQTMRLLDHPNVVCLKHCFFSTTEKDELYLNLVLEYVPETVNRVIKHYNKLNQRMPLIYVKLYTYQIFRALSYIHRCIGVCHRDIKPQNLLVNPHTHQVKICDFGSAKVLVKGEPNISYICSRYYRAPELIFGATEYTTAIDVWSVGCVLAELMLGQPLFPGESGVDQLVEIIKVLGTPTREEIKCMNPNYTEFKFPQIKAHPWHKIFHKRMPPEAVDLVSRLLQYSPNLRCTALDALTHPFFDELRDPNTRLPNGRFLPPLFNFKSHGMIVFE

SEQ ID NO: 1305 - DNA, 1095 bp, Glycine max
  Glyma19g41420.2
atggcttcagttggtgtggcaccaacatcatcaggcttgagagaatccagtggtgttgataggttgccagaggagatgaatgatatgagaattagggatgataaagaaatggaagccaccgttgtcgatggtaacggaacagagaccggacatattattgttactaccattgggggtagaaatggtcaaccgaagcagactataagctatatggcagagcggattgttggacatggatcatttggggttgtcttccaggctaaatgcttggagactggtgaaactgtggctatcaaaaaagttcttcaagacaagaggtataaaaaccgggagctgcaaacaatgcgccttcttgaccacccaaatgttgtctgtttgaagcattgtttcttttcaaccaccgaaaaggatgaactataccttaatttggtactggagtatgttcccgaaacagttaatcgtgtgatcaaacattataacaagttgaaccaacggatgcctctgatatatgtaaaactctatacataccagatctttagggcactctcttatattcatcgttgcattggagtctgccatcgggatatcaagcctcaaaatctattagttaatccacatactcaccaggtcaaaatatgcgactttggaagtgcaaaagtcttggtaaaaggcgaaccaaatatatcgtacatatgctctagatattatagagcacctgagcttatatttggagcaactgaatatactacagctattgacgtttggtcagttggttgtgtattggctgagcttatgcttggacagcccttgttccccggtgagagtggagttgatcagcttgttgagatcatcaaggttctgggaactccaacaagggaagagataaagtgcatgaatcctaactatacagaatttaaattcccacagattaaagcacatccatggcacaagatctttcacaagcgcatgcctccagaagctgttgatttagtatcaagactactacaatactcccctaacttgcggtgcacagctgtgagtatatttgactttttagcaggcctttctaactctaatttcaatccgcctaatttg

SEQ ID NO: 1306 - protein, 365 aa, Glycine max
  Glyma19g41420.2
MASVGVAPTSSGLRESSGVDRLPEEMNDMRIRDDKEMEATVVDGNGTETGHIIVTTIGGRNGQPKQTISYMAERIVGHGSFGVVFQAKCLETGETVAIKKVLQDKRYKNRELQTMRLLDHPNVVCLKHCFFSTTEKDELYLNLVLEYVPETVNRVIKHYNKLNQRMPLIYVKLYTYQIFRALSYIHRCIGVCHRDIKPQNLLVNPHTHQVKICDFGSAKVLVKGEPNISYICSRYYRAPELIFGATEYTTAIDVWSVGCVLAELMLGQPLFPGESGVDQLVEIIKVLGTPTREEIKCMNPNYTEFKFPQIKAHPWHKIFHKRMPPEAVDLVSRLLQYSPNLRCTAVSIFDFLAGLSNSNFNPPNL

SEQ ID NO: 1307 - DNA, 1230 bp, Glycine max
  Glyma10g28530.1
atgacatcggttggtgtggcaccaacttcgggtttgagagaagccagtgggcatggagcagcaggtgttgatagattgccagaggagatgaacgatatgaaaattagggatgatagagaaatggaagccacagttgttgatggcaatggaacggagacaggacatatcattgtgactaccattgggggtagaaatggtcagcccaagcagactataagctacatggcagagcgtgttgtagggcatggatcatttggagttgtcttccaggctaagtgcttggaaactggtgaaactgtggctatcaaaaaggttcttcaagacaagaggtacaagaaccgggagctgcaaacaatgcgccttcttgaccacccaaatgtcgttgctttgaagcactgtttcttttcaaccactgaaaaggatgaactataccttaatttggttctcgagtatgttcctgaaacagttaatcgggtgataaaacattacaacaagttgaaccaaaggatgccactgatatatgtgaaactctatacataccagatctttagggcattatcttatattcatcgttgtattggagtctgccatcgggatatcaagcctcaaaatctattggtcaatccacacactcaccaggttaaattatgtgactttggaagtgcaaaggttttggtaaaaggtgaaccaaatatatcatacatatgttctagatactatagagcacctgagctcatatttggcgcaactgaatatactacagccattgacgtctggtctgttggatgtgttttagctgagctgcttcttggacagcctttgttccctggtgagagtggagttgatcaacttgttgagattatcaaggttctgggcactccaacaagggaagagattaagtgcatgaaccctaattatacagaatttaaattcccacagattaaagcacatccatggcacaagatcttccataagcgcatgcctccagaggctgttgatttggtatcaagactactacaatactcccctaacttgcggtgcacagctttagatgccttgacgcatcctttctttgacgaacttcgtgatccaaattctcgcttgccaaatggccgattccttccaccactatttaatttcaaatcccatgaactgaaaggtgtcccagctgagattttggtgaaattggttccagagcatgcaaggaagcaatgcccgtttcttggcttg

SEQ ID NO: 1308 - protein, 410 aa, Glycine max
  Glyma10g28530.1
MTSVGVAPTSGLREASGHGAAGVDRLPEEMNDMKIRDDREMEATVVDGNGTETGHIIVTTIGGRNGQPKQTISYMAERVVGHGSFGVVFQAKCLETGETVAIKKVLQDKRYKNRELQTMRLLDHPNVVALKHCFFSTTEKDELYLNLVLEYVPETVNRVIKHYNKLNQRMPLIYVKLYTYQIFRALSYIHRCIGVCHRDIKPQNLLVNPHTHQVKLCDFGSAKVLVKGEPNISYICSRYYRAPELIFGATEYTTAIDVWSVGCVLAELLLGQPLFPGESGVDQLVEIIKVLGTPTREEIKCMNPNYTEFKFPQIKAHPWHKIFHKRMPPEAVDLVSRLLQYSPNLRCTALDALTHPFFDELRDPNSRLPNGRFLPPLFNFKSHELKGVPAEILVKLVPEHARKQCPFLGL

SEQ ID NO: 1309 - DNA, 1230 bp, Glycine max; identical to SEQ ID NO: 1307
  Glyma10g28530.3

SEQ ID NO: 1310 - protein, 410 aa, Glycine max; identical to SEQ ID NO: 1308
  Glyma10g28530.3

SEQ ID NO: 1311 - DNA, 1173 bp, Glycine max
  Glyma10g28530.2
atgacatcggttggtgtggcaccaacttcgggtttgagagaagccagtgggcatggagcagcaggtgttgatagattgccagaggagatgaacgatatgaaaattagggatgatagagaaatggaagccacagttgttgatggcaatggaacggagacaggacatatcattgtgactaccattgggggtagaaatggtcagcccaagcagactataagctacatggcagagcgtgttgtagggcatggatcatttggagttgtcttccaggctaagtgcttggaaactggtgaaactgtggctatcaaaaaggttcttcaagacaagaggtacaagaaccgggagctgcaaacaatgcgccttcttgaccacccaaatgtcgttgctttgaagcactgtttcttttcaaccactgaaaaggatgaactataccttaatttggttctcgagtatgttcctgaaacagttaatcgggtgataaaacattacaacaagttgaaccaaaggatgccactgatatatgtgaaactctatacataccagatctttagggcattatcttatattcatcgttgtattggagtctgccatcgggatatcaagcctcaaaatctattggtcaatccacacactcaccaggttaaattatgtgactttggaagtgcaaaggttttggtaaaaggtgaaccaaatatatcatacatatgttctagatactatagagcacctgagctcatatttggcgcaactgaatatactacagccattgacgtctggtctgttggatgtgttttagctgagctgcttcttggacagcctttgttccctggtgagagtggagttgatcaacttgttgagattatcaaggttctgggcactccaacaagggaagagattaagtgcatgaaccctaattatacagaatttaaattcccacagattaaagcacatccatggcacaagatcttccataagcgcatgcctccagaggctgttgatttggtatcaagactactacaatactcccctaacttgcggtgcacagctttagatgccttgacgcatcctttctttgacgaacttcgtgatccaaattctcgcttgccaaatggccgattccttccaccactatttaatttcaaatcccatggtataactgaaaggtgtcccagc

SEQ ID NO: 1312 - protein, 391 aa, Glycine max
  Glyma10g28530.2
MTSVGVAPTSGLREASGHGAAGVDRLPEEMNDMKIRDDREMEATVVDGNGTETGHIIVTTIGGRNGQPKQTISYMAERVVGHGSFGVVFQAKCLETGETVAIKKVLQDKRYKNRELQTMRLLDHPNVVALKHCFFSTTEKDELYLNLVLEYVPETVNRVIKHYNKLNQRMPLIYVKLYTYQIFRALSYIHRCIGVCHRDIKPQNLLVNPHTHQVKLCDFGSAKVLVKGEPNISYICSRYYRAPELIFGATEYTTAIDVWSVGCVLAELLLGQPLFPGESGVDQLVEIIKVLGTPTREEIKCMNPNYTEFKFPQIKAHPWHKIFHKRMPPEAVDLVSRLLQYSPNLRCTALDALTHPFFDELRDPNSRLPNGRFLPPLFNFKSHGITERCPS

SEQ ID NO: 1313 - DNA, 1278 bp, Glycine max
  Glyma20g22600.1
atggtttttgagcaacagcagttaaaagagaaaagggattcagcgaagatgacatcggttggtgtggcaccaacttcgggtttgagagaagccagtgggcatggagcagcagctgcggatagattgccagaggagatgaacgatatgaaaattagggatgatagagaaatggaagccacagttgttgatggcaacggaacggagacaggacatatcattgtgactaccattgggggtagaaatggtcagcccaagcagactataagctacatggcagagcgtgttgtagggcatggatcatttggagttgtcttccaggctaagtgcttggaaaccggtgaaactgtggctatcaaaaaggttcttcaagataagaggtacaagaaccgggagctgcaaacaatgcgccttcttgaccacccaaatgttgtcgctttgaagcactgtttcttttcaaccactgaaaaggatgaactatacctcaatttggtacttgaatatgttcctgaaacagttaatcgtgtgatcaaacattacaacaagttaaaccaaaggatgccgctgatatatgtgaaactctatacataccagatctttagggcgttatcttatattcatcgttgtattggagtctgccatcgggatatcaagcctcaaaatctattggtcaatccacacactcaccaggttaaattatgtgactttggaagtgcaaaggttttggtaaaaggcgaaccaaatatatcatacatatgttctagatactatagagcacctgagctcatatttggcgcaactgaatatacttcagccattgacatctggtctgttggatgtgttttagctgagctgctgcttggacagcctctgttccctggtgagagtggagttgatcaacttgttgagatcatcaaggttctgggcactccaacaagggaagagattaagtgcatgaaccctaattatacagaatttaaattcccacagattaaagcacatccatggcacaagatcttccataagcgcatgcctccagaggctgttgatttggtatcaagactactacaatactcccctaacttgcggtgcacagcttttgatgccttgacgcatcctttcttcgacgagcttcgtgatccaaatactcgcttgccaaatggccgattccttccaccactatttaatttcaaatcccatgaactgaaaggagtcccatctgagattttggtgaaattggttccagagcatgcaaggaagcaatgcccgtttctaggctcg

SEQ ID NO: 1314 - protein, 426 aa, Glycine max
  Glyma20g22600.1
MVFEQQQLKEKRDSAKMTSVGVAPTSGLREASGHGAAAADRLPEEMNDMKIRDDREMEATVVDGNGTETGHIIVTTIGGRNGQPKQTISYMAERVVGHGSFGVVFQAKCLETGETVAIKKVLQDKRYKNRELQTMRLLDHPNVVALKHCFFSTTEKDELYLNLVLEYVPETVNRVIKHYNKLNQRMPLIYVKLYTYQIFRALSYIHRCIGVCHRDIKPQNLLVNPHTHQVKLCDFGSAKVLVKGEPNISYICSRYYRAPELIFGATEYTSAIDIWSVGCVLAELLLGQPLFPGESGVDQLVEIIKVLGTPTREEIKCMNPNYTEFKFPQIKAHPWHKIFHKRMPPEAVDLVSRLLQYSPNLRCTAFDALTHPFFDELRDPNTRLPNGRFLPPLFNFKSHELKGVPSEILVKLVPEHARKQCPFLGS

SEQ ID NO: 1315 - DNA, 1278 bp, Glycine max; identical to SEQ ID NO: 1313
  Glyma20g22600.3

SEQ ID NO: 1316 - protein, 426 aa, Glycine max; identical to SEQ ID NO: 1314
  Glyma20g22600.3

SEQ ID NO: 1317 - DNA, 1278 bp, Glycine max; identical to SEQ ID NO: 1313
  Glyma20g22600.2

SEQ ID NO: 1318 - protein, 426 aa, Glycine max; identical to SEQ ID NO: 1314
  Glyma20g22600.2

SEQ ID NO: 1319 - DNA, 1278 bp, Glycine max; identical to SEQ ID NO: 1313
  Glyma20g22600.4

SEQ ID NO: 1320 - protein, 426 aa, Glycine max; identical to SEQ ID NO: 1314
  Glyma20g22600.4

SEQ ID NO: 1321 - DNA, 1143 bp, Vitis vinifera
  GSVIVT01031301001
atgaatgacatgaaaattagggatgacaaagagatggaagcaacagttgttgacggtaatggaacagagacaggtcatataattgtgacgactattggtggtagaaatggccaaccaaagcagacaataagttacatggctgagcgcgttgttgggcatggatcatttggagttgtttttcaagcaaaatgcttagagaccggtgaaactgtggctataaagaaggttcttcaagacaagagatataagaaccgtgaacttcaaactatgcgtcttcttgaccaccctaatgttgtctccttgaagcactgtttcttttcaacaaccgaaaaggatgaactttatcttaatcttgtacttgagtatgttcctgaaactgttcatcgggttattaaacactacaataagttgaaccaaaggatgccactgatatatgtgaagctctatacataccagattttcagggcattgtcttacattcatcgcagtattggagtttgtcatagggacatcaaacctcaaaatcttttggtgaatccacatacccaccagcttaagctatgtgactttggaagtgcaaaagtcttggtaaaaggggaacccaatatatcttatatctgctctagatattacagggctcctgagcttatatttggagcaactgagtacactacagctattgatatctggtctgcaggttgcgttctggctgagttaatgcttggacagcctctgtttcctggagagagtggagtcgatcagcttgttgagattatcaaggttttgggcactccaacaagggaggaaattaaatgcatgaaccccaactatacagagttcaaattcccccaaattaaagctcacccatggcacaagatattccataaacgcatgcctccagaagctgttgatttggtttcaagactactgcagtactctcctaatctacggtgcacagctatggatgccttgacccattccttcttcgatgagctacgtgactcaagcacccgcctgccaaatggccgatttcttccaccactattcaactttaagcctcacgaattgaagggagtaccagttgagattttggtgaaattgatcccggaacatgcaagaaagcaatgccccttccttgggcta

SEQ ID NO: 1322 - protein, 381 aa, Vitis vinifera
  GSVIVT01031301001
MNDMKIRDDKEMEATVVDGNGTETGHIIVTTIGGRNGQPKQTISYMAERVVGHGSFGVVFQAKCLETGETVAIKKVLQDKRYKNRELQTMRLLDHPNVVSLKHCFFSTTEKDELYLNLVLEYVPETVHRVIKHYNKLNQRMPLIYVKLYTYQIFRALSYIHRSIGVCHRDIKPQNLLVNPHTHQLKLCDFGSAKVLVKGEPNISYICSRYYRAPELIFGATEYTTAIDIWSAGCVLAELMLGQPLFPGESGVDQLVEIIKVLGTPTREEIKCMNPNYTEFKFPQIKAHPWHKIFHKRMPPEAVDLVSRLLQYSPNLRCTAMDALTHSFFDELRDSSTRLPNGRFLPPLFNFKPHELKGVPVEILVKLIPEHARKQCPFLGL

SEQ ID NO: 1323 - DNA, 1227 bp, Citrus clementina
  clementine0.9_011707m
atggcttcagtgggtgtggcaccaacatcttgtgtgagagaatccagtggtcatactgttggtgttgataagctacctgaggagatgaatgacatgaaaattagggacgacaaggaaatggaagcgacagtcgttgacggcaatggaacagagacaggtcatataattgtgacaaccattggtggaagaaatggtcaaccaaagcagacaataagctacatggctgagcgcattgttggacagggatcgtttggagttgttttccaggccaagtgcttagagacaggtgagactgtagctataaagaaggttctccaggataagaggtacaagaaccgtgagcttcaaactatgcgtctacttgaccatccaaatgttgtctctttgaagcattgcttcttttcaacaactgacaaggatgaactttatctcaatcttgttcttgagtatgttcctgaaactgttcatcgtgtggtcaaacatttcaacaagttgaaccaaaggatgccaatgatatatgtgaaactttatgcataccagatctttagggcattgtcttacattcatcgcagtattggagtgtgtcatcgggacataaaacctcaaaatcttttggtaaatccacatactcaccaggtcaaactttgtgattttggaagtgcaaaagtcttggtaaaaggtgaaccgaatatatcctatatatgctccaggtattatagagcacctgagcttatatttggagcaactgagtacaccacagctattgatatatggtctgctggctgtgttgttgctgagctgatgcttggaaagcctctatttcccggcgacagtggagttgaccagctggttgagattattaaggtattaggtactcctacaagggaggaaataaaatgcatgaaccccaactatactgagttcaaattccctcagataaaagctcacccgtggcacaagatattcccaaagcgcatgccccctgaggctgttgatctggtatcaagattgctgcaatactctcccaacttacggtgcactgctctagatgcattgatccatcccttctttgatgagcttcgtgaccctaatgctcgtttgccaagtggacgtttccttccaccgttatttaacttcaaatcacatgaactgaagggtgtaccggtggaaatattggtgaaattgataccagagcatgctagaaagcaatgcccctttcttggcttg

SEQ ID NO: 1324 - protein, 409 aa, Citrus clementina
  clementine0.9_011707m
MASVGVAPTSCVRESSGHTVGVDKLPEEMNDMKIRDDKEMEATVVDGNGTETGHIIVTTIGGRNGQPKQTISYMAERIVGQGSFGVVFQAKCLETGETVAIKKVLQDKRYKNRELQTMRLLDHPNVVSLKHCFFSTTDKDELYLNLVLEYVPETVHRVVKHFNKLNQRMPMIYVKLYAYQIFRALSYIHRSIGVCHRDIKPQNLLVNPHTHQVKLCDFGSAKVLVKGEPNISYICSRYYRAPELIFGATEYTTAIDIWSAGCVVAELMLGKPLFPGDSGVDQLVEIIKVLGTPTREEIKCMNPNYTEFKFPQIKAHPWHKIFPKRMPPEAVDLVSRLLQYSPNLRCTALDALIHPFFDELRDPNARLPSGRFLPPLFNFKSHELKGVPVEILVKLIPEHARKQCPFLGL

SEQ ID NO: 1325 - DNA, 1227 bp, Citrus clementina; identical to SEQ ID NO: 1323
  clementine0.9_011708m

SEQ ID NO: 1326 - protein, 409 aa, Citrus clementina; identical to SEQ ID NO: 1324
  clementine0.9_011708m

SEQ ID NO: 1327 - DNA, 1227 bp, Populus trichocarpa
  POPTR_0005s00710.1
atgggttctgtgggcgtggcaccttcttcgggattaagagaagctagtgcccataatgctggtgtggataagttacctgaggaaatgaatgacatgaaaattagagatgacaaagaaatggaggcaacagtggtggatggtaatggtacagagacaggtcatattatagtaacaacaattggtggtagaaatggccagccaaagcagactataagttacatggctgagcgtgttgttgggcatggttcatttggggttgttttccaggcaaaatgcttagagactggtgaaactgttgctataaagaaagttcttcaagataagaggtataagaaccgtgagctgcaaaccatgcgtcttcttgaccatccgaatgttgtctctttaaagcattgcttcttttcgacaactgagaaggatgagctttaccttaatctggttctcgagtatgtcccggaaactgttcatcgtgtgattaaacactatagcaagttgaatcagaagatgccactaatatatgtcaaactttatacgtatcagatatttagggcattgtcatacatccaccgtgcaattggagtttgtcatcgtgatattaaacctcaaaaccttttggtgaatcctcatacgcatcaggttaaattgtgtgattttggaagtgcaaaagtcttggtaaaaggggagccaaatatatcttatatctgctctaggtattacagagcacctgaacttatatttggagcaactgaatacacgacagctattgacatctggtctgttggctgtgtccttgctgagctattgcttggacagcctctttttcctggtgagagtggagtcgaccagcttgtggagattatcaaggttttgggtactccaacaagggaggaaattaaatgcatgaacccgaattatacagagtacaaattcccccagattaaagctcatccttggcacaagattttccacaagcgcatgcctcctgaagcagttgatctggtttctagattactgcaatactcccctaacctacggtgcactgctctggatgccttgacacatcccttttttgacgagctccgtgatcaaaacacccgcctgccaaatgggcgtttcctcccaccgttatttaacttcaaatctcatgaattgaagggagtttcagtggagacactggtcaaattgatacccgagcatgcaagaaagcaatgcccctttctcggttta

SEQ ID NO: 1328 - protein, 409 aa, Populus trichocarpa
  POPTR_0005s00710.1
MGSVGVAPSSGLREASAHNAGVDKLPEEMNDMKIRDDKEMEATVVDGNGTETGHIIVTTIGGRNGQPKQTISYMAERVVGHGSFGVVFQAKCLETGETVAIKKVLQDKRYKNRELQTMRLLDHPNVVSLKHCFFSTTEKDELYLNLVLEYVPETVHRVIKHYSKLNQKMPLIYVKLYTYQIFRALSYIHRAIGVCHRDIKPQNLLVNPHTHQVKLCDFGSAKVLVKGEPNISYICSRYYRAPELIFGATEYTTAIDIWSVGCVLAELLLGQPLFPGESGVDQLVEIIKVLGTPTREEIKCMNPNYTEYKFPQIKAHPWHKIFHKRMPPEAVDLVSRLLQYSPNLRCTALDALTHPFFDELRDQNTRLPNGRFLPPLFNFKSHELKGVSVETLVKLIPEHARKQCPFLGL

SEQ ID NO: 1329 - DNA, 1227 bp, Populus trichocarpa; identical to SEQ ID NO: 1327
  POPTR_0005s00710.4

SEQ ID NO: 1330 - protein, 409 aa, Populus trichocarpa; identical to SEQ ID NO: 1328
  POPTR_0005s00710.4

SEQ ID NO: 1331 - DNA, 1227 bp, Populus trichocarpa; identical to SEQ ID NO: 1327
  POPTR_0005s00710.3

SEQ ID NO: 1332 - protein, 409 aa, Populus trichocarpa; identical to SEQ ID NO: 1328
  POPTR_0005s00710.3

SEQ ID NO: 1333 - DNA, 1215 bp, Populus trichocarpa
  POPTR_0005s00710.2
atgacaaagtatggcaatcagctccttgtcgttggtttatgcctctttttgttgtttttagtggatttcggatgcagtcactcactcaggtatgcttttcaggaaatggaggcaacagtggtggatggtaatggtacagagacaggtcatattatagtaacaacaattggtggtagaaatggccagccaaagcagactataagttacatggctgagcgtgttgttgggcatggttcatttggggttgttttccaggcaaaatgcttagagactggtgaaactgttgctataaagaaagttcttcaagataagaggtataagaaccgtgagctgcaaaccatgcgtcttcttgaccatccgaatgttgtctctttaaagcattgcttcttttcgacaactgagaaggatgagctttaccttaatctggttctcgagtatgtcccggaaactgttcatcgtgtgattaaacactatagcaagttgaatcagaagatgccactaatatatgtcaaactttatacgtatcagatatttagggcattgtcatacatccaccgtgcaattggagtttgtcatcgtgatattaaacctcaaaaccttttggtgaatcctcatacgcatcaggttaaattgtgtgattttggaagtgcaaaagtcttggtaaaaggggagccaaatatatcttatatctgctctaggtattacagagcacctgaacttatatttggagcaactgaatacacgacagctattgacatctggtctgttggctgtgtccttgctgagctattgcttggacagcctctttttcctggtgagagtggagtcgaccagcttgtggagattatcaaggttttgggtactccaacaagggaggaaattaaatgcatgaacccgaattatacagagtacaaattcccccagattaaagctcatccttggcacaagattttccacaagcgcatgcctcctgaagcagttgatctggtttctagattactgcaatactcccctaacctacggtgcactgctctggatgccttgacacatcccttttttgacgagctccgtgatcaaaacacccgcctgccaaatgggcgtttcctcccaccgttatttaacttcaaatctcatgaattgaagggagtttcagtggagacactggtcaaattgatacccgagcatgcaagaaagcaatgcccctttctcggttta

SEQ ID NO: 1334 - protein, 405 aa, Populus trichocarpa
  POPTR_0005s00710.2
MTKYGNQLLVVGLCLFLLFLVDFGCSHSLRYAFQEMEATVVDGNGTETGHIIVTTIGGRNGQPKQTISYMAERVVGHGSFGVVFQAKCLETGETVAIKKVLQDKRYKNRELQTMRLLDHPNVVSLKHCFFSTTEKDELYLNLVLEYVPETVHRVIKHYSKLNQKMPLIYVKLYTYQIFRALSYIHRAIGVCHRDIKPQNLLVNPHTHQVKLCDFGSAKVLVKGEPNISYICSRYYRAPELIFGATEYTTAIDIWSVGCVLAELLLGQPLFPGESGVDQLVEIIKVLGTPTREEIKCMNPNYTEYKFPQIKAHPWHKIFHKRMPPEAVDLVSRLLQYSPNLRCTALDALTHPFFDELRDQNTRLPNGRFLPPLFNFKSHELKGVSVETLVKLIPEHARKQCPFLGL

SEQ ID NO: 1335 - DNA, 1227 bp, Populus trichocarpa
  POPTR_0013s00610.1
atggcttctgcgggggtggcacctacctcgggtttgagagaagctggtgtccataatgctggcgtggacaagttacctgaggaaatgaatgacatgaaaattagggatgacaaagacatggaggcaacagtagtggatggtaatggtacagagacaggtcatattatagtaacaacaattggtggtagaaatggccagccaaagcagacaataagttacatggctgagcgtgttgttgggaatggttcatttggagttgttttccaggcaaaatgcttagagaccagtgaaactgttgctataaagaaagttcttcaagataagaggtacaagaaccgtgagctgcaaaccatgcgtctccttgaccacccaaatgttgtctccttgaagcattgcttcctttcaacgactgagaaagatgagctttatcttaatctggttcttgagtacgtccctgaaactgttcatcgtgtgattaaacactaccgcaaattgaatcagaagatgccactaatatatgtcaaactctatacatatcagatatttagggcattgtcatacatccatcgtgctattggggtgtgtcatcgtgacattaaacctcaaaaccttttggtgaatcctcatacacatcaggttaaattatgtgattttggcagtgctaaagtcttggttaaaggggagccaaatatatcttatatctgctctaggtattacagagcacctgaacttatatttggagcaactgaatacaccacagctattgacatctggtctgctggctgtgtccttgctgagctattgcttggacagcctctatttcctggtgagagtggagtcgaccagcttgttgagattatcaaggttttgggcactccaacaagggaggaaattaagtgcatgaacccaaattatacagagtacaaattcccgcagattaaagctcatccttggcacaagatattccacaagcgcatgcctccagaagcagttgatctggtttcaagattactgcaatactcccctaacttgcggtgcacagctttggatgccttgacgcatcccttttttgacgagctccgtgaccaaaacacccgcttgccaaatgggcgtttccttccaccattatttaacttcaaatctcatgaattgaagggggtgtcagttgagatgttggtcaaattggtacccgagcatgcaagaaaacaatgtgcctttcttggtttg

SEQ ID NO: 1336 - protein, 409 aa, Populus trichocarpa
  POPTR_0013s00610.1
MASAGVAPTSGLREAGVHNAGVDKLPEEMNDMKIRDDKDMEATVVDGNGTETGHIIVTTIGGRNGQPKQTISYMAERVVGNGSFGVVFQAKCLETSETVAIKKVLQDKRYKNRELQTMRLLDHPNVVSLKHCFLSTTEKDELYLNLVLEYVPETVHRVIKHYRKLNQKMPLIYVKLYTYQIFRALSYIHRAIGVCHRDIKPQNLLVNPHTHQVKLCDFGSAKVLVKGEPNISYICSRYYRAPELIFGATEYTTAIDIWSAGCVLAELLLGQPLFPGESGVDQLVEIIKVLGTPTREEIKCMNPNYTEYKFPQIKAHPWHKIFHKRMPPEAVDLVSRLLQYSPNLRCTALDALTHPFFDELRDQNTRLPNGRFLPPLFNFKSHELKGVSVEMLVKLVPEHARKQCAFLGL

SEQ ID NO: 1337 - DNA, 1227 bp, Solanum lycopersicum
  Solyc01g101000.2.1
atggcttccgtgggcttagcacctacatcgggtttgagagaatccagtggccataatgctggggtagataggttgcctgaggagatgaatgacatgagaatcagggatgataaggaaatggaagcagcaattgttgacggtaatgggactgagacaggccacataatagtgacaactattggtggtagaaatggccagccaaagcagactattagttacatggctgaacgtgttgttggacaaggatcctttggggtggtgtttcaggcaaaatgcttagagactggtgaaactgttgctattaaaaaggttcttcaagataaaagatataagaaccgagaattgcagacaatgcgccttcttgaccaccctaatgttgtgtctctcaaacactgcttcttttccacaactgacaaggatgaactgtatcttaacttggttcttgagtatgtacctgaaaccgttcaccgtgttatcaaacactacaataagctgaatcaaaggatgccgttgatacttgtgaagctttatacatatcagattttcagggcattgtcttacatacaccgcactattggagtgtgccacagggacattaaacctcagaatcttttggtgaatccacatacccaccaggttaaattatgcgattttgggagtgccaaagttctggttaaaggagaaccaaatatttcttacatctgttctaggtattatcgagcacctgagctcatatttggtgcaacagagtacactactgctatagatgtttggtctgctggctgtgtcctagctgagctacttcttggtcagccattatttccaggtgaaagtggagttgatcagcttgttgagatcattaaggttttaggcactcctacaagggaagaaattaaatgtatgaatcccaactataatgagttcaaatttcctcaaattaaagctcatccatggcacaagatatttcataagcgcatgcctccagaagcagttgatctggtctcaagactgcttcagtactctcctaacttgcgctgtgctgctttggatgccttggttcacccattttttgacgagcttcgtgatcccaatacacgcttgcctaatggacgctttcttcctcccttgtttaacttcaaggctcatgagttgaagaatgtgcatgcagagatattactgaagttggttccagagcacgccagaaaacagtgcccttcccttgggtta

SEQ ID NO: 1338 - protein, 409 aa, Solanum lycopersicum
  Solyc01g101000.2.1
MASVGLAPTSGLRESSGHNAGVDRLPEEMNDMRIRDDKEMEAAIVDGNGTETGHIIVTTIGGRNGQPKQTISYMAERVVGQGSFGVVFQAKCLETGETVAIKKVLQDKRYKNRELQTMRLLDHPNVVSLKHCFFSTTDKDELYLNLVLEYVPETVHRVIKHYNKLNQRMPLILVKLYTYQIFRALSYIHRTIGVCHRDIKPQNLLVNPHTHQVKLCDFGSAKVLVKGEPNISYICSRYYRAPELIFGATEYTTAIDVWSAGCVLAELLLGQPLFPGESGVDQLVEIIKVLGTPTREEIKCMNPNYNEFKFPQIKAHPWHKIFHKRMPPEAVDLVSRLLQYSPNLRCAALDALVHPFFDELRDPNTRLPNGRFLPPLFNFKAHELKNVHAEILLKLVPEHARKQCPSLGL

SEQ ID NO: 1339 - DNA, 1209 bp, Citrus clementina
  clementine0.9_011958m
atggcttctgttagtgtagtacctgcttctggaaatacagtcggtgttgataggttacccgaggagatgaatgacatgaaaattagggatgacaaggaaatggaagcaactgtggttgatggtaatgggacggaagcgggtcatataattgtcaccactattgggggtaaaaatgggcagcccaaacagacaataagctacatggctgaacgtgttgttggccatggatcttttggagtagttttccaggctaagtgcttagagactggtgaagctgttgcaataaagaaggttcttcaggacaagaggtacaagaaccgggagctgcaaaccatgcgtcttctggaccacccaaatgttgtgtccctgaagcactgtttcttttcaacaactgaaaaggatgagctatatcttaaccttgttcttgagtatgttccggagaccgttcaccgggtgatcaaacatcactataaaatgagccaaaggatgccattgatttacgtcaaactttacttttatcagatatgtagagcacttgcttacatccataacactattggagtttgccacagggacataaagcctcaaaatttactggtcaatccacatacccaccagctgaaattgtgtgactttggaagtgcaaaagttctggtaaagggggaaccaaatatctcttacatatgttcaagatactatcgagcacctgaacttatatttggtgcaactgagtacaccgcagcaattgatatctggtctgccggctgcgttttggctgaactgctactgggacagcctcttttccctggcgagagcggtgtagaccagcttgtggaaatcatcaaggttttaggtactccaactagggaagaaataaagtgcatgaatccaaactacactgagtttaaatttccccaaatcaaagctcacccgtggcacaagatattccagaagcgtatgcccccagaagctgtagatcttgtctctagactactgcagtactctcccaatcttcggagcacagcattggaagctttgattcatcccttctttgatgaactacgtgatcctaatacccgactcccaaatggacgctttcttccaccattgtttaactttaagcctcatgaactgaagggtgtgcccgtggatatgttggtgaagctgatccctgagcatgcaagaaaacagtgtgccttccttggtttg

SEQ ID NO: 1340 - protein, 403 aa, Citrus clementina
  clementine0.9_011958m
MASVSVVPASGNTVGVDRLPEEMNDMKIRDDKEMEATVVDGNGTEAGHIIVTTIGGKNGQPKQTISYMAERVVGHGSFGVVFQAKCLETGEAVAIKKVLQDKRYKNRELQTMRLLDHPNVVSLKHCFFSTTEKDELYLNLVLEYVPETVHRVIKHHYKMSQRMPLIYVKLYFYQICRALAYIHNTIGVCHRDIKPQNLLVNPHTHQLKLCDFGSAKVLVKGEPNISYICSRYYRAPELIFGATEYTAAIDIWSAGCVLAELLLGQPLFPGESGVDQLVEIIKVLGTPTREEIKCMNPNYTEFKFPQIKAHPWHKIFQKRMPPEAVDLVSRLLQYSPNLRSTALEALIHPFFDELRDPNTRLPNGRFLPPLFNFKPHELKGVPVDMLVKLIPEHARKQCAFLGL

SEQ ID NO: 1341 - DNA, 1209 bp, Citrus clementina; identical to SEQ ID NO: 1339
  clementine0.9_011974m

SEQ ID NO: 1342 - protein, 403 aa, Citrus clementina; identical to SEQ ID NO: 1340
  clementine0.9_011974m

SEQ ID NO: 1343 - DNA, 1062 bp, Citrus clementina
  clementine0.9_014251m
atggcttctgttagtgtagtacctgcttctggaaatacagtcggtgttgataggttacccgaggagatgaatgacatgaaaattagggatgacaaggaaatggaagcaactgtggttgatggtaatgggacggaagcgggtcatataattgtcaccactattgggggtaaaaatgggcagcccaaacagacaataagctacatggctgaacgtgttgttggccatggatcttttggagtagttttccaggctaagtgcttagagactggtgaagctgttgcaataaagaaggttcttcaggacaagaggtacaagaaccgggagctgcaaaccatgcgtcttctggaccacccaaatgttgtgtccctgaagcactgtttcttttcaacaactgaaaaggatgagctatatcttaaccttgttcttgagtatgttccggagaccgttcaccgggtgatcaaacatcactataaaatgagccaaaggatgccattgatttacgtcaaactttacttttatcagatatgtagagcacttgcttacatccataacactattggagtttgccacagggacataaagcctcaaaatttactggtcaatccacatacccaccagctgaaattgtgtgactttggaagtgcaaaagttctggtaaagggggaaccaaatatctcttacatatgttcaagatactatcgagcacctgaacttatatttggtgcaactgagtacaccgcagcaattgatatctggtctgccggctgcgttttggctgaactgctactgggacagcctcttttccctggcgagagcggtgtagaccagcttgtggaaatcatcaaggttttaggtactccaactagggaagaaataaagtgcatgaatccaaactacactgagtttaaatttccccaaatcaaagctcacccgtggcacaagatattccagaagcgtatgcccccagaagctgtagatcttgtctctagactactgcagtactctcccaatcttcggagcacagcatttgatgcagttggaagctttgattcatcccttctt

SEQ ID NO: 1344 - protein, 354 aa, Citrus clementina
  clementine0.9_014251m
MASVSVVPASGNTVGVDRLPEEMNDMKIRDDKEMEATVVDGNGTEAGHIIVTTIGGKNGQPKQTISYMAERVVGHGSFGVVFQAKCLETGEAVAIKKVLQDKRYKNRELQTMRLLDHPNVVSLKHCFFSTTEKDELYLNLVLEYVPETVHRVIKHHYKMSQRMPLIYVKLYFYQICRALAYIHNTIGVCHRDIKPQNLLVNPHTHQLKLCDFGSAKVLVKGEPNISYICSRYYRAPELIFGATEYTAAIDIWSAGCVLAELLLGQPLFPGESGVDQLVEIIKVLGTPTREEIKCMNPNYTEFKFPQIKAHPWHKIFQKRMPPEAVDLVSRLLQYSPNLRSTAFDAVGSFDSSLL

SEQ ID NO: 1345 - DNA, 1227 bp, Eucalyptus grandis
  Eucgr.K03568.1
atggcttctgtgagcatggtgcccgtgtctggtttaagagatcccactgggaacacggtggcctttgatagattgcctgatgagatgaatgacatgaaaattagggatgagaaggacatggaggcagctgttgtcaatggtaacggggcagaggcgggtcacataatcgtcacgacaattggtggtaaaaatgggcagccaaaacagacaataagctatatggctgagcgggctgttgggcagggatcatttggtatagtcttccaggcaaaatgtttggagactggtgaaacagttgcaattaagaaggtcctacaagacaagaggtacaaaaatcgggagcttcaaaccatgcgtcttctagagcacccaaatgttgtgtcccttaagcactgtttcttttccacaaccgaaaaagacgagctctacctgaacctcgtccttgaatatgtgccggagacagtccacagagtgataaaacattataacaagatgaaccagaggatgccattaatatatgtgaaactctatttttaccagatatgtcgagcacttgcttacattcacaactgcatcggagtgtgccacagggacataaagcctcaaaacctactggttaaccctcacactcaccagctaaagttatgcgactttgggagcgcaaaagttttggtaaagggggagccaaatatatcttacatttgttcccgatactatcgtgcacccgagctcatattcggcgctactgagtacactacagcaatcgatatctggtcagctggctgtgtactggctgagctactgattggacagcctctctttcctggtgagagtggtgtggaccagcttgttgaaatcattaaggttttgggtaccccaaccagggaggaaataaagtgcatgaatcccaactacaccgagtttaagtttcctcaaattaaggctcatccgtggcacaagatattccataagcgcatgccctcggaagccgtggatctcgtctcacggctactgcagtattctccaaatcttcgaagcacagctctggaggctttggtccaccctttcttcgatgagctacgcgagcccaatgcccgtctaccaaatgggcgtccacttccgccactcttcaacttcaagactcacgaattgagaggagtaccatcggagatgctgcataagctgattcccgagcatgcaagaagaccattgccctcccacgggttt

SEQ ID NO: 1346 - protein, 409 aa, Eucalyptus grandis
  Eucgr.K03568.1
MASVSMVPVSGLRDPTGNTVAFDRLPDEMNDMKIRDEKDMEAAVVNGNGAEAGHIIVTTIGGKNGQPKQTISYMAERAVGQGSFGIVFQAKCLETGETVAIKKVLQDKRYKNRELQTMRLLEHPNVVSLKHCFFSTTEKDELYLNLVLEYVPETVHRVIKHYNKMNQRMPLIYVKLYFYQICRALAYIHNCIGVCHRDIKPQNLLVNPHTHQLKLCDFGSAKVLVKGEPNISYICSRYYRAPELIFGATEYTTAIDIWSAGCVLAELLIGQPLFPGESGVDQLVEIIKVLGTPTREEIKCMNPNYTEFKFPQIKAHPWHKIFHKRMPSEAVDLVSRLLQYSPNLRSTALEALVHPFFDELREPNARLPNGRPLPPLFNFKTHELRGVPSEMLHKLIPEHARRPLPSHGF

SEQ ID NO: 1347 - DNA, 1227 bp, Populus trichocarpa
  POPTR_0002s19110.1
atggcttctgtaagtgttgtccctgcctctggattgcgagatacacttggaaacacaaccggtgttgataagttgcctgaagagatgaatgacatgaaaattagtgatgacaaggaaatggaagcagctgtggttgatggtaatggaaccgagacaggtcatataatcgtcacgactattggtggcaaaaatggccagccaaagcagacaataagctatatggctgagcgtgttgttgggcatggatcttttggactagtattccaggcgaaatgtttagagactggtgaaactgttgctattaaaaaggttctgcaagataaaaggtacaagaaccgggagctgcaaaccatgcgtctgctagaccaccctaatgtagtgtctttgaaacactgtttcttctcaacaactgaaaaagatgaactctatcttaacctggtacttgagtatgtccctgagaccatccatcgtgtaatcaaacactactataagatgagtcaaaggatgcctttgatatatgtcaaactttacttttatcagatttgtagagctcttgcttacattcacaatagtattggagtgtgccatagagacatcaagcctcaaaatttattggtgaacccacatacgcaccaagtgaaactatgtgactttggaagtgcaaaagttttggttaaaggcgaaccaaacatatcttacatatgttctaggtactatcgagcacctgaacttatttttggtgccactgagtacaccactgccattgacatctggtctgcgggatgtgttctggctgaattactgcttggacagcctctctttccgggtgagagcggagtagaccagctggttgaaattataaaggttttgggtaccccaacaagggaggaaattaagtgcatgaatcctaattacacagagttcaaatttcctcaaattaaagctcacccatggcacaagatattccacaagcgcatgcctcctgaagctgtggaccttgtctcaagactattacagtactctccaaacctccgaagcacagctctggaggctttgatccatcccttctttgatgagctgcgtgatcctaacgcccgtttacctaatggacgcatccttccaccactgttcaactttaagcctcatgagctgaaaggagtgccagttgagatgcttgtcaagctgatcccagagcatgcaagaaagcagtgtgccttccttgggttg

SEQ ID NO: 1348 - protein, 409 aa, Populus trichocarpa
  POPTR_0002s19110.1
MASVSVVPASGLRDTLGNTTGVDKLPEEMNDMKISDDKEMEAAVVDGNGTETGHIIVTTIGGKNGQPKQTISYMAERVVGHGSFGLVFQAKCLETGETVAIKKVLQDKRYKNRELQTMRLLDHPNVVSLKHCFFSTTEKDELYLNLVLEYVPETIHRVIKHYYKMSQRMPLIYVKLYFYQICRALAYIHNSIGVCHRDIKPQNLLVNPHTHQVKLCDFGSAKVLVKGEPNISYICSRYYRAPELIFGATEYTTAIDIWSAGCVLAELLLGQPLFPGESGVDQLVEIIKVLGTPTREEIKCMNPNYTEFKFPQIKAHPWHKIFHKRMPPEAVDLVSRLLQYSPNLRSTALEALIHPFFDELRDPNARLPNGRILPPLFNFKPHELKGVPVEMLVKLIPEHARKQCAFLGL

SEQ ID NO: 1349 - DNA, 1143 bp, Vitis vinifera
  GSVIVT01028190001
atgaatgacatgaaaattagggatgacaaggaaatggaagatactgtggtggatggtaatgggacagagactggtcatataattgtaacaactattggagggaaaaatggccagccaaagcagaccatcagctatatggcagagcgtgttgttgggcatggatcttttggagtagtgttccaggcaaagtgcttagagactggtgaaacagttgcaattaaaaaagttcttcaagacaagagatacaagaacagagagttacagactatgcgtcttctggaccaccctaacgttgtgtcgctgaaacactgtttcttttcaacaactgaaaaggaagagctctatcttaatttagtgcttgagtatgtccctgagactgttcatcgggtgatcaaacactacaataagatgaaccagaggatgccaatgatatatgtgaaactttacacttaccagatttgtagagcgctggcttacattcatggtggtattggagtatgccacagggatataaaacctcaaaatttattggttaacccacatacccaccagctaaagctatgtgattttggaagtgcaaaagttttggtaaaaggggaattgaacatatcttacatctgttctaggtactatcgagcacctgaacttatatttggtgcaactgaatacaccacagccattgatatctggtcagccggctgtgttttggctgaactactgcttggacaacctctctttcccggggagagtggagtggatcagcttgtggaaatcattaaggttttgggcaccccaacaagagaggaaattaagtgcatgaatcccaattacacagaatttaaattcccacaaattaaagcccacccatggcacaagatattccataagcggatgccccctgaggccgttgatcttgtctcaagactgctgcagtactctccgaaccttcgtagcacagctctggaggctttgatccatcccttttttgatgagctacgtgagccaaacacccgtctgccaaatggacgtttccttcccccattgttcaacttcaagcctcatgaactaaagggcgtgcctgttgatatgttggtgaagttgatcccagaacatgcgagaaagcaatgtgccttccttgggttg

SEQ ID NO: 1350 - protein, 381 aa, Vitis vinifera
  GSVIVT01028190001
MNDMKIRDDKEMEDTVVDGNGTETGHIIVTTIGGKNGQPKQTISYMAERVVGHGSFGVVFQAKCLETGETVAIKKVLQDKRYKNRELQTMRLLDHPNVVSLKHCFFSTTEKEELYLNLVLEYVPETVHRVIKHYNKMNQRMPMIYVKLYTYQICRALAYIHGGIGVCHRDIKPQNLLVNPHTHQLKLCDFGSAKVLVKGELNISYICSRYYRAPELIFGATEYTTAIDIWSAGCVLAELLLGQPLFPGESGVDQLVEIIKVLGTPTREEIKCMNPNYTEFKFPQIKAHPWHKIFHKRMPPEAVDLVSRLLQYSPNLRSTALEALIHPFFDELREPNTRLPNGRFLPPLFNFKPHELKGVPVDMLVKLIPEHARKQCAFLGL

SEQ ID NO: 1351 - DNA, 1227 bp, Glycine max
  Glyma02g01220.1
atggcatcggcgggtgtagcacctgcttctggggtaagagatgtgaatgcaagttctgttgctgttgaaaggttgcctgatgagatgaatggcatgaaaattagggatgaaagggaaatggaagcaactgtggtagatggaaatgggactgaaacaggacatataattgttactaccattggtggtaaaaatggccagccaaagcagacaataagctacatggctgagcgagttgttggaaatggatcatttggtgtagttttccaggcaaagtgcttggagacaggggaaactgtggctataaagaaggttcttcaagacaagaggtacaagaaccgggaattgcaaaccatgcgtcttctggatcaccccaatgttgtaactttgaagcattgcttcttttcaacaactgaaaaagacgagctttatcttaatttggtacttgagtatgttcctgagactgtccaccgagttatcaggcattacaacaaaatgaatcaaagaatgcctttgatatacgtgaaactctatttttaccagatatgtagagcactagcttatattcacaactgcattggagtgtctcacagggacataaaacctcaaaatttactggtcaatcctcacactcaccagctaaagatttgtgactttgggagtgcaaaagtcttggtcaaaggcgaaccaaacatatcttatatctgttctaggtactatagagcacctgagcttatatttggtgcaactgagtacaccacggccattgatatctggtcagccggttgtgtacttggtgaactattgcttggccagcctctattccctggtgagagtggagtagatcagcttgttgaaattatcaaggttttaggaaccccgacaagggaagaaatcaagtgtatgaatcctaattacaccgagttcaaatttccacaaattaaagctcatccatggcataagatatttcacaagcgtttacctcctgaggctgtggatctcgtctcaaggctactgcaatactctccaaatcttcgatgcacagctctggaggccttggctcacccattctttgatgaactgcgtgatccaaatactcgcctaccaaatgggcgttaccttcccccactctttaacttcagagccaatgagcttaaaggagtgcctccagagatgctggtgaaactgattccatctcatgcaagaaagcagtgtgccttgtttgcgtca

SEQ ID NO: 1352 - protein, 409 aa, Glycine max
  Glyma02g01220.1
MASAGVAPASGVRDVNASSVAVERLPDEMNGMKIRDEREMEATVVDGNGTETGHIIVTTIGGKNGQPKQTISYMAERVVGNGSFGVVFQAKCLETGETVAIKKVLQDKRYKNRELQTMRLLDHPNVVTLKHCFFSTTEKDELYLNLVLEYVPETVHRVIRHYNKMNQRMPLIYVKLYFYQICRALAYIHNCIGVSHRDIKPQNLLVNPHTHQLKICDFGSAKVLVKGEPNISYICSRYYRAPELIFGATEYTTAIDIWSAGCVLGELLLGQPLFPGESGVDQLVEIIKVLGTPTREEIKCMNPNYTEFKFPQIKAHPWHKIFHKRLPPEAVDLVSRLLQYSPNLRCTALEALAHPFFDELRDPNTRLPNGRYLPPLFNFRANELKGVPPEMLVKLIPSHARKQCALFAS

SEQ ID NO: 1353 - DNA, 1176 bp, Glycine max
  Glyma02g01220.3
atggcatcggcgggtgtagcacctgcttctggggtaagagatgtgaatgcaagttctgttgctgttgaaaggttgcctgatgagatgaatggcatgaaaattagggatgaaagggaaatggaagcaactgtggtagatggaaatgggactgaaacaggacatataattgttactaccattggtggtaaaaatggccagccaaagcagacaataagctacatggctgagcgagttgttggaaatggatcatttggtgtagttttccaggcaaagtgcttggagacaggggaaactgtggctataaagaaggttcttcaagacaagaggtacaagaaccgggaattgcaaaccatgcgtcttctggatcaccccaatgttgtaactttgaagcattgcttcttttcaacaactgaaaaagacgagctttatcttaatttggtacttgagtatgttcctgagactgtccaccgagttatcaggcattacaacaaaatgaatcaaagaatgcctttgatatacgtgaaactctatttttaccagatatgtagagcactagcttatattcacaactgcattggagtgtctcacagggacataaaacctcaaaatttactggtcaatcctcacactcaccagctaaagatttgtgactttgggagtgcaaaagtcttggtcaaaggcgaaccaaacatatcttatatctgttctaggtactatagagcacctgagcttatatttggtgcaactgagtacaccacggccattgatatctggtcagccggttgtgtacttggtgaactattgcttggccaggttttaggaaccccgacaagggaagaaatcaagtgtatgaatcctaattacaccgagttcaaatttccacaaattaaagctcatccatggcataagatatttcacaagcgtttacctcctgaggctgtggatctcgtctcaaggctactgcaatactctccaaatcttcgatgcacagctctggaggccttggctcacccattctttgatgaactgcgtgatccaaatactcgcctaccaaatgggcgttaccttcccccactctttaacttcagagccaatgagcttaaaggagtgcctccagagatgctggtgaaactgattccatctcatgcaagaaagcagtgtgccttgtttgcgtca

SEQ ID NO: 1354 - protein, 392 aa, Glycine max
  Glyma02g01220.3
MASAGVAPASGVRDVNASSVAVERLPDEMNGMKIRDEREMEATVVDGNGTETGHIIVTTIGGKNGQPKQTISYMAERVVGNGSFGVVFQAKCLETGETVAIKKVLQDKRYKNRELQTMRLLDHPNVVTLKHCFFSTTEKDELYLNLVLEYVPETVHRVIRHYNKMNQRMPLIYVKLYFYQICRALAYIHNCIGVSHRDIKPQNLLVNPHTHQLKICDFGSAKVLVKGEPNISYICSRYYRAPELIFGATEYTTAIDIWSAGCVLGELLLGQVLGTPTREEIKCMNPNYTEFKFPQIKAHPWHKIFHKRLPPEAVDLVSRLLQYSPNLRCTALEALAHPFFDELRDPNTRLPNGRYLPPLFNFRANELKGVPPEMLVKLIPSHARKQCALFAS

SEQ ID NO: 1355 - DNA, 1227 bp, Glycine max; identical to SEQ ID NO: 1351
  Glyma02g01220.2

SEQ ID NO: 1356 - protein, 409 aa, Glycine max; identical to SEQ ID NO: 1352
  Glyma02g01220.2

SEQ ID NO: 1357 - DNA, 1227 bp, Glycine max
  Glyma10g01280.1
atggcatcggcgggtgtagcacctgcttctggagtaagagatgtgaatgcaaattcggttgctgttgaaaggttgcctgatgagatgaatggcatgaaaattagggatgaaagggaaatggaagcaactgtggtagatggaaatgggactgaaacaggacatataattgttactaccattggtggtaaaaatggccagccaaagcagacaataagctatatggctgagcgagttgttggaaatggatcatttggtgtagttttccaggcaaagtgcttggagacaggggaaactgtggctataaagaaggttcttcaagacaagagatacaagaaccgggaactgcaaaccatgcgtcttctggaccatcccaatgttgtaactttgaagcattgtttcttttcaacaactgaaaaagacgagctttatcttaatttggtacttgagtatgttcctgagactgtccaccgagttatcagacattacaacaaaatgaatcaaagaatgcctttgatatatgtgaaactctatttttaccagatatgtagagctctagcttatattcacaactgtattggagtgtctcacagggacataaaacctcaaaatttactggtcaatcctcacactcaccagctaaagatttgtgactttgggagtgcaaaagtcttggtcaaaggggaaccaaacatatcttacatctgctctaggtactatagagcacctgaacttatatttggtgcaactgagtacaccacggccattgatatttggtcagctggttgtgtacttggtgaactaatgcttggccagcctctattccctggtgagagtggagtagatcagcttgttgaaattatcaaggttttaggtaccccaacaagggaagaaatcaagtgcatgaatcctaattataccgagtccaaatttccacaaattaaagctcacccatggcacaagatctttcacaagcgcttacctcctgaggctgtggatctcgtctcaaggctactgcaatactctccaaatcttcgatgcacagctctggaggccttggttcatccattctttgatgaactgcgtgatccaaatacccgcctaccaaatgggcgttaccttcccccactctttaacttcagagccaatgagcttaaaggagtgcctccaggcatgctggtgaaactgattccatctcatgcaagaaagcagtgtgccttgtttgcgtca

SEQ ID NO: 1358 - protein, 409 aa, Glycine max
  Glyma10g01280.1
MASAGVAPASGVRDVNANSVAVERLPDEMNGMKIRDEREMEATVVDGNGTETGHIIVTTIGGKNGQPKQTISYMAERVVGNGSFGVVFQAKCLETGETVAIKKVLQDKRYKNRELQTMRLLDHPNVVTLKHCFFSTTEKDELYLNLVLEYVPETVHRVIRHYNKMNQRMPLIYVKLYFYQICRALAYIHNCIGVSHRDIKPQNLLVNPHTHQLKICDFGSAKVLVKGEPNISYICSRYYRAPELIFGATEYTTAIDIWSAGCVLGELMLGQPLFPGESGVDQLVEIIKVLGTPTREEIKCMNPNYTESKFPQIKAHPWHKIFHKRLPPEAVDLVSRLLQYSPNLRCTALEALVHPFFDELRDPNTRLPNGRYLPPLFNFRANELKGVPPGMLVKLIPSHARKQCALFAS

SEQ ID NO: 1359 - DNA, 1146 bp, Glycine max
  Glyma10g01280.2
atggcatcggcgggtgtagcacctgcttctggagaaatggaagcaactgtggtagatggaaatgggactgaaacaggacatataattgttactaccattggtggtaaaaatggccagccaaagcagacaataagctatatggctgagcgagttgttggaaatggatcatttggtgtagttttccaggcaaagtgcttggagacaggggaaactgtggctataaagaaggttcttcaagacaagagatacaagaaccgggaactgcaaaccatgcgtcttctggaccatcccaatgttgtaactttgaagcattgtttcttttcaacaactgaaaaagacgagctttatcttaatttggtacttgagtatgttcctgagactgtccaccgagttatcagacattacaacaaaatgaatcaaagaatgcctttgatatatgtgaaactctatttttaccagatatgtagagctctagcttatattcacaactgtattggagtgtctcacagggacataaaacctcaaaatttactggtcaatcctcacactcaccagctaaagatttgtgactttgggagtgcaaaagtcttggtcaaaggggaaccaaacatatcttacatctgctctaggtactatagagcacctgaacttatatttggtgcaactgagtacaccacggccattgatatttggtcagctggttgtgtacttggtgaactaatgcttggccagcctctattccctggtgagagtggagtagatcagcttgttgaaattatcaaggttttaggtaccccaacaagggaagaaatcaagtgcatgaatcctaattataccgagtccaaatttccacaaattaaagctcacccatggcacaagatctttcacaagcgcttacctcctgaggctgtggatctcgtctcaaggctactgcaatactctccaaatcttcgatgcacagctctggaggccttggttcatccattctttgatgaactgcgtgatccaaatacccgcctaccaaatgggcgttaccttcccccactctttaacttcagagccaatgagcttaaaggagtgcctccaggcatgctggtgaaactgattccatctcatgcaagaaagcagtgtgccttgtttgcgtca

SEQ ID NO: 1360 - protein, 382 aa, Glycine max
  Glyma10g01280.2
MASAGVAPASGEMEATVVDGNGTETGHIIVTTIGGKNGQPKQTISYMAERVVGNGSFGVVFQAKCLETGETVAIKKVLQDKRYKNRELQTMRLLDHPNVVTLKHCFFSTTEKDELYLNLVLEYVPETVHRVIRHYNKMNQRMPLIYVKLYFYQICRALAYIHNCIGVSHRDIKPQNLLVNPHTHQLKICDFGSAKVLVKGEPNISYICSRYYRAPELIFGATEYTTAIDIWSAGCVLGELMLGQPLFPGESGVDQLVEIIKVLGTPTREEIKCMNPNYTESKFPQIKAHPWHKIFHKRLPPEAVDLVSRLLQYSPNLRCTALEALVHPFFDELRDPNTRLPNGRYLPPLFNFRANELKGVPPGMLVKLIPSHARKQCALFAS

SEQ ID NO: 1361 - DNA, 1287 bp, Citrus clementina
  clementine0.9_010853m
atgtactctactggtatggcacatgctttggctgttgcaaaacctgaagacgatgatgtaatgattgttgacaaactcccagcaaaacctgatgatgacgatgatgcaatgcctgtcgataaactcccagaggaaatcaatgaaatgaagattaaggatgagagagttgaaaaggaaatggaagcaaccgtggttgatggaaatggaactgagactggccatattattgtaacaactattggtggtagaaatggccaacccaagcagaccataagttacatggcagaacgcgtagtcggacagggctcatttggaatcgtatttcaggctaagtgtttagaaactggggaaactgttgcaatcaagaaggttttgcaggataagagatataagaaccgtgagctacaaacaatgcgccttctcgatcatcctaatgtggtatcactcaaacattgtttcttttcaactaccgacaaggatgagctctatctcaatttggtgcttgagtttgtacctgagactgtttatcgtgtagcgaagcactatagcagggcaaatcagcgaatgcctttgatatatgtcaagctctacacatatcagatttgcagagcattggcatatattcatgggggcataggagtatgccacagggacatcaagccgcagaatcttcttgttaatccccatacccatcaagtcaagctctgtgactttggaagtgcaaaagttttggtcaaaggcgagccaaacatatcatatatttgttctcgttactatcgagctccggaactcatatttggggcaactgagtacaccactgcaattgacatatggtctgttggttgtgtactcgctgaattacttctcggacagcctctctttccgggtgagagtggagttgatcagctagttgagattattaaggtacttggcacaccaactcgtgaggaaatcaaatgcatgaatccaaactatacagagttcaaattcccacaaatcaaggctcatccttggcacaaaatattccacaagcgtatgccccctgaagcagtagatcttgtctcaagacttctccaatattctccaaatttaagatgcactgctttagaagcctgtattcatccatttttttatgaacttcgtgatcctaacgcacgtctccctaatgggcgtccctttcctccccttttcaactttaaacctcaagagctgaaaggggcaagcaaggagctcttatcaaaactgattccagaacatgcacgaaagcaatgtcccttccttggtttc

SEQ ID NO: 1362 - protein, 429 aa, Citrus clementina
  clementine0.9_010853m
MYSTGMAHALAVAKPEDDDVMIVDKLPAKPDDDDDAMPVDKLPEEINEMKIKDERVEKEMEATVVDGNGTETGHIIVTTIGGRNGQPKQTISYMAERVVGQGSFGIVFQAKCLETGETVAIKKVLQDKRYKNRELQTMRLLDHPNVVSLKHCFFSTTDKDELYLNLVLEFVPETVYRVAKHYSRANQRMPLIYVKLYTYQICRALAYIHGGIGVCHRDIKPQNLLVNPHTHQVKLCDFGSAKVLVKGEPNISYICSRYYRAPELIFGATEYTTAIDIWSVGCVLAELLLGQPLFPGESGVDQLVEIIKVLGTPTREEIKCMNPNYTEFKFPQIKAHPWHKIFHKRMPPEAVDLVSRLLQYSPNLRCTALEACIHPFFYELRDPNARLPNGRPFPPLFNFKPQELKGASKELLSKLIPEHARKQCPFLGF

SEQ ID NO: 1363 - DNA, 1227 bp, Citrus clementina
  clementine0.9_011710m
atgtactctactggtatggcacatgctttggctgttgcaaaacctgaagacgatgatgtaatgattgttgacaaactcccagcaaaacctgatgatgacgatgatgcaatgcctgtcgataaactcccagaggaaatcaatgaaatgaagattaaggatgagagagttgaaaaggaaatggaagcaaccgtggttgatggaaatggaactgagactggccatattattgtaacaactattggtggtagaaatggccaacccaagcaggctaagtgtttagaaactggggaaactgttgcaatcaagaaggttttgcaggataagagatataagaaccgtgagctacaaacaatgcgccttctcgatcatcctaatgtggtatcactcaaacattgtttcttttcaactaccgacaaggatgagctctatctcaatttggtgcttgagtttgtacctgagactgtttatcgtgtagcgaagcactatagcagggcaaatcagcgaatgcctttgatatatgtcaagctctacacatatcagatttgcagagcattggcatatattcatgggggcataggagtatgccacagggacatcaagccgcagaatcttcttgttaatccccatacccatcaagtcaagctctgtgactttggaagtgcaaaagttttggtcaaaggcgagccaaacatatcatatatttgttctcgttactatcgagctccggaactcatatttggggcaactgagtacaccactgcaattgacatatggtctgttggttgtgtactcgctgaattacttctcggacagcctctctttccgggtgagagtggagttgatcagctagttgagattattaaggtacttggcacaccaactcgtgaggaaatcaaatgcatgaatccaaactatacagagttcaaattcccacaaatcaaggctcatccttggcacaaaatattccacaagcgtatgccccctgaagcagtagatcttgtctcaagacttctccaatattctccaaatttaagatgcactgctttagaagcctgtattcatccatttttttatgaacttcgtgatcctaacgcacgtctccctaatgggcgtccctttcctccccttttcaactttaaacctcaagagctgaaaggggcaagcaaggagctcttatcaaaactgattccagaacatgcacgaaagcaatgtcccttccttggtttc

SEQ ID NO: 1364 - protein, 409 aa, Citrus clementina
  clementine0.9_011710m
MYSTGMAHALAVAKPEDDDVMIVDKLPAKPDDDDDAMPVDKLPEEINEMKIKDERVEKEMEATVVDGNGTETGHIIVTTIGGRNGQPKQAKCLETGETVAIKKVLQDKRYKNRELQTMRLLDHPNVVSLKHCFFSTTDKDELYLNLVLEFVPETVYRVAKHYSRANQRMPLIYVKLYTYQICRALAYIHGGIGVCHRDIKPQNLLVNPHTHQVKLCDFGSAKVLVKGEPNISYICSRYYRAPELIFGATEYTTAIDIWSVGCVLAELLLGQPLFPGESGVDQLVEIIKVLGTPTREEIKCMNPNYTEFKFPQIKAHPWHKIFHKRMPPEAVDLVSRLLQYSPNLRCTALEACIHPFFYELRDPNARLPNGRPFPPLFNFKPQELKGASKELLSKLIPEHARKQCPFLGF

SEQ ID NO: 1365 - DNA, 1227 bp, Citrus clementina; identical to SEQ ID NO: 1363
  clementine0.9_011714m

SEQ ID NO: 1366 - protein, 409 aa, Citrus clementina; identical to SEQ ID NO: 1364
  clementine0.9_011714m

SEQ ID NO: 1367 - DNA, 1287 bp, Citrus clementina; identical to SEQ ID NO: 1361
  clementine0.9_010872m

SEQ ID NO: 1368 - protein, 429 aa, Citrus clementina; identical to SEQ ID NO: 1362
  clementine0.9_010872m

SEQ ID NO: 1369 - DNA, 1236 bp, Vitis vinifera
  GSVIVT01032446001
atggcttctgctggcattccacctgcttcggcggttggaaaacctagtggcaacacaatgtttgttgataagctgccggaagaaatcaatgaaatgaagatcagggatgacaaggttgaaaaggaaatggaagcaacagtggtcgatggaaatggaactgagacagggcatattattgtaacaactataggtggtagaaatggtcaacccaaacagaccataagttacatggcagagcgtgttgttggacagggttcatttggaattgtatttcaggctaagtgcctagaaactggagaaaccgttgcaatcaagaaggttttacaggataagagatataagaaccgtgagttgcaaacaatgcgtcttcttgaccatccaaatattgtctctctcaaacactgcttcttttcaaccacggacaaggatgaactctatctcaatttggtgcttgaatatgtacctgagacggtttatcgtgtggctaaacactatagcagggcaaatcaacggatgcctctgatatatgtcaaactctacacataccagatttgtagagctttggcatacattcatggggttgtaggagtgtgccacagagatattaagccacagaatctattggttaatccccatattcatcagctcaagctatgtgattttgggagtgcaaaagttctggttaaaggtgagccaaatatatcatatatttgttctcgttattatcgagcaccagaactcatatttggtgcaacggagtacacaactgcaattgacatgtggtctgtgggttgtgtccttgcggaactgcttcttggacagcctctctttccaggtgaaagcggagttgatcagcttgttgagataatcaaagtacttgggacgccaactcgtgaggaaatcaagtgtatgaatccaaactatactgagtttaaattcccacaaatcaaggctcacccctggcacaagatttttcacaagcgcatgcccccagaagcagtagatcttgtctctagacttcttcaatactctccaaatctaaggtgtactgctttggaggcctgtattcacccgttcttcgatgaactgcgcgaccaaaattcccgtctccccaatggccgcccattgcctcctctcttcaactttaagcctcaagaactgaaaggagcgtctctggaactcctggccaaactgataccagaacatgctcgaaagcagtgccccttcctaggcttc

SEQ ID NO: 1370 - protein, 412 aa, Vitis vinifera
  GSVIVT01032446001
MASAGIPPASAVGKPSGNTMFVDKLPEEINEMKIRDDKVEKEMEATVVDGNGTETGHIIVTTIGGRNGQPKQTISYMAERVVGQGSFGIVFQAKCLETGETVAIKKVLQDKRYKNRELQTMRLLDHPNIVSLKHCFFSTTDKDELYLNLVLEYVPETVYRVAKHYSRANQRMPLIYVKLYTYQICRALAYIHGVVGVCHRDIKPQNLLVNPHIHQLKLCDFGSAKVLVKGEPNISYICSRYYRAPELIFGATEYTTAIDMWSVGCVLAELLLGQPLFPGESGVDQLVEIIKVLGTPTREEIKCMNPNYTEFKFPQIKAHPWHKIFHKRMPPEAVDLVSRLLQYSPNLRCTALEACIHPFFDELRDQNSRLPNGRPLPPLFNFKPQELKGASLELLAKLIPEHARKQCPFLGF

SEQ ID NO: 1371 - DNA, 1212 bp, Solanum lycopersicum
  Solyc02g086670.2.1
atgtcttcagcagctggcaaacctattactgatgttgtgcttattgacaacctacctaaagaaataaatgcaatgaagatcaacgatgacaaagaaggaaaggaaatggaagccgctgttgtggatgggaatggaactgaaacaggtcacatcattgtgacgactattggggggaaaaatggtcagccaaagcagaccataagttacatggcggagcgtgtagttggacagggttcctttggaattgtgttccaggccaaatgccttgaaacaggagaaaccgtggcaataaaaaaggtcttgcaggacaagagatacaagaatcgggaattgcagactatgcgacttcttgatcatcctagtattgtttcactgaagcactgcttcttttcgaccacagaaaaggatgagctttatctaaatttggttctagaatttgtacctgaaactctctaccgtgtgttaagacattacagcaaagcaaaccaacggatgcctattatatatgtcaaactgtacacatatcagatatttagagctttggcttacatacatgggataggagtctgccacagggacatcaaacctcagaatttactggtcaacccccacacacatcagcttaagctttgtgattttgggagtgcaaaagtcctggtcaaaggcgagccaaacatttcatatatctgttcacgttattatcgtgcgcccgaactaatattcggagcaactgagtacaccaatgcaattgacatttggtctgtgggttgtgtcctagctgaactgcttcttggacagcccctctttcctggtgagagtggtgtagatcagctcgtcgaaataatcaaggttcttggaacaccaactcgtgaagaaatcaagtgtatgaatccaaattacaccgaatttaagttcccgcaaatcaaagctcacccctggcacaagatttttcacaagcggatgcctcctgaagctgtagatcttgtgataaggcttctacagtattctccaaatctgaggtgcacagcgttggaagctcttggtcacgctttctttgatgagctccgtgaccctaatgctcgtcctcctaatggtcgtccattgccatctctcttcaacttcagacctcaagagctgaaaggagcgtcttcagaactcttaaacaaactgttaccagaacatgctaaaaagcagtgtcccttacttggagtc

SEQ ID NO: 1372 - protein, 404 aa, Solanum lycopersicum
  Solyc02g086670.2.1
MSSAAGKPITDVVLIDNLPKEINAMKINDDKEGKEMEAAVVDGNGTETGHIIVTTIGGKNGQPKQTISYMAERVVGQGSFGIVFQAKCLETGETVAIKKVLQDKRYKNRELQTMRLLDHPSIVSLKHCFFSTTEKDELYLNLVLEFVPETLYRVLRHYSKANQRMPIIYVKLYTYQIFRALAYIHGIGVCHRDIKPQNLLVNPHTHQLKLCDFGSAKVLVKGEPNISYICSRYYRAPELIFGATEYTNAIDIWSVGCVLAELLLGQPLFPGESGVDQLVEIIKVLGTPTREEIKCMNPNYTEFKFPQIKAHPWHKIFHKRMPPEAVDLVIRLLQYSPNLRCTALEALGHAFFDELRDPNARPPNGRPLPSLFNFRPQELKGASSELLNKLLPEHAKKQCPLLGV

SEQ ID NO: 1373 - DNA, 1230 bp, Solanum lycopersicum
  Solyc12g062870.1.1
atggcttctggctgtataatgccttcagcaggtggaaaacctcacactgatgccatgcttgttgacaaacttcctgaagaaattaatgaaatgaagatcagagatgataaagcagaaaaggaaatggaagcagctgtagttgacgggaacggaacagaaaagggccacatcattgtgacaactattgggggcaaaaatggtgagcctaagcagaccattagttacatggccgagcgtgttgttggacagggttcctttggaattgtgtttcaggccaaatgccttgaaactggagaaactgtggcaataaaaaaagttctacaggataagcgatacaagaatcgggaattgcaaacaatacgccttcttgaccatcctaatgttgtttcactgagacactgcttcttttcaaccacagaaaaggatgagctttatcttaatttggttcttgaatatgtacctgagactgtctaccgtgtgttgagacattacagcaaagcaaaccaacggatgccaatgatttatgtcaagctctatacatatcagattttcagagctttggcttacatacatgggataggagtctgccacagggacatcaagcctcagaatttactggtcaacccacatactcaccagcttaagctctgtgattttgggagtgcaaaagttctggtcaaaggcgagccaaatatttcatacatttgttctcgttactatcgtgcgcctgaacttatatttggagcaacagaatacacatttgcaattgacatttggtctgtgggttgtgtccttgctgaactgcttcttgggcagcccctctttcctggtgagagtggagttgatcagcttgtggaaattatcaaggttcttggaacaccaactcgggaggaaatcaagtgtatgaatccaaattacactgagttcaaattcccacaaatcaaagctcacccttggcataaaatttttcataagcggatgcctcctgaagctgtggatcttgtgtcaaggcttctccagtattctccaaatttgcggtctactgcattggaggcttgcacccactctttcttcgatgagcttcgtgatcctaagactcgtctccctaatggtcggccattgccacctctcttcaacttcaggcctcaagagttgaaaggagcatctgcagagctcttgaacaaactgataccagaacatgctaagaagcagtgtacctcccttggtttc

SEQ ID NO: 1374 - protein, 410 aa, Solanum lycopersicum
  Solyc12g062870.1.1
MASGCIMPSAGGKPHTDAMLVDKLPEEINEMKIRDDKAEKEMEAAVVDGNGTEKGHIIVTTIGGKNGEPKQTISYMAERVVGQGSFGIVFQAKCLETGETVAIKKVLQDKRYKNRELQTIRLLDHPNVVSLRHCFFSTTEKDELYLNLVLEYVPETVYRVLRHYSKANQRMPMIYVKLYTYQIFRALAYIHGIGVCHRDIKPQNLLVNPHTHQLKLCDFGSAKVLVKGEPNISYICSRYYRAPELIFGATEYTFAIDIWSVGCVLAELLLGQPLFPGESGVDQLVEIIKVLGTPTREEIKCMNPNYTEFKFPQIKAHPWHKIFHKRMPPEAVDLVSRLLQYSPNLRSTALEACTHSFFDELRDPKTRLPNGRPLPPLFNFRPQELKGASAELLNKLIPEHAKKQCTSLGF

SEQ ID NO: 1375 - DNA, 1956 bp, Arabidopsis thaliana
  AT5G06740.1
atgagattttctcttgcgtggaagctcctgttcttgatactaacttgtaagatcgagacacaagtgaagtgcttaaagttcgatttccctgggtttaatgtgagcaatgaactggaattgatccgagataactcatacattgtctttggagcaatccaagtgactcctgatgttactggtggacctggtggcactatcgcaaaccaagcaggcagagcactctacaaaaagcctttcaggctatggagcaaacacaagagtgctactttcaacaccactttcgttattaacatctctaacaaaaccgatcccggaggcgaaggcttagctttcgttctcacacccgaggagactgctcctcagaacagctcaggtatgtggctcggtatggtcaacgaaagaacaaataggaataatgagtcgaggatcgtttcggttgagttcgacacaaggaagagtcattcggatgatcttgatggaaaccatgtggctctaaatgtgaacaacatcaattcggttgttcaagaatccttgagcggtcgagggatcaagatcgattccggacttgacttaaccgcacatgtgcggtatgatggtaagaatctatcggtttatgtctcaagaaacttggatgtgtttgaacagaggaacttagtgttttctagggctatagatctctcagcctatcttccggagacagtttatgttggatttacagcttcaacaagcaatttcacggagctgaattgtgtgagatcatggagttttgaaggtttaaagatcgatggcgatggaaacatgttatggctctggatcactatccctatagtgtttattgttggtataggagctttcttaggagcattgtacttgagatctaggtcaaaggcaggggaaacaaatccggatatagaagctgagctagataattgcgctgcaaatccgcagaagttcaagctgagagagctaaagagagcaacaggaaacttcggcgcggagaataaactagggcaaggcgggtttgggatggtgtttaaagggaaatggcagggtagagacatagctgtgaaacgagtttccgagaaatcgcatcaagggaagcaagagtttatagccgagatcacaactattggtaatctgaatcataggaacctggtgaagttattgggatggtgctacgagaggaaggagtatcttctggtttatgagtatatgcctaacggaagcttggacaaatatcttttcttggaagacaagtcaagatcaaacctaacatgggagacaaggaagaacattataacagggctatctcaagctttggagtatcttcacaatggatgtgagaagaggatacttcacagagacataaaagcaagcaacgtaatgctggactccgacttcaacgcaaagctcggcgacttcgggcttgcgaggatgattcagcaaagcgaaatgacacatcattcgaccaaggagatcgctggaacaccgggatacatggctcctgagacttttctcaacgggagagccacagttgaaacagatgtgtatgcgttcggagttctaatgcttgaagtagtctcggggaagaaaccaagctatgtcttggtcaaagacaaccagaacaattacaacaatagcattgtgaattggctatgggagctatacagaaatggaaccatcacggatgctgccgatccgggaatgggaaatttgttcgataaagaagaaatgaaaagcgttttgctcttaggactagcttgctgccacccgaatccgaaccaaagaccgtccatgaaaacagtgttgaaggtcttgacgggtgagactagcccaccggatgttcctacagagagaccagctttcgtgtggccagcgatgcctccatctttcagtgacattgactactctcttacagggagtcagatcaattcacttacggagcttactggcaga

SEQ ID NO: 1376 - protein, 652 aa, Arabidopsis thaliana
  AT5G06740.1
MRFSLAWKLLFLILTCKIETQVKCLKFDFPGFNVSNELELIRDNSYIVFGAIQVTPDVTGGPGGTIANQAGRALYKKPFRLWSKHKSATFNTTFVINISNKTDPGGEGLAFVLTPEETAPQNSSGMWLGMVNERTNRNNESRIVSVEFDTRKSHSDDLDGNHVALNVNNINSVVQESLSGRGIKIDSGLDLTAHVRYDGKNLSVYVSRNLDVFEQRNLVFSRAIDLSAYLPETVYVGFTASTSNFTELNCVRSWSFEGLKIDGDGNMLWLWITIPIVFIVGIGAFLGALYLRSRSKAGETNPDIEAELDNCAANPQKFKLRELKRATGNFGAENKLGQGGFGMVFKGKWQGRDIAVKRVSEKSHQGKQEFIAEITTIGNLNHRNLVKLLGWCYERKEYLLVYEYMPNGSLDKYLFLEDKSRSNLTWETRKNIITGLSQALEYLHNGCEKRILHRDIKASNVMLDSDFNAKLGDFGLARMIQQSEMTHHSTKEIAGTPGYMAPETFLNGRATVETDVYAFGVLMLEVVSGKKPSYVLVKDNQNNYNNSIVNWLWELYRNGTITDAADPGMGNLFDKEEMKSVLLLGLACCHPNPNQRPSMKTVLKVLTGETSPPDVPTERPAFVWPAMPPSFSDIDYSLTGSQINSLTELTGR

SEQ ID NO: 1377 - DNA, 2022 bp, Brachypodium distachyon
  Bradi1g53947.1
atggcaatgtccaatagcattctcttgagccttttcttcatatcttctgcagcccttgccgacgtccaaggctgcagttgcttgcgattcacttaccccagcttcgacatcactaacaaggatgatttcagcttcagcccaggatcagcaattgcaaatggttccctgcaaatcacgtcgaacaccggaaacttgagcaatcaatcaggaagagtagtatatgcaagggaaaccctgaagctgtggaacaggaaagacgcagcgctcacatctttcaggacagaatttgtgctcaacatcctcccacagaatggggctggagaaggtatggctttcatactcacaaataattcatcattgcccagcgacagcagcggccagtggcttggcgtatgcaacaaccagacagatggtgcaccgacgaaccgaatagtagcagtggaattcgacacgtgcaaaagctctaaggatgaccttgacagcaaccatgttgggctcgacttgaacagcatcaaatctgataagcagtacccgctcagcaatctttccatcatcctgtcgagcggttctgatgtcttcgtcagtatcaaatataatagcacgagacatgtttttctagtatctataatccagtacaacacaactggcaatggggggcacacttggcgagaaacttggcttgttgatctatcacagcacctgcgggatgaaatatatctgggatttgcaggttccactggtgactacaccgaactgaaccagataaagtcctggaacttcacgacaatagacgatgatgctgtggttgaaacaaggcatgtgaggaaggtgtttttgtctctcgttaccttgattttgtttcctatatgttggtttcttgtgttgttgatgcggagaagggtgaagcagcagacaaggctagcctactgcaacctagagaaaatgatagatgcacatggtccaatcagatttaagatcaaggagctgaagcatgcaactgccaacttcagtcctcaccgtaagctcggtagaggaggaggaggcactgtttaccttggctatcttaataggctcaacatggaggtggctgtgaagcgggtgtcagcgaacaacagctcgagccgaggagagaaagagttcgtcgcggaggtgaacacaataggcaagctctcccatcgcaacctcgtcaagttggttggcttgtgccacgaaggaggcgagctactcctcgtgtacgactactttcccatgggcagcctggacaagcacttgttcagccatgccacagtgtgtacgtcgtcatccgacacgagcactcctgagctcacatgggagcggcgatacaggataatctgtggtgtggcatctgcgcttgactacctgcaccatgggagcagcaaaaggattcttcacagggatgtcaaggccagtaatgtgatgctcgacgaggaatacaatgcacggctgggcgacttcggccttgcccgcgttatccagatcgacggagtgacacatcactccacgcaagcagttgcaggcactcgcggctatatggcgcatgagagcttcttcaccggtcatgccagccttgacacagacgtttacgccttcggggtctttgtcatggaagttatcagtgggaagagcccaagcaggtccatgctatatgacagagaggaattgtacattgtggattggacttggaggcattacagcgaggggaaagtcttagagacggctgatgcagtgctaggagtagtatacaatgaggcacagatggattgcacagtgaggctggccttggcttgttgccatccgaacccacgggaaaggccatcgatgaggacagcagtgcaggtgctaattggtgggatgccagcccctgatcccccatttgagaagcccacatttgtttggcctctatctggcaagcagcaggagatcgagctgcggcatgttggtgtgctcttcacaggacagctcagtttctgctccaagacctccacctccctaacaggaagg

SEQ ID NO: 1378 - protein, 674 aa, Brachypodium distachyon
  Bradi1g53947.1
MAMSNSILLSLFFISSAALADVQGCSCLRFTYPSFDITNKDDFSFSPGSAIANGSLQITSNTGNLSNQSGRVVYARETLKLWNRKDAALTSFRTEFVLNILPQNGAGEGMAFILTNNSSLPSDSSGQWLGVCNNQTDGAPTNRIVAVEFDTCKSSKDDLDSNHVGLDLNSIKSDKQYPLSNLSIILSSGSDVFVSIKYNSTRHVFLVSIIQYNTTGNGGHTWRETWLVDLSQHLRDEIYLGFAGSTGDYTELNQIKSWNFTTIDDDAVVETRHVRKVFLSLVTLILFPICWFLVLLMRRRVKQQTRLAYCNLEKMIDAHGPIRFKIKELKHATANFSPHRKLGRGGGGTVYLGYLNRLNMEVAVKRVSANNSSSRGEKEFVAEVNTIGKLSHRNLVKLVGLCHEGGELLLVYDYFPMGSLDKHLFSHATVCTSSSDTSTPELTWERRYRIICGVASALDYLHHGSSKRILHRDVKASNVMLDEEYNARLGDFGLARVIQIDGVTHHSTQAVAGTRGYMAHESFFTGHASLDTDVYAFGVFVMEVISGKSPSRSMLYDREELYIVDWTWRHYSEGKVLETADAVLGVVYNEAQMDCTVRLALACCHPNPRERPSMRTAVQVLIGGMPAPDPPFEKPTFVWPLSGKQQEIELRHVGVLFTGQLSFCSKTSTSLTGR

SEQ ID NO: 1379 - DNA, 2112 bp, Brachypodium distachyon
  Bradi5g19480.1
atgaccgccgtccacaacaacatcatcaggtgttcaacattcctcgtcgtcctatgcacagcctgcagctccttgcagttcacatacccgagcttcgacgacacaaccaacgagtccgatttcagcttcaccccgggcaccgcaatctcgaacggctccctgcacatcacgcccaacaccgggaacctccgccaccggtcggggagagtggtgtacgcgcgggaaaccctcaagctgtggaacagcaaccgcacggcgctgacttcgttcaggacagagttcacgctcaacatcctcccgctggaacggaacgggacaggggaaggcatggccttcttcctcaccaacaacccgtcgctgccccgcgacagcagcgggcagtggctgggcttgtccaacaagcagacggacggcgccgcggcgaaccggatcgtggccgtcgagttcgacacgcggcggagcgtcgaggccggcgacatcgacggcaaccacttcggagtcgacaacaacggcgtgaagttgatgtggcagtacccgctcagcaacctctccatcgtgctcgccagcggggtcgacgtgtgggtcgggctcacgtacgacggcgccacggtaagcgtccaggcggtgcaggaagggaggacgttcgcgtactcttggctggccgatctgtcgccgtatctcctggacgatgatatattttttgggttttcggcttccaacggcgagtccccgcagttgaatcagatcaggtcctggaatttcagcacatacggcgaagcgattgccggcgccgacgacgatgaggggaggtaccggaggcagagcttgattctcgccgtgtcgattccgcttgccatgtttgcgttgttcgtggcgctgctcgtgtggagaaggctgacgcggcagactaggctcgcgtaccggaacctggagaagatgatcgacgcgcacggtccggtgaggttcaagctgagggagctgaggaaggcgacggcagggttcagcacggcgcgcaagctggggcgaggccggtccggcaccgtgtacctgggatacctgagcaggatgagcatggaggtggccgtgaagcgcgtgtcgacgaacgtcaactccaaccggggcgagaaggagttcgtggcggaggtgaacaccatcagcaagctctcccaccgcaacctcgtgaagctcattgggtggtgccacaacaagggcgagctgctcctcgtctacgagtacttccccatgggcagcctcgacaagctcctctacgccagaccaagcagcagagccgccgccacgccaccgtcgtcgacaacgacgggtcagacgaacacgagcgccagcgatccggagctgacgtgggagcggaggtacaggatcatccggggcgtggcgtcggcgctggactacctgcaccacgggagcagcaagcggatcctgcacagggacgtcaaggccagcaacgtgatgctggacgaggagtacaatgcgcggctgggcgacttcggcctggcgcgcgtcatcagccacgacggcgtcacgcaccactccacgcaggccgtggccggcacgcgcggatacatggcgtacgagagcttcttcaccggacgcgccagcctcgacaccgacgtgttcgccttcggggtcttcgtcatggaggtggtcagcgggaagagcccctgcagctccgtgttgtgccacagcgacgacagccgaggcgagtcaagagcgggatctcattctcgccctgcgcccatgtacattgtggactggacgtggaggctctacggcgaggggaaggcgctgcatgttgccgacgaggtgctcggcggaatgtacgacgaggcgcaggtggaccgcgcggtgaggctggccttggcgtgctgccacccgaacccgagggagaggccgtccatgaggacggccgtgcaggtgctcatcgacggagcacccgcgccggagcccccgtttgataagcctgcgtttgtttggcctccgggagggaatcagcaggagatggagttgccggacgttgggttgctcttcacgggaggggcagggcagcacaggcacagcagctttggttccataagctgttccatctcagggagg

SEQ ID NO: 1380 - protein, 704 aa, Brachypodium distachyon
  Bradi5g19480.1
MTAVHNNIIRCSTFLVVLCTACSSLQFTYPSFDDTTNESDFSFTPGTAISNGSLHITPNTGNLRHRSGRVVYARETLKLWNSNRTALTSFRTEFTLNILPLERNGTGEGMAFFLTNNPSLPRDSSGQWLGLSNKQTDGAAANRIVAVEFDTRRSVEAGDIDGNHFGVDNNGVKLMWQYPLSNLSIVLASGVDVWVGLTYDGATVSVQAVQEGRTFAYSWLADLSPYLLDDDIFFGFSASNGESPQLNQIRSWNFSTYGEAIAGADDDEGRYRRQSLILAVSIPLAMFALFVALLVWRRLTRQTRLAYRNLEKMIDAHGPVRFKLRELRKATAGFSTARKLGRGRSGTVYLGYLSRMSMEVAVKRVSTNVNSNRGEKEFVAEVNTISKLSHRNLVKLIGWCHNKGELLLVYEYFPMGSLDKLLYARPSSRAAATPPSSTTTGQTNTSASDPELTWERRYRIIRGVASALDYLHHGSSKRILHRDVKASNVMLDEEYNARLGDFGLARVISHDGVTHHSTQAVAGTRGYMAYESFFTGRASLDTDVFAFGVFVMEVVSGKSPCSSVLCHSDDSRGESRAGSHSRPAPMYIVDWTWRLYGEGKALHVADEVLGGMYDEAQVDRAVRLALACCHPNPRERPSMRTAVQVLIDGAPAPEPPFDKPAFVWPPGGNQQEMELPDVGLLFTGGAGQHRHSSFGSISCSISGR

SEQ ID NO: 1381 - DNA, 2073 bp, Zea mays
  GRMZM2G146866_T01
atggcgtccccgtcccatactggcatcaggcggcgcttcgctctgctagcttctgcaacgcttgccatcctggtcctctgcggcacctgcagctgcctgcagttcagctaccccaccttcggcgccgccaatgaggccgatttcagcttcacccccggcgccggcatcgaagatggagccctgcagatcacgccgagcaccggagacctgcgccaccggtcggggcgagtctgctacgcgcgggaaaccctcaagctgtggaaccgcaggcggacggcgctgacgtcgttcaggacggagttcgtgctcaacatcgtcccgcggaacgggaccggagaaggtatggcattcatcctcacaaacaacccggagttgccccgcaacagcagcgggcagtggctgggactagtgaacggccagacggacgggtcgccggcgaaccggatcgtggccgtggagttcgacacgaggaagagtggcaagcacgaccacgacgacaaccatgtcggcctcgacgtcaacggcatcgagtctgccagtgcgtatcctgtcggcaatctctccatcgtgctgtcgagcggggctgatgtttgggtcaccatacagtacgacggtgcgacgctgagcatagtcgcggtacagacgtacagcttcatgtacgcctgggccggtgacctgtcgcagtatctcacggacgacatcaccgtcggctttgcagcttcaaccggcgacttcaccgagctgaatcagatcaagtcttggaatttcacaacactaggcgacgatgcagacggcagatggcgacacaggaagaagatgagattgcttctcgcctacctgatcccgttcgccatagccggatcgttcctggcgttctgcgtgtggagaaggctgacgcgtccgagaaggctagcctaccgcaacctcgagaagatgatcgacgcgcaaggcccggtcaaatttaagttcagggagctaagaaatgctacggccaacttcagctctgaccgtaagctcggcagaggcggcttcggcaccgtgtaccttggctacctgaagaggatgggcgtgaacgtggccgtgaagcgggtgatgacgagtggcaactccaatcgcggggagcaggagttcgtggcggaggtgaactcgatcagcaagctgtcgcaccgtaacctcgtgaagctcatgggatggtgccacgaaagaggcgagctgctgcttgtctacgagtacttccccatgggcagcctggacaggcacctgtacgccgatgccggagcaataagtaatgcgccggcgtcggcgtcggaggcgacgcctgagctgacatgggagcggcggtacaggatcgtctgcggtgtggcgtcggcgctggactacctgcaccacgggagcagcaagcggatcctccaccgggacgtgaaggccagcaacgtgatggtggacggcgagtacgaggcgcggctgggcgacttcggcctggcccgcgtcatacagcgtgacggcgcgacgcaccactcgacgcaggcggtggcgggcacccgcgggtacatggcgtacgaaagcttcttcaccggccgcgccagcctcgacacggacgtgttcgcgttcggggtgttcgtcctggaggtggtcagcgggaggcgaccgagcagccccgtgcagtgctcgtaccacgacaacgaggcgagcttcgagcgaggccggcaccggcagccgcccatgtacattgtggactgggcgtggcggctctacggcgaagggagggcgcaggacgccgccgacgcggcgctggtcggcgagtttgacccggcggaggtggaccgcgcggtgaggctggcactggcgtgctgccacccgaacccgagggagaggccgtccatgcggacgtcggtgcaggtgctggttggtggagccgaggcgccggaacccccgctcctgaagcctgcgttcgtttggcctcctttcggcgagcggcaggagatcgatctggcgcatgtcggggttctcttcaccggaggcggagggcactgcagtttctgttccctgtcctccacctccttcacgggaagg

SEQ ID NO: 1382 - protein, 691 aa, Zea mays
  GRMZM2G146866_T01
MASPSHTGIRRRFALLASATLAILVLCGTCSCLQFSYPTFGAANEADFSFTPGAGIEDGALQITPSTGDLRHRSGRVCYARETLKLWNRRRTALTSFRTEFVLNIVPRNGTGEGMAFILTNNPELPRNSSGQWLGLVNGQTDGSPANRIVAVEFDTRKSGKHDHDDNHVGLDVNGIESASAYPVGNLSIVLSSGADVWVTIQYDGATLSIVAVQTYSFMYAWAGDLSQYLTDDITVGFAASTGDFTELNQIKSWNFTTLGDDADGRWRHRKKMRLLLAYLIPFAIAGSFLAFCVWRRLTRPRRLAYRNLEKMIDAQGPVKFKFRELRNATANFSSDRKLGRGGFGTVYLGYLKRMGVNVAVKRVMTSGNSNRGEQEFVAEVNSISKLSHRNLVKLMGWCHERGELLLVYEYFPMGSLDRHLYADAGAISNAPASASEATPELTWERRYRIVCGVASALDYLHHGSSKRILHRDVKASNVMVDGEYEARLGDFGLARVIQRDGATHHSTQAVAGTRGYMAYESFFTGRASLDTDVFAFGVFVLEVVSGRRPSSPVQCSYHDNEASFERGRHRQPPMYIVDWAWRLYGEGRAQDAADAALVGEFDPAEVDRAVRLALACCHPNPRERPSMRTSVQVLVGGAEAPEPPLLKPAFVWPPFGERQEIDLAHVGVLFTGGGGHCSFCSLSSTSFTGR

SEQ ID NO: 1383 - DNA, 2106 bp, Setaria italica
  Si009506m
atggcatccctgtcgtcccgtaccggcaccaggcggcgcttcgctctcctcgcttccacaactcttgccttcctgatcctatgcagcacctgcagctgcttgcagttcagttaccccaccttcgacgccgccaacgaggccgatttcagcttcagccccggctcagggatcgcgaacggagccctgcagatcacgccgaccaccggagaaatcagccaccggtcggggagagtctgctacgcgagggagaccctcaagctgtggaacagcgagcgtacggcgctcacgtccttcaggacggagttcgtgctcaacatcctcccccggaacggcaccggagaaggtatggccttcatcctcacgaacaacccggagttgcccaccaacagcagcgggcggtggctcggcatagtgaacagccagacggacggctcgccggcgaaccggatcgtcgccgtggagttcgacacgaggaagagcggcggcgacgacctcgaccacaaccacgtcggcctcgacgtcaacagcgtcagatccgtcagcacgtaccctctcaccaatctctccatcgcgctgtccagcggttccgacgtgtcggtcagcatagagtacgacggcgccgtgctgagcatagtcgccgtgcaggcgtacaccttcatgtattcttgggccggcgatctgtcgcggtacctgacggatgacatcaccgtgggtttcgcagcgtccaccggcaagttcaccgagctgaatcagatcaagtcgtggaatttcaccacgctaggcgatgatgccggcggtcggcgtggacgacgagaggcaaggaagaagctgatattgcttctcgcctacctgatcccgctcgccatagccggatctttcctggcgttctgcgtgtggagaaggctgacgcggccgggaaggttggcctaccgtaacctcgagaagatgatcgacgcgcgcggcccggtcaggtttgggttcagggagctgaagaacgcgaccgccaacttcagctccgaccgcaagctcggcagaggcggcttcggaaccgtgtacctcggctacctggagaggacgggcatggaggtggccgtgaagcgggtgatggcgagcggcggctccagcagaggggagcaggagttcgtggcggaggtgaactcgatcagcaagctctcgcaccgcaacctcgtgaggctcatcgggtggtgccacgagcggggcgagctgctgctcgtctacgagtacttccccatgggcagcctggacaagctcctgtacgccgacgacgcgagaggaagtggctcgccggcgccggggctgacgtgggagcggcggtacgggatcatctgcggcgtggcggcggcgctggagtacctgcaccacgggagcagcaggcggatcctgcaccgggacgtgaagaccagcaatgtgatgctggacggcgggtacggcgcgcggctgggcgacttcggcctcgcccgcgtcgtccagagcgaaggggcaacgcaccactcgacgcgggcggtggcgggtacccgcgggtacatggcgcccgagagcttcttcacggggcgcgccggcctcggcacggacgcgtacgcgttcggggtcttcgtcttggaggtggtcagcgggaggcggccgagcagccccgtaccgcagcaccactcgtacctcgacgacaacgacgacctcggcggcggcggtcttgacgacgccgtgccgagcggcgccaggggagggcggcagcaggacgcgtacatcgtggactgggcgtggaggctctacggcgagggaagggcgtggcgcaccgccgacgcggcgctgggcggcgcgtccgacccggagggggtggagcgcgccgtgaggctggccctggcgtgctgccacccggacccgagggagaggccgtccatgcgggcggcggtgcaggtgctggccggcggggtcgaggcgccggagcccccgctcgtgaagcccgcgttcgtgtggccgccggacggcggcaggcagcaggagatggagatggcgcgcgtcggggtgctcttcacgggggcacactccagtttctgcaccatgacctccagctccattatctctggaaga

SEQ ID NO: 1384 - protein, 702 aa, Setaria italica
  Si009506m
MASLSSRTGTRRRFALLASTTLAFLILCSTCSCLQFSYPTFDAANEADFSFSPGSGIANGALQITPTTGEISHRSGRVCYARETLKLWNSERTALTSFRTEFVLNILPRNGTGEGMAFILTNNPELPTNSSGRWLGIVNSQTDGSPANRIVAVEFDTRKSGGDDLDHNHVGLDVNSVRSVSTYPLTNLSIALSSGSDVSVSIEYDGAVLSIVAVQAYTFMYSWAGDLSRYLTDDITVGFAASTGKFTELNQIKSWNFTTLGDDAGGRRGRREARKKLILLLAYLIPLAIAGSFLAFCVWRRLTRPGRLAYRNLEKMIDARGPVRFGFRELKNATANFSSDRKLGRGGFGTVYLGYLERTGMEVAVKRVMASGGSSRGEQEFVAEVNSISKLSHRNLVRLIGWCHERGELLLVYEYFPMGSLDKLLYADDARGSGSPAPGLTWERRYGIICGVAAALEYLHHGSSRRILHRDVKTSNVMLDGGYGARLGDFGLARVVQSEGATHHSTRAVAGTRGYMAPESFFTGRAGLGTDAYAFGVFVLEVVSGRRPSSPVPQHHSYLDDNDDLGGGGLDDAVPSGARGGRQQDAYIVDWAWRLYGEGRAWRTADAALGGASDPEGVERAVRLALACCHPDPRERPSMRAAVQVLAGGVEAPEPPLVKPAFVWPPDGGRQQEMEMARVGVLFTGAHSSFCTMTSSSIISGR

SEQ ID NO: 1385 - DNA, 1380 bp, Glycine max
  Glyma02g29020.1
atgactggtttcgaagaatctatggagacccttttggtatctccacctcttaatctatcttcctatctccatgaagtggtttaccttggtttctcagcctcaacaagtaactacacggagctgaactgtgtgagatcatgggaattcagtggtgttgacattgcagatgatgataataaaagtctcttgtgggtttacatcactgttccaatagtgatagttattgttatcataggagggatggtgatctttttattgtgttggcaaaggaagcgccatatggagaggccagaagatgcatatccaaggatagaggatcagattcagtattcctctatggctccaaagaagtttaagctaagggaaataacaaaagcaaccggtggattcagccctcaaaacaagcttggagagggtgggtttggaactgtgtataagggcctattggaaaacaaggaggtggctgtgaagagagtctccaagaactcacgccaagggaagcaagaatttgtggcagaagtgacaacaattggaagccttcaccacaggaatttggtgaaactcactggctggtgctatgagaaaagagagcttctccttgtgtatgagttcatgccaaagggaagcctagacaagtacctctttggtgacaaaaattttggtaataacacccttgaagaggggtattctttaacactgaattgggaaacaaggcacagtgtgattcatggtgtggctcaagcattagactatctccacaatgggtgtgaaaagagggtgcttcatagagacatcaaggccagcaacataatgttggactcagattacaatgccaagttgggagactttggcttggccagaaccattcagcagagaaatgaaacacaccactctacaaaggagattgcaggcacaccagggtacatggctccagagacctttctcacaggaagagcaacagtggaaacagatgtgtatgcatttggggttcttgttttggaggttgtgtgtggaaggaggccagggagtgtgtacgcacaagatgactacaagaacagcattgtgtattgggtgtgggacttatatgggaaggggaaagtagttggtgctgtggatgcaaagttgaagaaggaggagattaaggaggaagaagtggagtgtgttcttgttctgggcttggcatgttgccatccaaacccacaccatagaccatccatgagaactgttcttcaggttctgaatggggaagcaaccccacctgaggtgcctaaggaaagaccagttttcatgtggcctgctatgcctccatctttcaaagaagctgaagattcttccctcgtccagggaacactcgccccgttcactgaaatcactggcaga

SEQ ID NO: 1386 - protein, 460 aa, Glycine max
  Glyma02g29020.1
MTGFEESMETLLVSPPLNLSSYLHEVVYLGFSASTSNYTELNCVRSWEFSGVDIADDDNKSLLWVYITVPIVIVIVIIGGMVIFLLCWQRKRHMERPEDAYPRIEDQIQYSSMAPKKFKLREITKATGGFSPQNKLGEGGFGTVYKGLLENKEVAVKRVSKNSRQGKQEFVAEVTTIGSLHHRNLVKLTGWCYEKRELLLVYEFMPKGSLDKYLFGDKNFGNNTLEEGYSLTLNWETRHSVIHGVAQALDYLHNGCEKRVLHRDIKASNIMLDSDYNAKLGDFGLARTIQQRNETHHSTKEIAGTPGYMAPETFLTGRATVETDVYAFGVLVLEVVCGRRPGSVYAQDDYKNSIVYWVWDLYGKGKVVGAVDAKLKKEEIKEEEVECVLVLGLACCHPNPHHRPSMRTVLQVLNGEATPPEVPKERPVFMWPAMPPSFKEAEDSSLVQGTLAPFTEITGR

SEQ ID NO: 1387 - DNA, 1410 bp, Glycine max
  Glyma09g16930.1
atgaatgacatgataacggtttttggttcgatgactggttttgaagaatctatgaagacccttttggtatctccacctcttaatctatctaactatcttcaagaagtggtttaccttggtttctcagcttcaacaagtaactacacggagctgaactgtgtaagatcatgggaattcagtggtgttgatattgcagatgatgataataaaagtctcttgtgggtttatattactgttccattagtgattgttattatcatcataggagggttggcgatctttttcttgtattggcaaaggaagcgccatatggagatgccagaagatgcatatccaaggatagaggatcaaattcaatattcctctatggctccaaagaagtttaagctaatggaaataacaaaagcaacaggtggattcagccctcaaaacaagcttggagaaggtggatttggaactgtgtacaaggggctattggacaataaggaggtagctgtgaagagagtctctaagaactcacgccaagggaagcaagaatttgtggcagaagtgacaacaattggaagccttcaccataggaatttggtgaaactcacaggttggtgctatgagaaaagagagcttctccttgtgtatgagttcatgcctaagggaagcctagacaagtacctctttggtgacaaaacttttggtaacaacacccttgaagaggggtgttcttcaacactgacttgggaaacaaggcacagtgtgattcatggcgtggctcaagcattagactatctccacaatgggtgtgagaagagggttcttcacagagacatcaaggccagcaacataatgttggactcagactacaatgccaagttgggagactttggattggcaagaaccattcagcagagaaatgaaacacaccactctacaaaggagattgcagggacaccagggtacatggctccagagacctttctcacaagtagagcaacagtggagacagatgtgtatgcatttggggttcttgtgttagaggttgtgtgtggaaggaagccagggagtgtgtatgcacaagatgactacaaaaacagcattgtgtattgggtttgggacttatatgggaagggggaagtagttggtgttgtggatgcaaggctgaagaaggaggagattaaagaggaagaagtggagtgtgttgttgttcttggcttggcttgttgccatccaaacccacaccataggccatccatgagaactgttcttcaggttctgaatggggaagcacccccacctgaggtgcctaaggaaagaccagtttttatgtggcctgctatgcctccatccttcaaagaagctgaagataactccctcatccagggtacactcactccattcactgaaatcactggcaga

SEQ ID NO: 1388 - protein, 470 aa, Glycine max
  Glyma09g16930.1
MNDMITVFGSMTGFEESMKTLLVSPPLNLSNYLQEVVYLGFSASTSNYTELNCVRSWEFSGVDIADDDNKSLLWVYITVPLVIVIIIIGGLAIFFLYWQRKRHMEMPEDAYPRIEDQIQYSSMAPKKFKLMEITKATGGFSPQNKLGEGGFGTVYKGLLDNKEVAVKRVSKNSRQGKQEFVAEVTTIGSLHHRNLVKLTGWCYEKRELLLVYEFMPKGSLDKYLFGDKTFGNNTLEEGCSSTLTWETRHSVIHGVAQALDYLHNGCEKRVLHRDIKASNIMLDSDYNAKLGDFGLARTIQQRNETHHSTKEIAGTPGYMAPETFLTSRATVETDVYAFGVLVLEVVCGRKPGSVYAQDDYKNSIVYWVWDLYGKGEVVGVVDARLKKEEIKEEEVECVVVLGLACCHPNPHHRPSMRTVLQVLNGEAPPPEVPKERPVFMWPAMPPSFKEAEDNSLIQGTLTPFTEITGR

SEQ ID NO: 1389 - DNA, 1932 bp, Citrus clementina
  clementine0.9_036085m
atgtgcttcgctctgatagctaagttcttgatacttgcaatcttaatggggagtgctgctcatatccaagtaagcagccttcatttcaatttccaaagcttcactgaacaaaatcgaaatgagctttccttccacgattcaacgttggccaaatccgccatccaagttacgtatgatgttcgaggagctccgattacaaatcaatccggacgggccatctacaaagatcaattccagctgtggagagataataaaaatgtcaaagcaactttcagcaccacctttgttcttaacatccttaaccagacagctcagcccggcgaaggcctcgcttttgtaatagccgggaacaaagatcttccggagaacagcgaggggcaatggcttggaattgtaaacggtatcacgaatgggactaatcaatctcagatagtcgcgatagagtttgatacaaagaagagctacgagcaagacattaatgataatcatgttggcttggacgtgaatagcgtctactcgatcagacaagtgcccctaacaagagtaaatcttgcaaatggcactgatatcacagtacaagttcgatatgacggccaaaatattactgtttttgtagcaaacatggagactccattgctttccgagcctattgatctttccgagtaccttccggaggaagtcttcgtaggattttcggcttcaacaggggatgatacacagctgaactgtgtgaaatcatgggcatttgatggttcagatattggcggagattcgaaggcctttcgggttttgattgctgttctagttccagctgtggttttactagccggtgttgctttttactgctggaggagatacatagctagggaacttgatgatgacatcgaaggcctaatcaatggcaccaatctggctccgaagaaattccggttgaaagagcttaagaaggcgacgggcaattttaacccgaagaacaagctcgggaaagggggatttgggacggtttataaaggaatctggaggaacaaagagatagctgtaaaaagagtttcagagacttcgcgccaaggtaagcaagagttcattgcagaagttaccacaatcgggagccttcgtcacaggaatcttgtgaagttgatcggatggtgctatgaaaggcatgattttcttcttgtgtatgagtacatgcctaacggtagcctggacaagttcatattctacgatgagaagaacagtggccccggggaagtgacactgaactgggaaaagaggctgagcgtaatacatgggacatctcaggcgctggattatctgcataacgggagcgaaaagagagttcttcatcgggacataaaatcgagcaatatcatgctggattcggagttcaatgcaaggttgggagattttggattggcgagaaccatccaagaaaatttgaagactcatcactctacgaaagagatagctggaactcctggttacatggctccggagagctttctggtgggcagggccaccattgaaactgatatttacgcgttcggagttctgatcctggaagttgcttgtgggaggaagcctggaaatcaaagtgagcagaacagttataacaatagcattgtgcactggctgtgggaacttcgtaggaagggaagaattcttgatgcggctgattcaagattgggaggagagttttcagagaaagaaatggagtgtgttctcattctgggtttggcatgttgccacccgaacccgcacctgaggccatcgatgaagacggttttgcaggttctttccggggaggcagatccgccggtgctgccacctgaaagaccctctttcgtgtggccggccatacctccatctttcgttgagtcggattacactcatacaggaagccaacttgatccattttcagatctcacagggcga

SEQ ID NO: 1390 - protein, 644 aa, Citrus clementina
  clementine0.9_036085m
MCFALIAKFLILAILMGSAAHIQVSSLHFNFQSFTEQNRNELSFHDSTLAKSAIQVTYDVRGAPITNQSGRAIYKDQFQLWRDNKNVKATFSTTFVLNILNQTAQPGEGLAFVIAGNKDLPENSEGQWLGIVNGITNGTNQSQIVAIEFDTKKSYEQDINDNHVGLDVNSVYSIRQVPLTRVNLANGTDITVQVRYDGQNITVFVANMETPLLSEPIDLSEYLPEEVFVGFSASTGDDTQLNCVKSWAFDGSDIGGDSKAFRVLIAVLVPAVVLLAGVAFYCWRRYIARELDDDIEGLINGTNLAPKKFRLKELKKATGNFNPKNKLGKGGFGTVYKGIWRNKEIAVKRVSETSRQGKQEFIAEVTTIGSLRHRNLVKLIGWCYERHDFLLVYEYMPNGSLDKFIFYDEKNSGPGEVTLNWEKRLSVIHGTSQALDYLHNGSEKRVLHRDIKSSNIMLDSEFNARLGDFGLARTIQENLKTHHSTKEIAGTPGYMAPESFLVGRATIETDIYAFGVLILEVACGRKPGNQSEQNSYNNSIVHWLWELRRKGRILDAADSRLGGEFSEKEMECVLILGLACCHPNPHLRPSMKTVLQVLSGEADPPVLPPERPSFVWPAIPPSFVESDYTHTGSQLDPFSDLTGR

SEQ ID NO: 1391 - DNA, 1941 bp, Populus trichocarpa
  POPTR_0006s20740.1
atgcgctttcccctggcagccacttctgcaatcctggctgtcttcttggctcttgctcaagaacagagccttgcttttgagtttccaaacttcacgattcaagatcagcctcaacttattttgagtgacaattcttctatagccctcggcgccatccaagtcacagcagatactcgtggagctagcatagaaaacagggctggaaggaccctgtacggaaggccattcaggctgtggagcaagaaggggaagaaagcaaatttcaatacgaccttcgtactcaatgtcaaaagcatgacagcttcaagtggtgaaggcttggcctttatattaacaggagatcctgacgttccaggtggaagcgatggacaatggcttgggattgtaaattccaggttaaatggaaccactgaagcgaagacagtggcgatagaatttgacactaaaaaaagcttcccagaagatcttgacgataaccatattggattggatataaacagtgtctactcgaaaagatcggtttcgttaaatgatagaggtatttatatttctgcgggcacggatatcaaggtagttgttcaatatgacggcaagaatttgattgtttttgtcggtgacgacatgaagaatccagttctctctgagcctctcgatctctcagcctatcttccagaaatggtgtatgtgggattttcgggttcaacaagtaataacactcaattaaattgtgttaggtcgtgggagtttaaccattctgaggtaaaagattccaagttgcggtgggtttggattttggttgctgtaggatcagtgctaatcctgttgattggtattggtatcgcctttttcttgtacaggaaaaggggatatgaaggaaatagggtggagaatacttgtccaaatattgaagaggcaatcctaggcttctcaactgctccgaagaagttcaaattcaaagaacttagcaaagcaacaggcaaattcaaccctaaaaacaagctcgggaaaggtggcttcgggacagtctacaagggaatcttgggaaaaaaggaagttgctgtcaaaagagtctcaaagaaatcaacccaaggaaagcaagagttcattgcagaagtcactacaataggccacatccatcaccgaaatcttgttaagctgatcgggtggtgccacgaaaagcgcgagtacctcttggtttacgagtacttgcctaatggtagcctggataaatatatattttgggatgaaaagtcaggcacgcaggaagaaacactgagctggggaagaaggctgagtgtgatttcaggagtggcgcaggcattggattatctgcataatggatgtatgaacagggtacttcaccgagacataaaggccagtaacgtaatgttggatttagatttcaatgcaaaactcggagatttcggcttggctcgcaccattattcataatgaacaaactcaccactcaacaaaagagcttgcaggaacacctggctacatggctccggagagtattcttacaggaagggcaacggccgaaacagatgtttatgcttttggtgttcttgttctggaagttgcttgtggaaggaagcctggagggcaggctgagcgggatgactacatttgtaacattgtgcatgggctatgggaactttacaggaggggaacaatcctcgaaggtgcagaccccagattgaatggaatattcataaaggaagagatggagtgtgtgcttattctggggttggcctgctgccatccaaacccaaaaaataggccctccatgaaaactgttttgcaggttcttacaggggaagcgccaccaccagaagtgccagctgaaagacctgcttttataaattcatcgttctgtacggggaataaagattcaaaatccctctctacggataatacaattatctatcatggaaaacaa

SEQ ID NO: 1392 - protein, 647 aa, Populus trichocarpa
  POPTR_0006s20740.1
MRFPLAATSAILAVFLALAQEQSLAFEFPNFTIQDQPQLILSDNSSIALGAIQVTADTRGASIENRAGRTLYGRPFRLWSKKGKKANFNTTFVLNVKSMTASSGEGLAFILTGDPDVPGGSDGQWLGIVNSRLNGTTEAKTVAIEFDTKKSFPEDLDDNHIGLDINSVYSKRSVSLNDRGIYISAGTDIKVVVQYDGKNLIVFVGDDMKNPVLSEPLDLSAYLPEMVYVGFSGSTSNNTQLNCVRSWEFNHSEVKDSKLRWVWILVAVGSVLILLIGIGIAFFLYRKRGYEGNRVENTCPNIEEAILGFSTAPKKFKFKELSKATGKFNPKNKLGKGGFGTVYKGILGKKEVAVKRVSKKSTQGKQEFIAEVTTIGHIHHRNLVKLIGWCHEKREYLLVYEYLPNGSLDKYIFWDEKSGTQEETLSWGRRLSVISGVAQALDYLHNGCMNRVLHRDIKASNVMLDLDFNAKLGDFGLARTIIHNEQTHHSTKELAGTPGYMAPESILTGRATAETDVYAFGVLVLEVACGRKPGGQAERDDYICNIVHGLWELYRRGTILEGADPRLNGIFIKEEMECVLILGLACCHPNPKNRPSMKTVLQVLTGEAPPPEVPAERPAFINSSFCTGNKDSKSLSTDNTIIYHGKQ

SEQ ID NO: 1393 - DNA, 1833 bp, Populus trichocarpa
  POPTR_0016s04410.1
atgacaacagggcagagccttgattttcagtttccaaacttcacggaatcagatagagatcaacttattttgactcccgatatttcttatatagcccataccgccatccaagtcacaccagattctaatggattttctatggttaacagggctggaagggtcttgtacagatggccattcagactatggagcaacggagggaagaatgcatctttcaatacaaccttcgtactcaatatcaaaagacagacagcttcaagtggtgaaggcttagcttttatattaacagcagatcgtgatgttccagatggaagtaaaggacaatggcttggaatagtaaattccacgttaaatggatccaaggaagccaggacagtggcagtagaatttgacaccggacaaagtttcccggatgatcttgatgataaccatattggattggatgtgaacagtgtctactcaagaacatcggtttcgttaaatgacagaggcatttatctttctaagggcaaagatgtcacggtagatgttcgatacgacggcaagaatttgactgtttttgtggataaggacatgaagaatccagttatttctgagcatctcaatctctcagactatcttccagaaaacgtttatgtggggttttcgggttcaacaagtaacaacactcaactaaattgtgtgaggtcatgggagttcatcggttcggagataaaagactccaagttgcggtgggtttggattttagttgcggtaggatcagtactaatcctgttgattagtattggtatcgcccttttcttgtacaggaaaagaggatgtcaagtggacaggctggaggatgcttatccaaatattgatgaggcaatcctaggctcctcaactgctccgaggaaatacaaattcaaagaacttagcaaagcaactggtaatttcaaccccaagaacaagctcgggaaaggtggcttcgggacagtctacaagggaatcttgggaaacaaggaagtcgctgtcaaaagaatctcaaagaaatcaacccaaggtaaacaagaattcatagcagaagtcactacaataggcaacctccatcaccgaaatcttgttaggttgatcggatggtgtcatgaaaggcgtgagtacctcttggtttacgagtacttgcctaatggaagcctggataaatatgtattttgtgatgaaaagccaggcacgcaggaagcaaccctgagctgggaaaaaaggctgagcgtgatttccggagtggcacaggcattggattatctgcataatggctgcatgaagagggtacttcaccgagacataaaggccagtaacataatgttggatttagatttcaaagcgcaactgggagattttggcttagctcgcaccattattcgaaatgaacaaactcaccacacaacgaaagagcttgctggaacacctggctacatggctccggagagtattcttacgggaagggcaacgaccgaaacagatgtttatgcttttggcgttcttgttctggaagttgcttgtggaaggaagcctggagggcagactgagcgggatgactacattagtaacattgtgcatgggctatgggaactttacagaaggggaacgatcctcgaaggtgcagaccccagattggatggaatattcaaaaatgaagaaatggagtgcgtgcttattctggggttggcctgctgccatccaaatccaaacgataggccctccatgaaaactgttttgcaggtccttacaggggaagcgccaccaccagacgtgcctgctgaaaggcctgtttttatgctaagggcacatgaaagt

SEQ ID NO: 1394 - protein, 611 aa, Populus trichocarpa
  POPTR_0016s04410.1
MTTGQSLDFQFPNFTESDRDQLILTPDISYIAHTAIQVTPDSNGFSMVNRAGRVLYRWPFRLWSNGGKNASFNTTFVLNIKRQTASSGEGLAFILTADRDVPDGSKGQWLGIVNSTLNGSKEARTVAVEFDTGQSFPDDLDDNHIGLDVNSVYSRTSVSLNDRGIYLSKGKDVTVDVRYDGKNLTVFVDKDMKNPVISEHLNLSDYLPENVYVGFSGSTSNNTQLNCVRSWEFIGSEIKDSKLRWVWILVAVGSVLILLISIGIALFLYRKRGCQVDRLEDAYPNIDEAILGSSTAPRKYKFKELSKATGNFNPKNKLGKGGFGTVYKGILGNKEVAVKRISKKSTQGKQEFIAEVTTIGNLHHRNLVRLIGWCHERREYLLVYEYLPNGSLDKYVFCDEKPGTQEATLSWEKRLSVISGVAQALDYLHNGCMKRVLHRDIKASNIMLDLDFKAQLGDFGLARTIIRNEQTHHTTKELAGTPGYMAPESILTGRATTETDVYAFGVLVLEVACGRKPGGQTERDDYISNIVHGLWELYRRGTILEGADPRLDGIFKNEEMECVLILGLACCHPNPNDRPSMKTVLQVLTGEAPPPDVPAERPVFMLRAHES

SEQ ID NO: 1395 - DNA, 1524 bp, Glycine max
  Glyma02g29060.1
catgtctacaaattcaaccatacactaagggaccattcaagtccccatagaagcatcagggtcagagacctcaaacctttctatcaaagaggcatgaaagcctcattcaattcaacttttgttttcaatattcatccaataacctctcctagtggtgagggatttgctttcatactagcatctaacacttctcttccaagcagcagtgcaggccaatggcttggtaatgtcaactcaacaagcatacgggtaagcaacatagttgtagtggagtttgatacaaggaaaaactatgatgaagacattgatgacaaccatgcggggttggatgtaaagagcatctattccatccagcaacaacctcttggaccacatagtgttaatctttctagtggcattgatgttgttgctactgtttactttgatgctaaagatgggaaaatgagcatttttgtttctacatcagatttgaggttgaaaaaaccattgcttgtagtggatcttgatctctctaaactgcttccaaaagatgtttttgtgggattttcagcttccacaggggtatatacccagtattttgagaagaatccaataaatttattgtggttatggatcctgattccaacaattgtggttggaggagcatttgctggtgcgtactattggagaaaaaaacacaaaaaggaacaaggggtggaggaagatctcaacatagagcttgaaattaaaagctcatataatgctcctcataagtttcggctgaaggaacttgtatctgccacaaggaatttccactcatcaaacaaactagggaaagaaggattttgcatggtttacaaaagcacattgaatggtaaagatgttgctgcgaagaggattttgaggaactcacgtcatagtaagcaagattttatggtagaaatcacaaccatatggaatctcaatcacaaaaatctagtgaagttaataaggtggtgctatgaaaagggtgagatcatccttgtgtatgagttaatgcaaaatggtagcttgtacaaattcattttttcaacatttggaggggattcaattttgagttgggaaatgaggctcaatgttatatgtggagtttctacaggactggattatcttcacaatggatgtgacaaaagagtgctacatagagacataaaaccaagcaatgtgatgctggattcggacttcaatgctcagcttggagactttggcttggctcgcacagttcatctcagcaaaaaaactcaccactcaacaagagaaattgttggaacaccagggtacatggcgctggaaagcttctacacccgaagggctttggttgaaaccgatgtctatgcatttggtgttctgatgttggaagttgtgtgcagcggcagaagaaagcctgaatacaaactggacctaagatgttgcaacgacattgtggactgggtttgggagcatcatttcaaggaaaacataactggtgtcgtggatttgagactaaatggtgattttgatgaggct

SEQ ID NO: 1396 - protein, 508 aa, Glycine max
  Glyma02g29060.1
HVYKFNHTLRDHSSPHRSIRVRDLKPFYQRGMKASFNSTFVFNIHPITSPSGEGFAFILASNTSLPSSSAGQWLGNVNSTSIRVSNIVVVEFDTRKNYDEDIDDNHAGLDVKSIYSIQQQPLGPHSVNLSSGIDVVATVYFDAKDGKMSIFVSTSDLRLKKPLLVVDLDLSKLLPKDVFVGFSASTGVYTQYFEKNPINLLWLWILIPTIVVGGAFAGAYYWRKKHKKEQGVEEDLNIELEIKSSYNAPHKFRLKELVSATRNFHSSNKLGKEGFCMVYKSTLNGKDVAAKRILRNSRHSKQDFMVEITTIWNLNHKNLVKLIRWCYEKGEIILVYELMQNGSLYKFIFSTFGGDSILSWEMRLNVICGVSTGLDYLHNGCDKRVLHRDIKPSNVMLDSDFNAQLGDFGLARTVHLSKKTHHSTREIVGTPGYMALESFYTRRALVETDVYAFGVLMLEVVCSGRRKPEYKLDLRCCNDIVDWVWEHHFKENITGVVDLRLNGDFDEA

SEQ ID NO: 1397 - DNA, 2652 bp, Vitis vinifera
  GSVIVT01033490001
atggacgtcaaggtgagaattcggtatgatggggaggttttgagggtttttgtgggggaagacacgagctcaccagcaatttctgactctcttaatttctccatctatctgcgtcacaaagtttatgtgggattctcagcttcaacgggaaattattcccaactaaactatgtaaggtcatgggaattcagtgtattagatttagatgatcatcagatgccgcaatggatctggatcatagttgctgcagtaatagctttgtttattggatttgccttttccttgtattggaaatggaaatattatgtcaggaagggagatgatccgggatttgagctacagattcaaggcttatccacggctccaagaaaattcagattgaaagaactggagtctgccacagagaacttcaattctgataacttgctcggcagaggtggatttgggactgtctataaaggagcactggactaccttcataatggatgtgagaagagggtgcttcaccgagacataaaggcaagtaatgtaatgctggactcagaattcaacgcccgattgggggattttggactggctcgaaccatcaatccgatggattgggtatgggaaaattacaggggagggagcattctggatgtggtagatttgcaattgaatgggattttcagcaaggagcaagctgaatacagtatgttaagccatgattttctgcggtttaatgcagtagcactagcaactgtcttggttggcgctgttactcaagctgaatgcttcaatttcagttatccaattttcaaaccacaaaaaggagatgatttgacgttcttcggagattcatatatggcttctgacaccatccagctaacacaaaatgttttaaataatggaggatgtggccgggtcttttatacaaggcctttgaagttgtggagcacaggcagaggcacattaccttttaattccacctttgtgatcaatatcactcccctcacatatccagggggtgaaggcctggcttttatcttaaccgggcatgcggatattccagccaacagcgtaggaaaatggcttgggattataagcgagaatacaatggggtcaagtacaaggggagctgtggcagtagaatttgacaccaggaacagctacccagaggacttggatgataaccacgtcggcctggatctgaatagcatctactcaagaaaacaagagagtttaagtgtcaatctttcaagtggtattgatataaaggtgaaggttcaatatgatgggcaaggcttgagcatttttgttggggaaaacaggagcgttcctgtaattttcgagtcacttaatctctacgactatctacctcagaaggtttatgtaggattctcagcttcaactggagtttatgcacagatcaattatgtgaagtcatgggaattcagtgggttggaactatatgatgatgcccctaacctgctatgggtctggatcacggttcctggggcaataggtttggttattggattttctgccttcctgtactggaaatggcaacgcaaaaccaaggatcatgtggaggaggaggatgatccagggtggtttgagctgcagattcaaggctcatccacggctccaagaaaattcaaattgaaagaactggaagctgccacagaaaacttcaattctgataacttgcttggcagaggtggatttgggaccgtctataaaggagtcttgagggtgcttcaccgagacataaaggcaagcaatgtaatgctggactcagacattctggatgtggtagatttgcaattgaatggggttttcagcaaggagcaagctgaatgtgtattggttttggcactggctagttgtcatccaaatccattccagaggccatccatgagaactgccttgagggttcttgccggagaggttgctccaccagttatccccatggacagacctgcttttgtcacagagactaacccaatcgcactggattgggaaaaaaggcatagcatcatccgtggagtggctcaggcgctggactaccttcacaatggatgccaggatagggtgcttcaccgggacatcaaaacaagcaacatcatgctagattctgagttcaacgcgcggttgggggactttggactggccagaaccatccatcccaatgaccaaactcaccattccacccaagttcttgcaggaacacatggctatatggctccagaaagcttccacaacagcagagcaaccgttgaaacagacgtgtatgcttttggggttcttctattggaagttgtctgtgcaagaaagcctggaactcagagcatggagaacgattataacaacagtatagtggactgggtgtgggcgcatcacaggagggacaggctttttgaagtcgtagatttccgattgaacggggatttcaacagggagcaagttgaatgtgtgttgatgttggcattggcctgctgccatccgaatccatacgagaggccatccatgagaactgctttgagggttctcacaggggaggttgatccaccacttatcccctttgacaagcctgttttcatgtggccagccacagctcctccatctttcaatgaggatttggagtactgctctttcatgtttttcattagt

SEQ ID NO: 1398 - protein, 884 aa, Vitis vinifera
  GSVIVT01033490001
MDVKVRIRYDGEVLRVFVGEDTSSPAISDSLNFSIYLRHKVYVGFSASTGNYSQLNYVRSWEFSVLDLDDHQMPQWIWIIVAAVIALFIGFAFSLYWKWKYYVRKGDDPGFELQIQGLSTAPRKFRLKELESATENFNSDNLLGRGGFGTVYKGALDYLHNGCEKRVLHRDIKASNVMLDSEFNARLGDFGLARTINPMDWVWENYRGGSILDVVDLQLNGIFSKEQAEYSMLSHDFLRFNAVALATVLVGAVTQAECFNFSYPIFKPQKGDDLTFFGDSYMASDTIQLTQNVLNNGGCGRVFYTRPLKLWSTGRGTLPFNSTFVINITPLTYPGGEGLAFILTGHADIPANSVGKWLGIISENTMGSSTRGAVAVEFDTRNSYPEDLDDNHVGLDLNSIYSRKQESLSVNLSSGIDIKVKVQYDGQGLSIFVGENRSVPVIFESLNLYDYLPQKVYVGFSASTGVYAQINYVKSWEFSGLELYDDAPNLLWVWITVPGAIGLVIGFSAFLYWKWQRKTKDHVEEEDDPGWFELQIQGSSTAPRKFKLKELEAATENFNSDNLLGRGGFGTVYKGVLRVLHRDIKASNVMLDSDILDVVDLQLNGVFSKEQAECVLVLALASCHPNPFQRPSMRTALRVLAGEVAPPVIPMDRPAFVTETNPIALDWEKRHSIIRGVAQALDYLHNGCQDRVLHRDIKTSNIMLDSEFNARLGDFGLARTIHPNDQTHHSTQVLAGTHGYMAPESFHNSRATVETDVYAFGVLLLEVVCARKPGTQSMENDYNNSIVDWVWAHHRRDRLFEVVDFRLNGDFNREQVECVLMLALACCHPNPYERPSMRTALRVLTGEVDPPLIPFDKPVFMWPATAPPSFNEDLEYCSFMFFIS

SEQ ID NO: 1399 - DNA, 2010 bp, Solanum lycopersicum
  Solyc10g080510.1.1
atgtattatctaggcaagattagttatttaactaactttgttcatcttttgatcatattcatatttttggttcttagagtggattgtctgagtttcaattaccaaaatttcaccaagcaaaacgaaaatgatttcataactactgagcattcctacatagaatttggagctatccaagtaactggcgatgctcgtggtacttccatcagtaatttgtctggaaggatatggtattcacagcctatgaatctatggaacagaaggaaaaacagaacagcctcgtttaattcaacgtttgtgatcaatatcaaacctgagagtgatccatggggtgaaggattggctttcatattgactaaagaaagtggttatgagtcaatcccagatgaaagttatggacaatggcttgggattgtgaatgaaactactaatggatcttctttaaacaacatatttgctgttgaattcgatacaaggaaaagttaccttgatgatcttgatgataatcatgttggcattgacataaacagcatcaactctgtcaatcaggtctcgttgatggatcgtggtgttaacctttcacgagctgttgatgttatagcaagtgtccagtatgatggagaatccaacatcttgaaggtctatacattcatgagtaatgaaactggagtcaatgaaagaaatcccatcatttccatgccacttgatctttctagctatctccccgaggatgttttcgtgggattttcagcttcaactgggatatataatcagcttaactgcataaaggcatggaattttacaagcacagatattgggaacagtaatgaagttagcttgttatggttgtggatcttgataccagtaatatcggttctggttgtgttccttggtggggttttcgtatatttcagctggtggagaaaaaagaagaggacgcaagtgttagatcagtcggagaatatagagattcagattcagaattcagctactgcacctcagagattccagctgaaggacttgaaacgagcaacggggaactttgatccgaagaacattcttggaagaggaggatgtggagtagtcctcaaagggatgttagatcaaaaagaggtggctgtgaagagattctttaatgattcaagtcaaggggcaaaagatctcatagcagaagtcacaactataggcaatctccatcataaaaaccttgtcaaattgataggatggtgctatgagagcaatgaactccttgtggtctatgagttcatgccaaatgggagcttagaaaagttgatattttgcgaagaaaacggaaaaggtttgagtctgaattgggaaataaggtatggtgtcatctgtgggattgctcaagcacttgattatctgcacaatggatgtcaaaaaagagtacttcacagagacatcaaagccagcaacatcatgcttgactcagaactcaatgctcgtctaggagatttcggattagctaggacagttcaagtgaatggaaagactcaccattcaacaaaagagattgctggtactataggctatatggcacctgagagtttccatataggtcgagccacagttgaaacagacgtctttgcatttggagtgctagttcttgaagttgcttgtggtcgaaaacctggaaatagacgatatgaggagaataattataccaacagagtcattgaatatgtatgggacttgtacaagattggaaggatcattgatgccatagatgtcagattggatagagatttcaatgaagaacaagccgaatgtgtgttaatattaggtttggcttgttgccatccaaatccttacgaaaggccaagcatgaaaactgctttacagattcttacaggggaattagttctaccagacatcccaactgagaaacctgcatttgtatggccagccaaagctccatcgtccaacgaagcttctagtgattctctccaggaaggccaacttacaccgattacagtactcagtggcaga

SEQ ID NO: 1400 - protein, 670 aa, Solanum lycopersicum
  Solyc10g080510.1.1
MYYLGKISYLTNFVHLLIIFIFLVLRVDCLSFNYQNFTKQNENDFITTEHSYIEFGAIQVTGDARGTSISNLSGRIWYSQPMNLWNRRKNRTASFNSTFVINIKPESDPWGEGLAFILTKESGYESIPDESYGQWLGIVNETTNGSSLNNIFAVEFDTRKSYLDDLDDNHVGIDINSINSVNQVSLMDRGVNLSRAVDVIASVQYDGESNILKVYTFMSNETGVNERNPIISMPLDLSSYLPEDVFVGFSASTGIYNQLNCIKAWNFTSTDIGNSNEVSLLWLWILIPVISVLVVFLGGVFVYFSWWRKKKRTQVLDQSENIEIQIQNSATAPQRFQLKDLKRATGNFDPKNILGRGGCGVVLKGMLDQKEVAVKRFFNDSSQGAKDLIAEVTTIGNLHHKNLVKLIGWCYESNELLVVYEFMPNGSLEKLIFCEENGKGLSLNWEIRYGVICGIAQALDYLHNGCQKRVLHRDIKASNIMLDSELNARLGDFGLARTVQVNGKTHHSTKEIAGTIGYMAPESFHIGRATVETDVFAFGVLVLEVACGRKPGNRRYEENNYTNRVIEYVWDLYKIGRIIDAIDVRLDRDFNEEQAECVLILGLACCHPNPYERPSMKTALQILTGELVLPDIPTEKPAFVWPAKAPSSNEASSDSLQEGQLTPITVLSGR

SEQ ID NO: 1401 - DNA, 2628 bp, Arabidopsis thaliana; identical to SEQ ID NO: 607
  AT2G19190.1

SEQ ID NO: 1402 - protein, 876 aa, Arabidopsis thaliana; identical to SEQ ID NO: 608
  AT2G19190.1

SEQ ID NO: 1403 - DNA, 2556 bp, Arabidopsis thaliana; identical to SEQ ID NO: 605
  AT1G05700.1

SEQ ID NO: 1404 - protein, 852 aa, Arabidopsis thaliana; identical to SEQ ID NO: 606
  AT1G05700.1

SEQ ID NO: 1405 - DNA, 2628 bp, Arabidopsis thaliana; identical to SEQ ID NO: 609
  AT4G29990.1

SEQ ID NO: 1406 - protein, 876 aa, Arabidopsis thaliana; identical to SEQ ID NO: 610
  AT4G29990.1

SEQ ID NO: 1407 - DNA, 2643 bp, Arabidopsis thaliana; identical to SEQ ID NO: 611
  AT2G19210.1

SEQ ID NO: 1408 - protein, 881 aa, Arabidopsis thaliana; identical to SEQ ID NO: 612
  AT2G19210.1

SEQ ID NO: 1409 - DNA, 3075 bp, Arabidopsis thaliana; identical to SEQ ID NO: 613
  AT2G19230.1

SEQ ID NO: 1410 - protein, 1025 aa, Arabidopsis thaliana; identical to SEQ ID NO: 614
  AT2G19230.1

SEQ ID NO: 1411 - DNA, 2592 bp, Arabidopsis thaliana; identical to SEQ ID NO: 541
  AT1G07550.1

SEQ ID NO: 1412 - protein, 864 aa, Arabidopsis thaliana; identical to SEQ ID NO: 542
  AT1G07550.1

SEQ ID NO: 1413 - DNA, 2658 bp, Arabidopsis thaliana; identical to SEQ ID NO: 543
  AT2G14440.1

SEQ ID NO: 1414 - protein, 886 aa, Arabidopsis thaliana; identical to SEQ ID NO: 544
  AT2G14440.1

SEQ ID NO: 1415 - DNA, 2604 bp, Arabidopsis thaliana; identical to SEQ ID NO: 545
  AT2G14510.1

SEQ ID NO: 1416 - protein, 868 aa, Arabidopsis thaliana; identical to SEQ ID NO: 546
  AT2G14510.1

SEQ ID NO: 1417 - DNA, 2613 bp, Arabidopsis thaliana; identical to SEQ ID NO: 547
  AT1G07560.1

SEQ ID NO: 1418 - protein, 871 aa, Arabidopsis thaliana; identical to SEQ ID NO: 548
  AT1G07560.1

SEQ ID NO: 1419 - DNA, 2598 bp, Arabidopsis thaliana; identical to SEQ ID NO: 555
  AT5G16900.1

SEQ ID NO: 1420 - protein, 866 aa, Arabidopsis thaliana; identical to SEQ ID NO: 556
  AT5G16900.1

SEQ ID NO: 1421 - DNA, 2640 bp, Arabidopsis thaliana; identical to SEQ ID NO: 549
  AT2G28960.1

SEQ ID NO: 1422 - protein, 880 aa, Arabidopsis thaliana; identical to SEQ ID NO: 550
  AT2G28960.1

SEQ ID NO: 1423 - DNA, 2616 bp, Arabidopsis thaliana; identical to SEQ ID NO: 551
  AT2G29000.1

SEQ ID NO: 1424 - protein, 872 aa, Arabidopsis thaliana; identical to SEQ ID NO: 552
  AT2G29000.1

SEQ ID NO: 1425 - DNA, 2694 bp, Arabidopsis thaliana; identical to SEQ ID NO: 553
  AT4G20450.1

SEQ ID NO: 1426 - protein, 898 aa, Arabidopsis thaliana; identical to SEQ ID NO: 554
  AT4G20450.1

SEQ ID NO: 1427 - DNA, 2358 bp, Arabidopsis thaliana; identical to SEQ ID NO: 557
  AT2G28970.1

SEQ ID NO: 1428 - protein, 786 aa, Arabidopsis thaliana; identical to SEQ ID NO: 558
  AT2G28970.1

SEQ ID NO: 1429 - DNA, 2652 bp, Arabidopsis thaliana; identical to SEQ ID NO: 559
  AT2G28990.1

SEQ ID NO: 1430 - protein, 884 aa, Arabidopsis thaliana; identical to SEQ ID NO: 560
  AT2G28990.1

SEQ ID NO: 1431 - DNA, 2634 bp, Arabidopsis thaliana; identical to SEQ ID NO: 561
  AT3G46330.1

SEQ ID NO: 1432 - protein, 878 aa, Arabidopsis thaliana; identical to SEQ ID NO: 562
  AT3G46330.1

SEQ ID NO: 1433 - DNA, 2667 bp, Arabidopsis thaliana; identical to SEQ ID NO: 563
  AT3G46340.1

SEQ ID NO: 1434 - protein, 889 aa, Arabidopsis thaliana; identical to SEQ ID NO: 564
  AT3G46340.1

SEQ ID NO: 1435 - DNA, 2613 bp, Arabidopsis thaliana; identical to SEQ ID NO: 565
  AT3G46350.1

SEQ ID NO: 1436 - protein, 871 aa, Arabidopsis thaliana; identical to SEQ ID NO: 566
  AT3G46350.1

SEQ ID NO: 1437 - DNA, 2379 bp, Arabidopsis thaliana; identical to SEQ ID NO: 567
  AT3G46370.1

SEQ ID NO: 1438 - protein, 793 aa, Arabidopsis thaliana; identical to SEQ ID NO: 568
  AT3G46370.1

SEQ ID NO: 1439 - DNA, 2649 bp, Arabidopsis thaliana; identical to SEQ ID NO: 569
  AT3G46400.1

SEQ ID NO: 1440 - protein, 883 aa, Arabidopsis thaliana; identical to SEQ ID NO: 570
  AT3G46400.1

SEQ ID NO: 1441 - DNA, 2514 bp, Arabidopsis thaliana; identical to SEQ ID NO: 571
  AT3G46420.1

SEQ ID NO: 1442 - protein, 838 aa, Arabidopsis thaliana; identical to SEQ ID NO: 572
  AT3G46420.1

SEQ ID NO: 1443 - DNA, 2676 bp, Arabidopsis thaliana; identical to SEQ ID NO: 573
  AT5G59650.1

SEQ ID NO: 1444 - protein, 892 aa, Arabidopsis thaliana; identical to SEQ ID NO: 574
  AT5G59650.1

SEQ ID NO: 1445 - DNA, 2604 bp, Arabidopsis thaliana; identical to SEQ ID NO: 575
  AT5G59670.1

SEQ ID NO: 1446 - protein, 868 aa, Arabidopsis thaliana; identical to SEQ ID NO: 576
  AT5G59670.1

SEQ ID NO: 1447 - DNA, 2661 bp, Arabidopsis thaliana; identical to SEQ ID NO: 577
  AT5G59680.1

SEQ ID NO: 1448 - protein, 887 aa, Arabidopsis thaliana; identical to SEQ ID NO: 578
  AT5G59680.1

SEQ ID NO: 1449 - DNA, 2664 bp, Arabidopsis thaliana; identical to SEQ ID NO: 579
  AT1G49100.1

SEQ ID NO: 1450 - protein, 888 aa, Arabidopsis thaliana; identical to SEQ ID NO: 580
  AT1G49100.1

SEQ ID NO: 1451 - DNA, 2652 bp, Arabidopsis thaliana; identical to SEQ ID NO: 581
  AT1G51805.1

SEQ ID NO: 1452 - protein, 884 aa, Arabidopsis thaliana; identical to SEQ ID NO: 582
  AT1G51805.1

SEQ ID NO: 1453 - DNA, 2655 bp, Arabidopsis thaliana; identical to SEQ ID NO: 583
  AT1G51820.1

SEQ ID NO: 1454 - protein, 885 aa, Arabidopsis thaliana; identical to SEQ ID NO: 584
  AT1G51820.1

SEQ ID NO: 1455 - DNA, 2595 bp, Arabidopsis thaliana; identical to SEQ ID NO: 585
  AT1G51850.1

SEQ ID NO: 1456 - protein, 865 aa, Arabidopsis thaliana; identical to SEQ ID NO: 586
  AT1G51850.1

SEQ ID NO: 1457 - DNA, 2079 bp, Arabidopsis thaliana; identical to SEQ ID NO: 587
  AT1G51830.1

SEQ ID NO: 1458 - protein, 693 aa, Arabidopsis thaliana; identical to SEQ ID NO: 588
  AT1G51830.1

SEQ ID NO: 1459 - DNA, 2232 bp, Arabidopsis thaliana; identical to SEQ ID NO: 589
  AT1G51810.1

SEQ ID NO: 1460 - protein, 744 aa, Arabidopsis thaliana; identical to SEQ ID NO: 590
  AT1G51810.1

SEQ ID NO: 1461 - DNA, 2553 bp, Arabidopsis thaliana; identical to SEQ ID NO: 591
  AT2G04300.1

SEQ ID NO: 1462 - protein, 851 aa, Arabidopsis thaliana; identical to SEQ ID NO: 592
  AT2G04300.1

SEQ ID NO: 1463 - DNA, 2697 bp, Arabidopsis thaliana; identical to SEQ ID NO: 593
  AT3G21340.1

SEQ ID NO: 1464 - protein, 899 aa, Arabidopsis thaliana; identical to SEQ ID NO: 594
  AT3G21340.1

SEQ ID NO: 1465 - DNA, 2670 bp, Arabidopsis thaliana; identical to SEQ ID NO: 595
  AT1G51860.1

SEQ ID NO: 1466 - protein, 890 aa, Arabidopsis thaliana; identical to SEQ ID NO: 596
  AT1G51860.1

SEQ ID NO: 1467 - DNA, 2511 bp, Arabidopsis thaliana; identical to SEQ ID NO: 597
  AT1G51870.1

SEQ ID NO: 1468 - protein, 837 aa, Arabidopsis thaliana; identical to SEQ ID NO: 598
  AT1G51870.1

SEQ ID NO: 1469 - DNA, 2640 bp, Arabidopsis thaliana; identical to SEQ ID NO: 599
  AT1G51880.1

SEQ ID NO: 1470 - protein, 880 aa, Arabidopsis thaliana; identical to SEQ ID NO: 600
  AT1G51880.1

SEQ ID NO: 1471 - DNA, 2628 bp, Arabidopsis thaliana; identical to SEQ ID NO: 601
  AT1G51890.1

SEQ ID NO: 1472 - protein, 876 aa, Arabidopsis thaliana; identical to SEQ ID NO: 602
  AT1G51890.1

SEQ ID NO: 1473 - DNA, 2628 bp, Arabidopsis thaliana; identical to SEQ ID NO: 603
  AT1G51910.1

SEQ ID NO: 1474 - protein, 876 aa, Arabidopsis thaliana; identical to SEQ ID NO: 604
  AT1G51910.1

SEQ ID NO: 1475 - DNA, 2682 bp, Arabidopsis thaliana; identical to SEQ ID NO: 539
  AT1G51800.1

SEQ ID NO: 1476 - protein, 894 aa, Arabidopsis thaliana; identical to SEQ ID NO: 540
  AT1G51800.1

SEQ ID NO: 1477 - DNA, 2646 bp, Arabidopsis thaliana; identical to SEQ ID NO: 615
  AT1G51790.1

SEQ ID NO: 1478 - protein, 882 aa, Arabidopsis thaliana; identical to SEQ ID NO: 616
  AT1G51790.1

SEQ ID NO: 1479 - DNA, 2739 bp, Arabidopsis thaliana
  AT4G29180.2
atgggagctcactctgtttttctcatccttttttccgtcattgccattgccattgtagtacatggccaaggccaagcaggtttcatcagcatagattgtgggtcaccccctaatattaactatgtagacactgatactggtatcagttacacctgggatgcacctttcatcaacgctggagtaaatctgaacgtctctgaagaatacggttacccgaaaaacccggttttgcctttcccgcttgctgatgtaagatcttttcctcaaggaaacaggaactgttacaccttaaccccctccgatggaaaagggaatctttatctcatcagagcttcgtttatgtatggaaactacgatggtaaaaatgctttacctgagtttgatctctacgtaaacgtgaatttctggacctcggtgaaactcagaaatgcttctgagaacgtcatcaaggagatcctcagctttgcagagtcagatacaatatatgtttgccttgtgaacaaaggtaaaggaactccttttatttcagcgttggagcttcgaccaatgaacagctccatctatggaactgagtttggaagaaatgtctcattggtactctatcaaagatgggatacaggatatttgaatggaacaggacggtaccaaaaggatacatatgatcgtatttggtctccgtactctccagtgtcttggaatacaactatgactactgggtatatcgatatttttcagtctggttataggccaccagatgaagttattaagacagctgcttcgcctaaaagtgacgatgaaccattggaactgtcttggacatcaagcgatccagatactcggttttatgcgtacctttattttgcagaacttgaaaatctcaagaggaatgagagcagagaaatcaagatattctggaatgggtcgcctgtttcaggagcttttaacccctctcctgagtattcaatgacagtgtctaactcacgagctttcactggtaaagatcactggatttctgttcagaagaccgcagagtcaacgcgtccaccaatactcaatgctattgagattttttcagcacaatctctggatgaattttacaccagaattgacgatgttcaagccatagaaagcataaaatcaacgtataaagtgaataagatttggactggtgatccttgctctcccagactcttcccttgggaaggtattggatgcagctacaacacttctagttatcaaatcaagtccctaaatcttagttcaagtggattacatggaccaatagcgttcgcatttagaaatctctcccttcttgagtcattggatttatcaaacaacaacctcaaaggaattgtgccggaatttttggctgatctaaaatatctgaagtccctgaatttgaaaggaaataacttgactgggtttatcccaagatctcttaggaaaagagcaacggctaatggacttgcactcagtgtcgatgaacaaaacatttgtcactcacgttcatgtcgggacgggaacagaatcatggtgccaatagttgtatccacattagtgattattctcattgccgccttggctatcatatgcatcatgcgaagggaaagcaaaataatgtattcaggagcatattcaggaccacttctgccttcgggaaagagaaggttcacatatagtgaagtctctagtattacaaacaacttcaataaagtgattggtaaaggagggtttggtattgtgtaccttggttcccttgaagatggaactgaaattgctgtaaagatgatcaacgattcttcttttggaaaatctaaaggatcttcatcatcatcatcatcatcccaggtctccaaagaattccaagtcgaggcggagcttcttttgacagtccatcaccggaacttagcttcgtttgttggatactgcgatgatggtcgcagtatggctctcatctacgagtacatggccaatggcaacttgcaagattatctttcaagtgagaatgcagaggatcttagttgggaaaagagactccatatagccatagactctgcacaagggttggagtatcttcatcatggctgcaggccaccaatagtacacagagacgttaaaacagcaaacattcttttaaacgataacttggaagccaagatcgctgatttcgggctttctaaggtcttccctgaggatgatctcagccacgttgtgactgctgtcatgggcactcctggctatgtcgatcctgagtactacaacacgtttaagctaaacgagaagagcgacgtgtacagctttgggatcgtcctccttgaactcataaccggcaagagatccataatgaaaactgacgacggagaaaaaatgaacgttgttcactacgtcgagcctttcctcaaaatgggagacatagatggtgtcgtggatccacggcttcacggcgacttctcctcaaactcggcttggaaatttgtggaagtggcaatgtcttgcgtcagagacagaggaaccaacagaccaaacacaaaccagatcgtgtctgacttgaaacagtgcttagctgccgagctagctcgtgagccaaaaagcaatcatgagaagaaggaagtagtgaaagagaagtacacgaagaccaagtcgacggttcagaattatagcagcaatgaatataatagctcatctggatcggtttcactttcttttggagattactccacgtttggcccaatggcaagg

SEQ ID NO: 1480 - protein, 913 aa, Arabidopsis thaliana
  AT4G29180.2
MGAHSVFLILFSVIAIAIVVHGQGQAGFISIDCGSPPNINYVDTDTGISYTWDAPFINAGVNLNVSEEYGYPKNPVLPFPLADVRSFPQGNRNCYTLTPSDGKGNLYLIRASFMYGNYDGKNALPEFDLYVNVNFWTSVKLRNASENVIKEILSFAESDTIYVCLVNKGKGTPFISALELRPMNSSIYGTEFGRNVSLVLYQRWDTGYLNGTGRYQKDTYDRIWSPYSPVSWNTTMTTGYIDIFQSGYRPPDEVIKTAASPKSDDEPLELSWTSSDPDTRFYAYLYFAELENLKRNESREIKIFWNGSPVSGAFNPSPEYSMTVSNSRAFTGKDHWISVQKTAESTRPPILNAIEIFSAQSLDEFYTRIDDVQAIESIKSTYKVNKIWTGDPCSPRLFPWEGIGCSYNTSSYQIKSLNLSSSGLHGPIAFAFRNLSLLESLDLSNNNLKGIVPEFLADLKYLKSLNLKGNNLTGFIPRSLRKRATANGLALSVDEQNICHSRSCRDGNRIMVPIVVSTLVIILIAALAIICIMRRESKIMYSGAYSGPLLPSGKRRFTYSEVSSITNNFNKVIGKGGFGIVYLGSLEDGTEIAVKMINDSSFGKSKGSSSSSSSSQVSKEFQVEAELLLTVHHRNLASFVGYCDDGRSMALIYEYMANGNLQDYLSSENAEDLSWEKRLHIAIDSAQGLEYLHHGCRPPIVHRDVKTANILLNDNLEAKIADFGLSKVFPEDDLSHVVTAVMGTPGYVDPEYYNTFKLNEKSDVYSFGIVLLELITGKRSIMKTDDGEKMNVVHYVEPFLKMGDIDGVVDPRLHGDFSSNSAWKFVEVAMSCVRDRGTNRPNTNQIVSDLKQCLAAELAREPKSNHEKKEVVKEKYTKTKSTVQNYSSNEYNSSSGSVSLSFGDYSTFGPMAR

SEQ ID NO: 1481 - DNA, 2589 bp, Arabidopsis thaliana
  AT4G29450.1
atgagggctaatctcgttttcggcatattttgtgcccttgttaccaccattttagttcacggccaagaccaatcaggttacatcagcatcgattgtggcatacctccttacgatacccctgaagacactatgactaacattaattacgtctccgatgaagctttcataaccaccggcgtaaacttcaaggtctctgaagaatacggctatccaaaaaacccggtattgctgtcaactcttgctgaagtaagagctttccctcaaggaaacagaaactgttacaccttaaaactttcacaaggaaaagatcatctttatctcattagagcttcctttatgtatggaaactacgatggtaaaaaagctttgcctgagtttgatctctatgtaaacgtgaacttctggtcgacagtgaaattcaaaaatgcttctgatcaagtcaccaaagagattttaagctttgcagagtcggatacaatatatgtttgccttgtgaataaaggcaaaggaactccttttatttcagggttagagctccgaccagtgaacagctcaatctacggtactgaatttggaagaaatgtctctttggttctctatcgaagatgggacattggatatttaaacggaacaggacggtaccaagacgatagattcgatcgtatttggtctccatactcctcaaatatctcctggaactcgattataacatcgggctatatcgatgtttttcagaacggttattgtccacctgatgaagttattaagacagctgctgctcctgaaaacgttgatgatccgttggaattgttctggacatcagacgatccaaatgttcggttctacgcatatctttacttcgcggaactcgaaacactagagaagaatgagactagaaagatcaagattttgtggaatggttcccctgtttctgaaacttctttcgaaccttcttcaaaatattcaacgacgttttctaatccaagagctttcactggtaaagatcactggatttctattcagaagactgtagattcaacgcttccaccgattctcaatgctatagagatttttaccgcacaatctctagatgaattttccaccacaattgaagacattcatgctatagaaagcataaaagcaacttataaagtgaacaaggtttggagtggtgatccttgctccccaagattattcccttgggaaggtgttggatgcagcgacaacaataataatcatcaaatcaagtccctgaatcttagctcaagcggattactaggaccaatagtcttggcatttagaaatctctctcttcttgagtcattggatttatccaacaatgacctgcaacaaaatgtgcctgagtttttggctgatctaaaacatttgaaagtcctgaatttgaaaggaaacaattttactgggtttatcccaaaatcccttatgaaaaagttaaaggccggtttacttacgctcagtgcggatgagcaaaacctttgtaactcatgtcaagaaaagaagaagaagaagagcatggtcgtgccaatagctgtagcagcatcagtgatcgttctcgttgtcgtcttggttatcatatggatcatactaaggcaaagaaaaaaaggagcctattcaggaccactcctgccttcagggaagagaaggttcacatataatgaggtctctagcataacaaacaacttcaataaagtgattggtaaaggagggtttggtattgtgtaccttggttcccttgaagatgggactaaaattgctgtaaagatgataaacgattcttcattggcaaaacctaaaggaacttcatcatcatcattatcccgggcttctaaccaattccaagtcgaggcagagcttcttttgacagtgcatcaccgtaacttagcttcatttgttggatactgcgatgatgatcgtagcatggctctcatctacgagtacatggccaacggcaacttgcaggcttatctttcaagtgagaatgcagaggatcttagttgggaaaagagactccatatagccatagattctgcacaaggtttggagtatttgcacgatggatgcagaccagcaatagtacatagagacgttaaaacagcaaacattctaataaacgataacttggaagccaagattgctgatttcggcctttctaaggtcttccctgaagacgatctcagccacgtcgtgactaccgtcatgggcactcccggctacgttgatcctgaatactacagaacatttgtgctgaacgagaagagcgacgtgtacagttttggggtcgttcttcttgaactcatcactggccagcgagccatcatcaaaacagaagaaggagacaatatcagcgttattcactacgtttggccgttctttgaggctagagaactagacggcgtcgtggacccgctgcttcggggagacttctcgcaggactcagcttggaagtttgtggatgtggcaatgtcttgcgtcagagataaaggatcgaatagaccaacgatgaaccagatcgtagcggagctgaaacagtgcctagctgctgagctggaccgtgagccacagagccag

SEQ ID NO: 1482 - protein, 863 aa, Arabidopsis thaliana
  AT4G29450.1
MRANLVFGIFCALVTTILVHGQDQSGYISIDCGIPPYDTPEDTMTNINYVSDEAFITTGVNFKVSEEYGYPKNPVLLSTLAEVRAFPQGNRNCYTLKLSQGKDHLYLIRASFMYGNYDGKKALPEFDLYVNVNFWSTVKFKNASDQVTKEILSFAESDTIYVCLVNKGKGTPFISGLELRPVNSSIYGTEFGRNVSLVLYRRWDIGYLNGTGRYQDDRFDRIWSPYSSNISWNSIITSGYIDVFQNGYCPPDEVIKTAAAPENVDDPLELFWTSDDPNVRFYAYLYFAELETLEKNETRKIKILWNGSPVSETSFEPSSKYSTTFSNPRAFTGKDHWISIQKTVDSTLPPILNAIEIFTAQSLDEFSTTIEDIHAIESIKATYKVNKVWSGDPCSPRLFPWEGVGCSDNNNNHQIKSLNLSSSGLLGPIVLAFRNLSLLESLDLSNNDLQQNVPEFLADLKHLKVLNLKGNNFTGFIPKSLMKKLKAGLLTLSADEQNLCNSCQEKKKKKSMVVPIAVAASVIVLVVVLVIIWIILRQRKKGAYSGPLLPSGKRRFTYNEVSSITNNFNKVIGKGGFGIVYLGSLEDGTKIAVKMINDSSLAKPKGTSSSSLSRASNQFQVEAELLLTVHHRNLASFVGYCDDDRSMALIYEYMANGNLQAYLSSENAEDLSWEKRLHIAIDSAQGLEYLHDGCRPAIVHRDVKTANILINDNLEAKIADFGLSKVFPEDDLSHVVTTVMGTPGYVDPEYYRTFVLNEKSDVYSFGVVLLELITGQRAIIKTEEGDNISVIHYVWPFFEARELDGVVDPLLRGDFSQDSAWKFVDVAMSCVRDKGSNRPTMNQIVAELKQCLAAELDREPQSQ

SEQ ID NO: 1483 - DNA, 2760 bp, Brachypodium distachyon
  Bradi2g52970.1
atggcgaaaagctccacttgctcgtcaagtgcgaaactgaaatggaccatggcgctgctggtcgtcctggtcagcatgattcgagtccatggccagccagggtttgtaagcatcgattgtggattcgcaaacagtaacgcctacaacgacagctccacagggatacagttcgatcctgatgctggatttgagggcggtttgagccacaaaatttccgcagagttcatggcagattcagatgagcatcagaaaaccctgaggagcttccctgacggctcacggaattgctatactctgccatccaccactggcaagaagtatctcgtgagggccacttttacttatggcaactatgatgggttgaacaagagtcaggacgggtcgctgtttctcttcgggctccacatcggcgtcaatttctgggatgcggtgaacttcacaaattggggtgtcccgatatggaaagaggtgctcaccgttgctccgagcaacaacatctcggtctgtctgataaactttggttcagggactccgttcatatctacattggagctgaggcccctacaagatatgatgtacccttttgtgaatacttcggtgtcaatcagctactttagtcggaaaagatttggcaacgttactggatttatcacaagatatccatccgacccttacgatcggttctgggagagatttctctaccaggaccccccctggatcagcctggacacaagcaatacagtgaggaggctccccggcgacaacgccttccaggtaccagaggacatcatgcggaaggcctcgacactagaagcaaactattccttcatgtatgtcaacgtgggagtgggtcccaatttggacgccaagaacctgcagcttctcccgatcttccactttgcggagatcaacaacagcaacccgaacaggaggttcgacatctacagcaccaacgagttgctgttcgacgacttttccccagcacgatttcaggtggacagtatgcaagagaatgggcggttcttgcacaaccccgaggcatccttcctcctaaacaagacgagaaggtcaaggctaccgccactcatcaatgcgtttgagttgtactcgctcgttcggatggataacttcaccactgactccgacgatgtcaattacatgaaagaagtcaagaagcactacaatttggcacgaataaactggaatggagatccatgctccccaagagagtattcctgggaaggtttgacttgcgactactctaaaagtaaccagaatccgacgattgtcagagtagatctgtctaagagcgggctgcaaggtgcattagccatatcattcctgaacatggtatcactggaaaacttggatttatcacacaacaatctgacgggaactattccagactatccactaaagtcactcaaagttcttgacttgtcaaataatcagctcgatggaccaatccctaattctatccttcagagatctcaggctggtctgcttgacttaagattacagggaaatcctgtatgctcaaaagtcaaagatacgtactgttcaaataagaagaacaccacgcaaaccttgctcatcgcagtgatagttcctgtggtactggtatccttcttagtagtgatgttcatactatggaagttgtgctggaaagggaagtcaggagaccgcgaggattatgctatgtatgaagaggaaactccgctacatattgacattagacggttcacgtatgctgagctgaagctcataacaaacgacttccaaacaatcgttggaaaaggaggttttggtactgtttatcatggcatactggaaactggtgatgaagtagctgttaaggttcttatggagacatcaatagcagagtcaacagacttcctccctgaggtacaaaccttgtccaaagttcatcacaagaatctcgtgactttggtaggatattgccaaaacaagaagtgcctagcactcgtttatgacttcatgcccagaggaaatcttcaacagcttttgaaaggaggagacgactatagcttgaattgggaacagcggcttcatatcgcacttgattctgcacaagggctggagtatctacatgagtcatgcaccccatcaatagttcacagagatgtgaagactgctaacattcttctagacaagaatctggtggggataatatctgattttgggctttcgcgggcttttaacgatgctcatacgcacatatctactgttgctgctggcactcttggctacctcgaccccgagtaccatgcaactttccaactcactgtcaagacagatgtttatagcttcggcattgtgctcttggagatcatcactgcccagtccccggtattgatggaccctcaaacaatccacctaccaaattgggtgcgccaaaagatagctaagggcagtgttcgtgatgttgtggacaagaggctgatggatcagtacgacgtcagttccctggagagtgtggtagaccttgcattgaactgcgtagaaaatgcagctattgacaggccaaccatgaccgaagttgtttcaaggctcaaagtgtggttgccggtttcaagcgaaaagcagtctatttctggaacccctcaccgcaagaactacatggatattgatatcccaagacagttccagttgatgctttctggagaaagccacgaggggagctccttccagtctggtaataccagtaggatgtcagaaatgagccttttttctggacgg

SEQ ID NO: 1484 - protein, 920 aa, Brachypodium distachyon
  Bradi2g52970.1
MAKSSTCSSSAKLKWTMALLVVLVSMIRVHGQPGFVSIDCGFANSNAYNDSSTGIQFDPDAGFEGGLSHKISAEFMADSDEHQKTLRSFPDGSRNCYTLPSTTGKKYLVRATFTYGNYDGLNKSQDGSLFLFGLHIGVNFWDAVNFTNWGVPIWKEVLTVAPSNNISVCLINFGSGTPFISTLELRPLQDMMYPFVNTSVSISYFSRKRFGNVTGFITRYPSDPYDRFWERFLYQDPPWISLDTSNTVRRLPGDNAFQVPEDIMRKASTLEANYSFMYVNVGVGPNLDAKNLQLLPIFHFAEINNSNPNRRFDIYSTNELLFDDFSPARFQVDSMQENGRFLHNPEASFLLNKTRRSRLPPLINAFELYSLVRMDNFTTDSDDVNYMKEVKKHYNLARINWNGDPCSPREYSWEGLTCDYSKSNQNPTIVRVDLSKSGLQGALAISFLNMVSLENLDLSHNNLTGTIPDYPLKSLKVLDLSNNQLDGPIPNSILQRSQAGLLDLRLQGNPVCSKVKDTYCSNKKNTTQTLLIAVIVPVVLVSFLVVMFILWKLCWKGKSGDREDYAMYEEETPLHIDIRRFTYAELKLITNDFQTIVGKGGFGTVYHGILETGDEVAVKVLMETSIAESTDFLPEVQTLSKVHHKNLVTLVGYCQNKKCLALVYDFMPRGNLQQLLKGGDDYSLNWEQRLHIALDSAQGLEYLHESCTPSIVHRDVKTANILLDKNLVGIISDFGLSRAFNDAHTHISTVAAGTLGYLDPEYHATFQLTVKTDVYSFGIVLLEIITAQSPVLMDPQTIHLPNWVRQKIAKGSVRDVVDKRLMDQYDVSSLESVVDLALNCVENAAIDRPTMTEVVSRLKVWLPVSSEKQSISGTPHRKNYMDIDIPRQFQLMLSGESHEGSSFQSGNTSRMSEMSLFSGR

SEQ ID NO: 1485 - DNA, 2811 bp, Oryza sativa; identical to SEQ ID NO: 623
  LOC_Os01g59570.1

SEQ ID NO: 1486 - protein, 937 aa, Oryza sativa; identical to SEQ ID NO: 624
  LOC_Os01g59570.1

SEQ ID NO: 1487 - DNA, 2664 bp, Oryza sativa; identical to SEQ ID NO: 621
  LOC_Os01g59550.1

SEQ ID NO: 1488 - protein, 888 aa, Oryza sativa; identical to SEQ ID NO: 622
  LOC_Os01g59550.1

SEQ ID NO: 1489 - DNA, 2658 bp, Brachypodium distachyon; identical to SEQ ID NO: 625
  Bradi2g19290.1

SEQ ID NO: 1490 - protein, 886 aa, Brachypodium distachyon; identical to SEQ ID NO: 626
  Bradi2g19290.1

SEQ ID NO: 1491 - DNA, 2736 bp, Oryza sativa; identical to SEQ ID NO: 627
  LOC_Os05g44990.1

SEQ ID NO: 1492 - protein, 912 aa, Oryza sativa; identical to SEQ ID NO: 628
  LOC_Os05g44990.1

SEQ ID NO: 1493 - DNA, 2625 bp, Setaria italica; identical to SEQ ID NO: 629
  Si024869m

SEQ ID NO: 1494 - protein, 875 aa, Setaria italica; identical to SEQ ID NO: 630
  Si024869m

SEQ ID NO: 1495 - DNA, 2754 bp, Brachypodium distachyon; identical to SEQ ID NO: 631
  Bradi2g19297.2

SEQ ID NO: 1496 - protein, 918 aa, Brachypodium distachyon; identical to SEQ ID NO: 632
  Bradi2g19297.2

SEQ ID NO: 1497 - DNA, 2931 bp, Brachypodium distachyon; identical to SEQ ID NO: 633
  Bradi2g38910.1

SEQ ID NO: 1498 - protein, 977 aa, Brachypodium distachyon; identical to SEQ ID NO: 634
  Bradi2g38910.1

SEQ ID NO: 1499 - DNA, 2838 bp, Brachypodium distachyon; identical to SEQ ID NO: 635
  Bradi2g38947.1

SEQ ID NO: 1500 - protein, 946 aa, Brachypodium distachyon; identical to SEQ ID NO: 636
  Bradi2g38947.1

SEQ ID NO: 1501 - DNA, 2892 bp, Oryza sativa; identical to SEQ ID NO: 637
  LOC_Os01g03370.1

SEQ ID NO: 1502 - protein, 964 aa, Oryza sativa; identical to SEQ ID NO: 638
  LOC_Os01g03370.1

SEQ ID NO: 1503 - DNA, 2841 bp, Oryza sativa; identical to SEQ ID NO: 639
  LOC_Os05g44930.1

SEQ ID NO: 1504 - protein, 947 aa, Oryza sativa; identical to SEQ ID NO: 640
  LOC_Os05g44930.1

SEQ ID NO: 1505 - DNA, 2895 bp, Oryza sativa; identical to SEQ ID NO: 641
  LOC_Os05g44940.1

SEQ ID NO: 1506 - protein, 965 aa, Oryza sativa; identical to SEQ ID NO: 642
  LOC_Os05g44940.1

SEQ ID NO: 1507 - DNA, 2826 bp, Oryza sativa; identical to SEQ ID NO: 643
  LOC_Os05g44970.1

SEQ ID NO: 1508 - protein, 942 aa, Oryza sativa; identical to SEQ ID NO: 644
  LOC_Os05g44970.1

SEQ ID NO: 1509 - DNA, 2526 bp, Oryza sativa
  LOC_Os09g09220.1
atggccgcgaggtcatgtttacatcttctcatcgtcctcgccgtcgccgtcgccggcggcttgctacaggcagctcgcgggcagcccgacagcaacggtttcataagcatagactgcggcctgtcagggaaggccggctacgtcgacaacgccaccaagttgtcctactcgccggacgccgccttcaccgacgccggcaccaacaacaacatatcggcggagtacttgtcgccggcgaactccaggatcttcgacaacgttcgcagcttccccgccggcgccgcgccgcggagctgctacacgctgcggtcgctggtgccggggctcaagtacctggtccgcgccagcttcatgtatggcaactacgacggcctccgaaggccgccggtgttcgacctctacgccggcgtcaacttctggaggacggtgaacatcacggatgcggcagcctcgatcacggcggaggccatcatcgttgtgccggaggactcgatgcaggtctgtctcctcaacactggcgccgggacgcccttcatctccagccttgacctgaggccgctcaagaactctctctacccgcaagcgaatgccacgcaaggcctggtcatggtcagcagggtaaactttggccccactgatacgttcatcaggtacccagatgatccgcgcgacagaggatggcggccatggatcgacacgatgagatacgtggaggtatcgacgacgaagacagtgcagaacgtggaaaaggacttgttcgaggcgccgtcggcggtgatgcagacggcgatcacgccgcgcaacgcctccgatagcatcgaactctactggaccgccgatccgagcgctgccgccggcgaccctccgccggggtacatcgccattatgcacttctccgagctgcagctcgtccagggcaacgccgttcgcgcgttcaatatcagcctgaatgaccagtggctggacattggcatgacgccggactacctctacgccgatgcctccttcaacaccgtgcccttccggggctcaagccggtacaacctcacgttccgtgccaccgccaactcgacgttgccgcccatcatcaacgccctggagattttctcggtcatccctaccaccaatgtgcccactgacggcaaggatgtttctggtatcacggcgatcaagaagcagtatcaggtgaagcagaactggatgggtgacccatgtgttccaaagacactagcatgggactggttgacctgtagctatgctatttccagccctccaacaatcacaggcgtatatgacaataatccggacctttgcatcaatgacacttgtccctctccaaatgggaagcccaaactagctatctatatctctgtccctgtagttgcagtcacggtgatactagtgttagttttattttgcttgctaagacgaaaaaccaaaggctcagcaaataatactatcaatccacacaatgagccaacaagccattctcacggaagtggcagctatggacatggttcgatgcagtttgaaaaccgtcggttcacatataaggatctacagatgataacaaacaactttgagcaagtgcttggcaaaggagggtttgggtatgtctactatggtattttggaggagggcactcaagtggcagtcaaattgcggtctcaatcgtcaaatcaaggtgtaaaagagttccttacagaggctcagattttgacccggattcatcataagaatcttgtctcgatgattggttattgcaaggatggagagtacatggcacttgtttatgagtacatgtctgaaggaaccctggaagagcatattgcaggaagagatcacaacaagaggaacttaacctggacagagagactccgcattgcgcttgaatctgcacaagggctagagtacctacacaaagggtgcagcccacccgtcgttcacagggatgtcaaggcaacaaacatcttacttaacacgaacttggaggctaagatcgcggattttggcttgtctaaggcattcaaccgtgatagtgacacacatgtatcaacaagtatacttgttggaacacctggatacattgatcctgagtatgtcatatccaaattcttcttcatctgttatattcaaagtcttaccaccaaagagctggtcacggggaagtcacccatccttcgtaccccggagccaatcagccttatccattgggcacaacagcgcatgcaatgtggaaacatcgagggtgtggtggatgcacgcatgcacggtgtctatgatgtcaacagtgtctggaaggttgcagagataggactaatgtgcactgcacaggcatcggcacatcggcctatgatgactgatgtagtggcaaaactgcaagaatgccaagacctcgagcatggtcgcgctggcagtgttgccgagccctcaattgaccatgtcagcaaaactaacaccatatttgaaatagatcgcctggagaggattccactgccaaccatgtctagtggtccatcagcacga

SEQ ID NO: 1510 - protein, 842 aa, Oryza sativa
  LOC_Os09g09220.1
MAARSCLHLLIVLAVAVAGGLLQAARGQPDSNGFISIDCGLSGKAGYVDNATKLSYSPDAAFTDAGTNNNISAEYLSPANSRIFDNVRSFPAGAAPRSCYTLRSLVPGLKYLVRASFMYGNYDGLRRPPVFDLYAGVNFWRTVNITDAAASITAEAIIVVPEDSMQVCLLNTGAGTPFISSLDLRPLKNSLYPQANATQGLVMVSRVNFGPTDTFIRYPDDPRDRGWRPWIDTMRYVEVSTTKTVQNVEKDLFEAPSAVMQTAITPRNASDSIELYWTADPSAAAGDPPPGYIAIMHFSELQLVQGNAVRAFNISLNDQWLDIGMTPDYLYADASFNTVPFRGSSRYNLTFRATANSTLPPIINALEIFSVIPTTNVPTDGKDVSGITAIKKQYQVKQNWMGDPCVPKTLAWDWLTCSYAISSPPTITGVYDNNPDLCINDTCPSPNGKPKLAIYISVPVVAVTVILVLVLFCLLRRKTKGSANNTINPHNEPTSHSHGSGSYGHGSMQFENRRFTYKDLQMITNNFEQVLGKGGFGYVYYGILEEGTQVAVKLRSQSSNQGVKEFLTEAQILTRIHHKNLVSMIGYCKDGEYMALVYEYMSEGTLEEHIAGRDHNKRNLTWTERLRIALESAQGLEYLHKGCSPPVVHRDVKATNILLNTNLEAKIADFGLSKAFNRDSDTHVSTSILVGTPGYIDPEYVISKFFFICYIQSLTTKELVTGKSPILRTPEPISLIHWAQQRMQCGNIEGVVDARMHGVYDVNSVWKVAEIGLMCTAQASAHRPMMTDVVAKLQECQDLEHGRAGSVAEPSIDHVSKTNTIFEIDRLERIPLPTMSSGPSAR

SEQ ID NO: 1511 - DNA, 2079 bp, Zea mays; identical to SEQ ID NO: 645
  GRMZM2G701201_T01

SEQ ID NO: 1512 - protein, 693 aa, Zea mays; identical to SEQ ID NO: 646
  GRMZM2G701201_T01

SEQ ID NO: 1513 - DNA, 2805 bp, Setaria italica; identical to SEQ ID NO: 647
  Si021124m

SEQ ID NO: 1514 - protein, 935 aa, Setaria italica; identical to SEQ ID NO: 648
  Si021124m

SEQ ID NO: 1515 - DNA, 2847 bp, Setaria italica; identical to SEQ ID NO: 649
  Si024174m

SEQ ID NO: 1516 - protein, 949 aa, Setaria italica; identical to SEQ ID NO: 650
  Si024174m

SEQ ID NO: 1517 - DNA, 2481 bp, Setaria italica
  Si021227m
atggagcaatccacggcgagaacaatggcggcaagatcgtggctgctgcttctctgcctcgccgccgtcgccactgccggcgtgctccaagctcgcgcccagcccgacagcatcggtttcatcagcatcgactgcgggctctcgggcacggcgagctacgtggacgacaccaacacgctgtcgtacgccccggacgccgccttcgtcgacgccggctccaaccacaacatctcggccgagtacatcacgcccaagctcggcaagagctacctcaacgtgcgcagcttccccgacggtgcgcgcaactgctacacgctccggtccctcgtcgcggggctcaagtacctcgtccgcgccaccttcaagtacggcaactacgacggcctcggccggccgcccatcttcgacgtctacatcggcgtcaacttctggagcatggcgaacatcacggacgccgacacccctctgctcctcgaggccatcgtcgtcgtgccggacgatttcgtgcaggtctgcctggtgaacaccggcaccggcacgccgttcatctccgggctggacctgaggccgctcaagagcacgctctacccgcaggcgaacgcaactcagggcctggtcctgctcggcaggatcaacttcggccccaccgatgccacggacatcgtcaggtaccctgatgatccgcacgaccgattctggttgcccttggtggacgctacgagctggaactcgatatcgacgacccagagggtgcagaacatagacaacgacctgttcgaggcgccgtccaaggtgatgcagacggcgatcacgccgcggaacgcctccaagaacatcgagttctcctgggacccggagccgcagcccaagaacccgacgccggggtacgtcgccaacatgcacttcaccgagctgcagctcctgccgagcaacgccacgcgccagttctacatcaacctcgacggcaagccgtggtacccgaagcccttcacgccgccgtacctcaccaccgacgccacctacaacagcaacccctatagggggctcgcgcactacaacatctccatcaacgccaccgccaactcgacactgccgccgatcatcaacgccatcgaggtgttctccgtcatctccaccaccaacgtcgccacggactcccaggacgtatctgccatcacggcgatcaaggcgaagtatcatgtgcagaagaactggatgggtgacccatgcgttccaaagactcttgcgtgggaagggttgacgtgcagctacgccgtttccactcctccaagaattacaggcgtatacggcaataattcaaacctctgcagcaacggcaactcgtgtcagacgacgaaagggaagagaacgacgattaactctgtgaagcctcaaaacgagacgccgaggagccatgtgccaacaggcgacgcgtatccgcagagctcgctgcagcttgagaaccgccggttcacgtacaaggagctggaggtgatcacgaataacttccagcgcgtactcggccgaggagggttcgggaaagtctacgatggcttcttggaggatggtacccaggtggcagtcaagctgcggtcggattcttccaatcagggtgttaaggagttcctagcagaggcccagaccttgacccggattcaccacaagaatctcgtgtctatgatcgggtactgcaaggatggggagtacatggcacttgtctacgagtacatgtcagaaggaaccctgcaagagcacatttcaggaaatggccgcaatggaggattcttaagctgggcacagaggctcagaattgcactggaatcagcgcaaggtctggagtacctacatagagggtgcaacccacctctcattcacagggatgtgaagggggccaacatcctactgaattccaaactggaggccaagatcgccgatttcggcttgaccaaggccttcagtcgcgagaatggcacgcaagtatccacgaatacccttgtcggtaagccgacgacaaagagcgacgtctacagcttcggcgtcgtgctgctggagctggtcacgggaaggccggccattttccgagaccccgagccaaccagcatcatcctgtgggcgcggcagcgcctcgcgcggggcaacattgagggcgtcgtggacccgcgcatgcgcggcgaccacgacgtgaacactctgtggaaagccgcggacatcgcgctcaagtgcacggcgcagtcgtcggcgcagcggccgaccatgaccgatgttgtggcgcagctgcaggagtgcctcgagctcgagcaggctcgcgccggtggcgcgaatggcagcttctacaccggcagcagcagtgacccgtactcgggatacaacggctccactgctgacggccagtccactgacgtgagccggagcagcactgcgtttgagatggatcacaattttgggagggcgccaacgatgcccacgggtcctgctgcacga

SEQ ID NO: 1518 - protein, 827 aa, Setaria italica
  Si021227m
MEQSTARTMAARSWLLLLCLAAVATAGVLQARAQPDSIGFISIDCGLSGTASYVDDTNTLSYAPDAAFVDAGSNHNISAEYITPKLGKSYLNVRSFPDGARNCYTLRSLVAGLKYLVRATFKYGNYDGLGRPPIFDVYIGVNFWSMANITDADTPLLLEAIVVVPDDFVQVCLVNTGTGTPFISGLDLRPLKSTLYPQANATQGLVLLGRINFGPTDATDIVRYPDDPHDRFWLPLVDATSWNSISTTQRVQNIDNDLFEAPSKVMQTAITPRNASKNIEFSWDPEPQPKNPTPGYVANMHFTELQLLPSNATRQFYINLDGKPWYPKPFTPPYLTTDATYNSNPYRGLAHYNISINATANSTLPPIINAIEVFSVISTTNVATDSQDVSAITAIKAKYHVQKNWMGDPCVPKTLAWEGLTCSYAVSTPPRITGVYGNNSNLCSNGNSCQTTKGKRTTINSVKPQNETPRSHVPTGDAYPQSSLQLENRRFTYKELEVITNNFQRVLGRGGFGKVYDGFLEDGTQVAVKLRSDSSNQGVKEFLAEAQTLTRIHHKNLVSMIGYCKDGEYMALVYEYMSEGTLQEHISGNGRNGGFLSWAQRLRIALESAQGLEYLHRGCNPPLIHRDVKGANILLNSKLEAKIADFGLTKAFSRENGTQVSTNTLVGKPTTKSDVYSFGVVLLELVTGRPAIFRDPEPTSIILWARQRLARGNIEGVVDPRMRGDHDVNTLWKAADIALKCTAQSSAQRPTMTDVVAQLQECLELEQARAGGANGSFYTGSSSDPYSGYNGSTADGQSTDVSRSSTAFEMDHNFGRAPTMPTGPAAR

SEQ ID NO: 1519 - DNA, 2847 bp, Setaria italica; identical to SEQ ID NO: 651
  Si024720m

SEQ ID NO: 1520 - protein, 949 aa, Setaria italica; identical to SEQ ID NO: 652
  Si024720m

SEQ ID NO: 1521 - DNA, 2703 bp, Brachypodium distachyon
  Bradi4g04077.1
atgtggtacgtctctgacatcggcttcgtcgacgctgatgcgggggcgaacgcccacgtcagcccgtcattcgacatatacgacctatcacagcggtatgataacgtccgctacttccccccttggggtgccggcaaccggagctgctacacgctctgggggccaacgcaaggaaacaagtacctggtcaggtgcagcttctactacggcaactatgatggcaactatgacgggaacagaagcctcccggccttcgacctctaccttggggtcaatcgatgggccaccgtcaacgtcaccaacaccacggacaggtacatcctcgaggcggtggtagtgtcaacggccaacttcttacaggtatgcctggtgaacatagggttgggtacgcctttcatctcttcgcttgagctgaggccgctcaagccagccatgtacccggaggccaccgtgaaccagtcgctgctcctcctcagccttcgcctgccgacagcggcattcccctttaaccggtactacttctggcagtcgcctagagtatacaggattaccggcaacaggtacccagatgacgacttcgaccgtgactggcagagctacttcaacgccactgcgtggatccaaataaaaacgaagggcaccgtaaatgtatccaactcaagcagctttgccaaggcaccaaaggtggtactgcagagcgccgctgctccagtgaacgggacccggctcgacttctcatggagcacggacccttcgctggacaacaacagcaacagtagcacagcttacctcctgctgttctacttcgcggagctggagcggctgccgagcagctcgtcgaggcgattcgacattctcatcgatggttcttcgtgggacggcggccggaactacaccccaaagtacctcactgcagaggtcttgaaaaaggtagtggtgcagggggcgggccagcacaccatctcgcttgtcaccacgccaggcacagtgctcccacccatcctgaatgcgctcgagatatactcggtgcggcagatgaatgagcttgggacgaacaatgtagatgccgagtccatgatgaaaattcgcaagacatatgtgctgaagaaaaactggataggtgatccttgtgcaccgaaagcatttgcgtgggatggcctgaactgtagttactcttcatctggtcctgcatggataacagctttaaacttgtcatctagcgtgttgactggtgcagtggatccttcttttagcgatctaaaatccatccaatatctggacttgtccaataacagcctgtctggcccaatacctgattttctaggacaaatgccatcactcatattccttgatttgtcgagcaataaactcagcggatcaattcctgcagctctactagaaaaacatcaaagtggatctcttgtactaagggttggtaacaacacaaatatctgtgacaatggtgcctctacatgtgatcccggcggcaataaaaagaaccgaacactcgtcattgcaatatctgtcgcaatagctgttgcaactatactgtttgtggcagcaattcttatccttcacagaaggagaaatggacaagatacatggatcagaaacaactcaaggcttaacagcacctggaacacgtcgaacttatttgagaacagacggttcagttacaaggagctgaagctaattacagctaacttcagagaagaaatagggagaggaggatttggtgctgtgtttcttggttatttagagaatgaaaatgcagttgccgtgaagatccgttcaaaaacatcatctcagggggataaagagtttctagctgaggctcaacacttaagtcgagttcatcataggaatctggtatccttaattggttattgcaaggacaagaaacatctggcccttgtctatgaatatatgcatggaggagacttagaggattgcctaagaggagaggcttctgttgctacacccctcagttggcatcaacgtctcaggattgctctcgactctgcccatggattggagtatctacacaagtcctgccaaccgctgctaatccatagagatgtgaagacaaagaacatcctgctaactgctgacctagaggcaaagatatccgactttggcctcacgaaggtgtttgccaacgagttcatgacccatatcaccacccaaccggcaggtaccctggggtaccttgaccctgaatactacaacacatcccggctcagtgagaagagtgacgtgtacagctttggggttgtactactggagctcatcaccggccagccgccagcagtcgccgttagtgacaccgagagcatccacatcgcacagtgggtgcgccagaagctttcagagggtaacatagagagcattgctgactcaaagatggggatggagtatggtgttaactcagtctggaaggttacagagctggcactgcggtgcaaggaacaaccatcatgggaacgcccaacgatgaccgaggttgtggctgagctcaatgagtgcttggagctggaggtgtctcgtggaattggcaactacagctcagtcaccagtgatggtctcagtgcaatgagtgctgacttgcatagtgatcttcaaagaagtgatctgagacagaaaagcatgcctgagttggaggatggcgatgcatccgcaactctcataggtccgacaacgtgc

SEQ ID NO: 1522 - protein, 901 aa, Brachypodium distachyon
  Bradi4g04077.1
MWYVSDIGFVDADAGANAHVSPSFDIYDLSQRYDNVRYFPPWGAGNRSCYTLWGPTQGNKYLVRCSFYYGNYDGNYDGNRSLPAFDLYLGVNRWATVNVTNTTDRYILEAVVVSTANFLQVCLVNIGLGTPFISSLELRPLKPAMYPEATVNQSLLLLSLRLPTAAFPFNRYYFWQSPRVYRITGNRYPDDDFDRDWQSYFNATAWIQIKTKGTVNVSNSSSFAKAPKVVLQSAAAPVNGTRLDFSWSTDPSLDNNSNSSTAYLLLFYFAELERLPSSSSRRFDILIDGSSWDGGRNYTPKYLTAEVLKKVVVQGAGQHTISLVTTPGTVLPPILNALEIYSVRQMNELGTNNVDAESMMKIRKTYVLKKNWIGDPCAPKAFAWDGLNCSYSSSGPAWITALNLSSSVLTGAVDPSFSDLKSIQYLDLSNNSLSGPIPDFLGQMPSLIFLDLSSNKLSGSIPAALLEKHQSGSLVLRVGNNTNICDNGASTCDPGGNKKNRTLVIAISVAIAVATILFVAAILILHRRRNGQDTWIRNNSRLNSTWNTSNLFENRRFSYKELKLITANFREEIGRGGFGAVFLGYLENENAVAVKIRSKTSSQGDKEFLAEAQHLSRVHHRNLVSLIGYCKDKKHLALVYEYMHGGDLEDCLRGEASVATPLSWHQRLRIALDSAHGLEYLHKSCQPLLIHRDVKTKNILLTADLEAKISDFGLTKVFANEFMTHITTQPAGTLGYLDPEYYNTSRLSEKSDVYSFGVVLLELITGQPPAVAVSDTESIHIAQWVRQKLSEGNIESIADSKMGMEYGVNSVWKVTELALRCKEQPSWERPTMTEVVAELNECLELEVSRGIGNYSSVTSDGLSAMSADLHSDLQRSDLRQKSMPELEDGDASATLIGPTTC

SEQ ID NO: 1523 - DNA, 2910 bp, Oryza sativa; identical to SEQ ID NO: 653
  LOC_Os12g37980.1

SEQ ID NO: 1524 - protein, 970 aa, Oryza sativa; identical to SEQ ID NO: 654
  LOC_Os12g37980.1

SEQ ID NO: 1525 - DNA, 2664 bp, Zea mays; identical to SEQ ID NO: 655
  GRMZM2G332280_T01

SEQ ID NO: 1526 - protein, 888 aa, Zea mays; identical to SEQ ID NO: 656
  GRMZM2G332280_T01

SEQ ID NO: 1527 - DNA, 2709 bp, Setaria italica
  Si004727m
atggctccctctcctgctttgcagttcttgggccttgtatgcttggcagcagcatcggctcttagcactgtcatccatggccagcccggttctgcagatttcttcagcatcgactgcggcatccccgcggaccagacctaccctgaccggtccatcccgggcatcgtctacgtctccgacgccggcttcaccgacgcggggctcaccgccggcgtcaaaccgacgtacgtcgggccgaacctgcacgacaggtaccgaacccttcggtacttccccggcggcgccgccgcgcggagctgctacacgctccggccggttacgcccggcggcaagtacctcgtcaaggccagcttcttctacggcaactacgacgggctggacgagcctcccgtcttcgacctccacctcggcgccaaccgctggtggaccaccctgcaactgctcgccaccaacacgtacagcgtcgaggcgttgaccgtgccgccgggagactccttgcaggtgtgcttggtgaatacaggtttgggtacaccattcatctctgggcttgacctgatgccgctcggggccaccatgtacccggaggccacggtcaaccagtcactagttctgctcaggattgcccggccatcagccgcattcagtttcaaccgatatcatttctggccagccgatcaattgtttaggtaccccactgataggtatgaccgccactggcaaagatacggcgatgtttctgcactgaccaacataacaaccacggaaactgtcgacgtctcaggtatcagcaacttcgacaagccaacgaagatactgcagagcactgccactccagtgaatggaacccgaatcgacatcacctggagcccagatcccgcctcgagtagtgacaactcgacgtaccttctgctgctttacttcgcagaagttcagagattgccgcgcaataccctgaggcagtttgatatccttgtggacaacgctacatggaatggtagtcagggcttcacaccgagatacctttcggcagagatcgtgaaaaggatggtgcgggcggcgcgccaacacaccttctcgcttgtcgccacaccagaggccacgcatccacccatcctgaatgctttcgagatatacacagtaaagccaatgactgagcctacgacgaatgacatggatgctaaggccatgataactattcgcacaacgtatgcggtgaagaaaaactggatgggtgatccttgtgccccaaaaacatatgcttgggatggcttgaactgcagttattcatcatctgactctgcatggataacagctctgcacttatcatcttgtgggttgactggtgatgttgatccttcgtttggatatctaaaatccctccaacatctggatctgtcaaataatagtctgtctggtcgcgtgccagattttctagcgcaaatgccatcattgaaattccttgatttttcaagcaataaattcgttggatctgtacctgcaattctactagagaagcatcaaaatggatcccttgtgttaaggtttgcatcacaaattgttgttccaatagcagtcgcaactctactgtttgtggcagcatttcttatcttccgaattatgagaaaaagaaaagatgcatggatggcaaacaactcaaggcttcacagcccacgaggtagggcgaatacatttcagagcagacagttcacctacaaggagctgaaggtcatgacatctaacttcagagaagaaatagggcgaggtgggtttggtgctgtgttcctgggctatttggagaacggaagtccagtcgccatcaagatgtgttcaaaaacatcctcccaaggggataaggaatttttagctgaggctcagcacttgactagagttcaccacaggaacctggtttccttggtaggatattgcaaggacaagaaacatctggcccttgtctatgaatacatggaaggaggaagcctagagggccgtctaagaggagaggcctctgcagctacacccctcacctggcatcaacgtctcaagattgctctcgactctgcccaaggattggagtatctgcataaatcatgccaaccgccgctgatccatagggatgtgaagacacagaacattctgctatcggccaatcttaaggcgaagatagctgactttgggctcatgaaggagttttcggatgagtacaggacccatgtcaccacccacccggcaggcaccttggggtatcttgaccctgaatactacaacacatcgcagctaagtgaaaagaatgatgtatacagctttggagttgtgttgctagagcttatcacaggccagccaccggcggttcccatcggcgataccgagagcatccacattgctcagtgggtgcgcgagaagctttcggagggcgacgacatcgagagcattgctgacccgaggatggagaggcagtacgatgtcaactctgtttggaaggtttcagagttggcactgcagtgcaaagaagagccatcacggacacgaccagcaatgactgacgtggtggtggggctgaaggaatgtttggagctagaggtgtctcgtgcaatgagctactacagctcagtcgcaagcagtgcaagaaatgtcagtgtaacaagtgttgatttgcacattgaagctcaagcaagcgattatctgagacagcaggccgcgcttgagttggaa

SEQ ID NO: 1528 - protein, 904 aa, Setaria italica
  Si004727m
MAPSPALQFLGLVCLAAASALSTVIHGQPGSADFFSIDCGIPADQTYPDRSIPGIVYVSDAGFTDAGLTAGVKPTYVGPNLHDRYRTLRYFPGGAAARSCYTLRPVTPGGKYLVKASFFYGNYDGLDEPPVFDLHLGANRWWTTLQLLATNTYSVEALTVPPGDSLQVCLVNTGLGTPFISGLDLMPLGATMYPEATVNQSLVLLRIARPSAAFSFNRYHFWPADQLFRYPTDRYDRHWQRYGDVSALTNITTTETVDVSGISNFDKPTKILQSTATPVNGTRIDITWSPDPASSSDNSTYLLLLYFAEVQRLPRNTLRQFDILVDNATWNGSQGFTPRYLSAEIVKRMVRAARQHTFSLVATPEATHPPILNAFEIYTVKPMTEPTTNDMDAKAMITIRTTYAVKKNWMGDPCAPKTYAWDGLNCSYSSSDSAWITALHLSSCGLTGDVDPSFGYLKSLQHLDLSNNSLSGRVPDFLAQMPSLKFLDFSSNKFVGSVPAILLEKHQNGSLVLRFASQIVVPIAVATLLFVAAFLIFRIMRKRKDAWMANNSRLHSPRGRANTFQSRQFTYKELKVMTSNFREEIGRGGFGAVFLGYLENGSPVAIKMCSKTSSQGDKEFLAEAQHLTRVHHRNLVSLVGYCKDKKHLALVYEYMEGGSLEGRLRGEASAATPLTWHQRLKIALDSAQGLEYLHKSCQPPLIHRDVKTQNILLSANLKAKIADFGLMKEFSDEYRTHVTTHPAGTLGYLDPEYYNTSQLSEKNDVYSFGVVLLELITGQPPAVPIGDTESIHIAQWVREKLSEGDDIESIADPRMERQYDVNSVWKVSELALQCKEEPSRTRPAMTDVVVGLKECLELEVSRAMSYYSSVASSARNVSVTSVDLHIEAQASDYLRQQAALELEQ

SEQ ID NO: 1529 - DNA, 2712 bp, Oryza sativa; identical to SEQ ID NO: 657
  LOC_Os02g05730.1

SEQ ID NO: 1530 - protein, 904 aa, Oryza sativa; identical to SEQ ID NO: 658
  LOC_Os02g05730.1

SEQ ID NO: 1531 - DNA, 2619 bp, Setaria italica; identical to SEQ ID NO: 661
  Si016287m

SEQ ID NO: 1532 - protein, 873 aa, Setaria italica; identical to SEQ ID NO: 662
  Si016287m

SEQ ID NO: 1533 - DNA, 2679 bp, Zea mays; identical to SEQ ID NO: 659
  GRMZM2G093490_T01

SEQ ID NO: 1534 - protein, 893 aa, Zea mays; identical to SEQ ID NO: 660
  GRMZM2G093490_T01

SEQ ID NO: 1535 - DNA, 2658 bp, Oryza sativa; identical to SEQ ID NO: 619
  LOC_Os09g18594.1

SEQ ID NO: 1536 - protein, 886 aa, Oryza sativa; identical to SEQ ID NO: 620
  LOC_Os09g18594.1

SEQ ID NO: 1537 - DNA, 2556 bp, Oryza sativa; identical to SEQ ID NO: 617
  LOC_Os09g18260.1

SEQ ID NO: 1538 - protein, 852 aa, Oryza sativa; identical to SEQ ID NO: 618
  LOC_Os09g18260.1

SEQ ID NO: 1539 - DNA, 2643 bp, Oryza sativa
  LOC_Os09g18360.1
atggcacccatgctcctcttcgctgcactcatgttagcctcactatccgaagcagcggctgacgatgggatcggcggccagtcaggttttgtgagcatcgactgcggcagggaggccaactacagcgactacaaggaccccaagaccggcatcgtctacgtctccgacgagccgtacatcgacgccggcgcaggggagaatcaccggatctccgccactgccacggccaccgccgccgacagctacctcctccagacgctccggagcttcccctccggcccgcgcaactgctacgcgctccccaccgtcgccgggaccaagtacctggtccggctggggttcctgtacggcaactacgacggcgagaacagctcgtcgtcgtcggcgtcgtcgctgcggttcgatctgcatctcggtgcgcaacgctgggccaccgtggacgacgtggttgtgcagaccggcgggattagccggatgtacgaggtggtgttcatggggtgggcgaggtgggcgccggcgtgcctggtgaacgtcggcggcggcacgccgttcgtgtcgtcggtggagctgaggccgatcgacgacgagctttacccgtccgtcaagaccagcgagtcgctgtctttgtttaaacggtcggatatgggggcggacactactactcttacccggtaccctgccgatgagcacgaccgcatctggaaagggactggaaacccaggatcgacagacatttccacccaagaaaaaatccagtcggagaacagcttcgaggtgcccctccctgttcttcagacagcgatcacgacgcccggtggcaacgacacgacgctcaccgtggcatggcaagacaccaggtcgtcgagcgaatacatggtgttccttcacttcgccgactttcagaagattcagcccaggcagttcaatgtcacactcaacgacatcccgatcggatccaatggccggtcgctcatgttcagcccttcgcccctggactcttcctctgtatacagctccgatgggtacagagctgatgatggcaattacaacctcgtcctcaggagaacagctgcctcggcgctgcctccgatgctcaatgcgatggagatctatactgtcatcacacatgatagtccaaggacattccacaaagactttgacgcaatcatggacattaaatatgagtatgggatcaagaaaaactggatgggtgatccgtgtttcccgtccgaatttatttgggatggcatcaaatgcagcactgcaggtgatgataacacttcaagaataatatcacttgatctctcccagagcaacttgcaaggggtggtatctattaacttcacttttctcaccgcgctcaactatttaaatttgtcaggtaaccaactgaatgggccagttccagactcgctctgtaaaaatattgcaggattatacattttcagttacacgtctgacggagatatctgcaacaatagaacctcttcgtctcggtcaacaaacagatcaacaactatcttagcaatttcaatagttactcccgtattggcagtggctatacttcttgcatttcttctctggagagcaaaaggaaagcacaacgtttctacatttgatcctcccagagtaccggatcccaagaaagctccaggaagtacaacagatcactggagccatttgccaataaatggaagtcgccaattcacatatgaggaactgaagaattttactcttaactttcaacggtttattggacaaggaggttttggacatgtgtattatggttgtttagaagatggctctgaggttgctgtcaagatgcgatccgaatcatcattgcatgggcttgatgagtttttagctgaggtccagagcttgacaaaggtgcatcacagaaatctagtttctttggttggatactgctgggaagagcactatttagcactggtctatgagtacatgcctagtggcagtctatgtgatcatctgagaggtaaacgtgatgttggtgaaaccttgaactgggcaaaacgtgtgcgaatcatgcttgaagctgcacaaggcctggaatacctacacaagggttgcaatttgccaataattcacggggatgtgaaaaccaataatgttctcttgggtgaaaatctgaaagctaaactagcggattttgggctctctaaaatgtatattagtgactcgcagactcacatatcagtcaccgcagctggaacagtgggttacattgacccagagtactatcagaccggacggctaactgagagcagtgatgtttatagctttggtgttgttctactggaggtagtcaccggtgagcttccgatactagctggccatggtcacatcgtccagcgtgtggaacgtaaggttacctccggtagtatcggcttagttgccgatgcacggcttaatgattcctacgacattagctctatgtggaaggtggtggataccgcaatgctgtgcacaacagatgttgctattcaaaggccaactatgtccaccgttgttttacagttgaaggaatgccttgcattggaagaagctcgtgaggataggaatagggcaggcccaacaaatgatgccgtggatgtggtatccacatttggtccatcggcaaga

SEQ ID NO: 1540 - protein, 881 aa, Oryza sativa
  LOC_Os09g18360.1
MAPMLLFAALMLASLSEAAADDGIGGQSGFVSIDCGREANYSDYKDPKTGIVYVSDEPYIDAGAGENHRISATATATAADSYLLQTLRSFPSGPRNCYALPTVAGTKYLVRLGFLYGNYDGENSSSSSASSLRFDLHLGAQRWATVDDVVVQTGGISRMYEVVFMGWARWAPACLVNVGGGTPFVSSVELRPIDDELYPSVKTSESLSLFKRSDMGADTTTLTRYPADEHDRIWKGTGNPGSTDISTQEKIQSENSFEVPLPVLQTAITTPGGNDTTLTVAWQDTRSSSEYMVFLHFADFQKIQPRQFNVTLNDIPIGSNGRSLMFSPSPLDSSSVYSSDGYRADDGNYNLVLRRTAASALPPMLNAMEIYTVITHDSPRTFHKDFDAIMDIKYEYGIKKNWMGDPCFPSEFIWDGIKCSTAGDDNTSRIISLDLSQSNLQGVVSINFTFLTALNYLNLSGNQLNGPVPDSLCKNIAGLYIFSYTSDGDICNNRTSSSRSTNRSTTILAISIVTPVLAVAILLAFLLWRAKGKHNVSTFDPPRVPDPKKAPGSTTDHWSHLPINGSRQFTYEELKNFTLNFQRFIGQGGFGHVYYGCLEDGSEVAVKMRSESSLHGLDEFLAEVQSLTKVHHRNLVSLVGYCWEEHYLALVYEYMPSGSLCDHLRGKRDVGETLNWAKRVRIMLEAAQGLEYLHKGCNLPIIHGDVKTNNVLLGENLKAKLADFGLSKMYISDSQTHISVTAAGTVGYIDPEYYQTGRLTESSDVYSFGVVLLEVVTGELPILAGHGHIVQRVERKVTSGSIGLVADARLNDSYDISSMWKVVDTAMLCTTDVAIQRPTMSTVVLQLKECLALEEAREDRNRAGPTNDAVDVVSTFGPSAR

SEQ ID NO: 1541 - DNA, 2523 bp, Oryza sativa
  LOC_Os09g19140.1
atggagttcttggctttcttcgccgtactcgtcttagcaacggcggtcgttcctgccgtcagccagcaaggatacctgagcatcgactgcggcctggaggccaacagcagctaccaggacgacaacaggatcttgtacgtgcccgacggtccgtacgtcgacggcggggagaaccacaaggtggcggcggagtacgcgtccagcttccagcgcccagaccagacgctccggagcttcccctccggcgtacggaactgctacacgctccccaccgccgccgggtccaagtacctggtccggctggtgttcgtctacggcaactacgacggcaagaacatctcctcctcctcctcgtccgcggcggcggcggcgctcaggttcgacctgtacctcgggctgagccgttggaccaccgtgcagggcggcaccggcagcggcggcgaggtgcacgaggcggtgttcgtggcgtgggcgagctgggcgcccgtgtgcctcgtcaacaccggcagcggcacgccgttcgtgtccacggtggagctgaggccgctcgtggattcgctctacccggctgtcatggccaaccagtccttggccatgcttcgacggcgtaatatggcggcaaacaatttcatacggtatcctgacgacccatatgaccggtactggtggccaatgaatgctgaccccgcatgggccaacctttcaaccacgtcaaccattaagactggatccacatttgcggtgccctcgagtgttctccaaacggccgttacaccatccggaaacagtacggtgcttaacgtcataagctggcaagacacaacggccaaagagtatgtggtgtacctgcattttgccgacttccagagcagcaaactccgggagtttgatgcttaccctgatgccaaccaggtagtgtacaattacaccccacattacttgttatccagtagcgtgtacacacccttgttcagggccattgctggtgagtataatattactcttgccgccactgccaactctgcgttgccccctatgctcaatgctttcgagatctacttcctcatcacctacgacggcacgacaacgttctccaaagactttgatacaatcatggctattaaactcgagtatggggtaaagaagaactggatgggtgatccatgttttccacctgaatttgcttgggacggcatcaaatgcaggaacaccagtggtaacattatgaggataatatcgattgatctctccaacagcaacctttttggggtgatatctaataacttcacattgcttactgcactcgagaaattaaatttatcaggcaaccaactgaatgggcccattccagactctctctgtaaaaacaatgcaggacaattcgttttcaggtatgttgctaaaacaaaccctgaactgttggttttatataattattacagttatggatctgatggaaatatgtgcaacaaaacaatagttcctacgtatgttcctcctcaagtaccagatatcaagacttcgccagaaaggaaaacaaatccttttgatcctctgcaaataactgaaagtcggcaattcacatacgaggagctaaagaagtttactaataacttccaacagttcattggacgaggaggctttgggaatgtctattacggctgtttagaaaacaaaaccgaggttgctgtcaaaatgctctctgaattctcggagaatggccttgatcagtttttagccgaggttcagagcttgacaaaggtgcatcacaaaaatctagtttctttggttggttattgctgggaaaaggatcacttagcactggcttatgagtacatggctagaggcaatctttgtgatcatctaagaggtaaatttggtgttggtgatacctttaactgggtaacccgtgtgcgagttgtgcttgatgctgcacaaggtctggagtatctgcacaaaggttgcaacttgccaataattcacggggatgtgaagaccaataatgtactcttgggtgaaaatctaaaagctaaaatcgcagactttgggctttctaaaacttatattagcgagacacagactcacatatcaaccagtaatgccgctggaacaatgggttacatcgaccccgagtactatcatactggaaggctgacagagagcagtgatgtttatagcttcggtgttgttctactagaggtagccaccggtgaacctccaatactacctggcagtggccacatcattcagcgtgtgaaacagaaagttgcatctggtaatatcagcttggttgccgatgcacgactcaaagatttgtacgacattagctccatgtggaaggtggttgatactgcaatgctctgcatatcagaggttgctactcaaaggccaacaatgtccaccgtggttctacagctgaaggagagcttggcactggaggaagcccgtgacagcagggacatcacgacaagctcagttagtgatgccatggatgtgttgtcaaaatttggtccatcggcaaga

SEQ ID NO: 1542 - protein, 841 aa, Oryza sativa
  LOC_Os09g19140.1
MEFLAFFAVLVLATAVVPAVSQQGYLSIDCGLEANSSYQDDNRILYVPDGPYVDGGENHKVAAEYASSFQRPDQTLRSFPSGVRNCYTLPTAAGSKYLVRLVFVYGNYDGKNISSSSSSAAAAALRFDLYLGLSRWTTVQGGTGSGGEVHEAVFVAWASWAPVCLVNTGSGTPFVSTVELRPLVDSLYPAVMANQSLAMLRRRNMAANNFIRYPDDPYDRYWWPMNADPAWANLSTTSTIKTGSTFAVPSSVLQTAVTPSGNSTVLNVISWQDTTAKEYVVYLHFADFQSSKLREFDAYPDANQVVYNYTPHYLLSSSVYTPLFRAIAGEYNITLAATANSALPPMLNAFEIYFLITYDGTTTFSKDFDTIMAIKLEYGVKKNWMGDPCFPPEFAWDGIKCRNTSGNIMRIISIDLSNSNLFGVISNNFTLLTALEKLNLSGNQLNGPIPDSLCKNNAGQFVFRYVAKTNPELLVLYNYYSYGSDGNMCNKTIVPTYVPPQVPDIKTSPERKTNPFDPLQITESRQFTYEELKKFTNNFQQFIGRGGFGNVYYGCLENKTEVAVKMLSEFSENGLDQFLAEVQSLTKVHHKNLVSLVGYCWEKDHLALAYEYMARGNLCDHLRGKFGVGDTFNWVTRVRVVLDAAQGLEYLHKGCNLPIIHGDVKTNNVLLGENLKAKIADFGLSKTYISETQTHISTSNAAGTMGYIDPEYYHTGRLTESSDVYSFGVVLLEVATGEPPILPGSGHIIQRVKQKVASGNISLVADARLKDLYDISSMWKVVDTAMLCISEVATQRPTMSTVVLQLKESLALEEARDSRDITTSSVSDAMDVLSKFGPSAR

SEQ ID NO: 1543 - DNA, 2661 bp, Setaria italica
  Si028878m
atggccttcttggttcttcttgctgccacgctattcatgttaaccgcccaagcggtggttcgtgtcgtcggtgagccagggttcctcagcatcgactgcggcctggacggcagcggctacaaggacgcgaccaccggtatcgactacgtccctgatggcccgtacgtcgacgccggcgagaaccacgtggtggccgccgagtaccgggacggtccgaaaaggtacgacacgctgcggagcttcccgcccggaagcgggaagcgaaactgctacacgctgcccacggtcgccggagccaagtacctagtccggatggagtccacctacgggaactacgatggccggaacagctcgtcgtcgtcgtccatggaggagtacatgttcgacctgtacctgggggctgactactgggagaccgtcgaagtcggaaggaacgtggcgtccgaggcagtcttcgtggcgtgggcggcctggacgccggcgtgcctcgtcgataccgaccaaggcacgccgttcgtgtccgtcgtggagctcaggccactcccggcagggctctaccctactgtcacacccgggctgtccatgaaccttcaacgtcggatgggggcaagcatgccattaacccggtttccatacgatgaatacgatcgtttctggtggccaatgtacaataactcgcattgggcgaacttgtcgactaggatgactatccagccggaccccagcttcgccgagcccttgtctattctccagacagcggtttcggcgaccgggaatgacacggtgctcaccatcttcatcttagggaatcacctgcacaagacgaccttctccttcatggggttcatgcatttcgccgattttcagaatgctcagcttcggcagtttgacatatacttgaacggcgaaaaacaggggccctcatacacctcatcattcctggttgcttcgtgcatctataccccaacggcatacaaagccgtcgatcgcaaatacaacatcacccttgtcgccaccgccaagtctgtgctgccgccaatgatcaacgctgtcgagatctacaatatcatcccacacagcaatccaataacattctctgatgattttgacgccatcatggctatcaaattcgagtatggcgtgaagaaaaactggatgggtgatccatgtttcccaaccatatatgcttgggacggtgtgaaatgcagcaatacaagtggtaacactacgaggataacatcactagatctctccaatagcaacttgcgtggggccttatctacgaatttcacattgcttacggcactcgagaatttggatttgtcttataacaacttaagcgggccaatacctgattccctaccaagtttgccctccctacgagttctaaatttgtctggcaaccatctgaatggcaactccctatgcaaaaattacggtggatcacttactttcagatatgattctgatataagtacgtgcaacaaatcgacaagtccgtcaagagaaaaagctctcttagttatttcagttgtggcccctgtcctggttgtggctgcacttgttttttcatttttcatctggagagcaaaaagaaagcctaatgtttctatagatgatcacaatggaaatctacaactggagagtgctacaagaggcgcaaaaggtcaaggggatcacctgcaagatactgagaataggaaattcacgtataaggagctggagaagtttactgataatttcgaacggttcataggacaaggaggttttggacctgtttactttggctgtctagaagaaggtaccatggttgctatcaagatacgttctgagtcatcatcacatggcctagatgaatttttagccgaggttcagagtttgacaaaggtgcatcacaggaatatagtttctctggttggttactgctgggagaaaaatcatttagcccttgtttatgagtacatgtctcaaggcaatctttatgatcatctgagaggtaaaaaggctgctgtccaaaccttgaactggggagcacgtgtgcaaattgtgcttgaagctgcacaaggcctggattatttgcacaaaggatgcagcccgccaataattcaccgagatgtgaagagcggcaacattctcttgggtcgaaatctgcaagctaaaatagcagattttggactgagcaaaacatatcttagcgatgctcaaactcacatatcagccactgcagctggcacggctggctacatggacccagagtactacctcaccggaaggcttaccgagagcagcgatgtgtatagcttcggagtagtcctacttgaggcagccaccggtgagcctccgctgctgccaggccatggccacatcacccagcgcgtgaaacagaggatcgccgcaggcgacatcggctcgatcgctgactcaaggcttggaggcgcctacgacgtcagctccatgtggatggtggtggacacggccatggcgtgcacggcggaggccgatgctggaaggccaactatggctgacgtggtggcgcacctgaaggatagcctggcactggaggatgctcgcgataacgactgcagcgtcccgccgcggcgagcgttgcagcgtgatgatgatgatgacacggttatgtcctcgtttggtccgtccgtgaga

SEQ ID NO: 1544 - protein, 887 aa, Setaria italica
  Si028878m
MAFLVLLAATLFMLTAQAVVRVVGEPGFLSIDCGLDGSGYKDATTGIDYVPDGPYVDAGENHVVAAEYRDGPKRYDTLRSFPPGSGKRNCYTLPTVAGAKYLVRMESTYGNYDGRNSSSSSSMEEYMFDLYLGADYWETVEVGRNVASEAVFVAWAAWTPACLVDTDQGTPFVSVVELRPLPAGLYPTVTPGLSMNLQRRMGASMPLTRFPYDEYDRFWWPMYNNSHWANLSTRMTIQPDPSFAEPLSILQTAVSATGNDTVLTIFILGNHLHKTTFSFMGFMHFADFQNAQLRQFDIYLNGEKQGPSYTSSFLVASCIYTPTAYKAVDRKYNITLVATAKSVLPPMINAVEIYNIIPHSNPITFSDDFDAIMAIKFEYGVKKNWMGDPCFPTIYAWDGVKCSNTSGNTTRITSLDLSNSNLRGALSTNFTLLTALENLDLSYNNLSGPIPDSLPSLPSLRVLNLSGNHLNGNSLCKNYGGSLTFRYDSDISTCNKSTSPSREKALLVISVVAPVLVVAALVFSFFIWRAKRKPNVSIDDHNGNLQLESATRGAKGQGDHLQDTENRKFTYKELEKFTDNFERFIGQGGFGPVYFGCLEEGTMVAIKIRSESSSHGLDEFLAEVQSLTKVHHRNIVSLVGYCWEKNHLALVYEYMSQGNLYDHLRGKKAAVQTLNWGARVQIVLEAAQGLDYLHKGCSPPIIHRDVKSGNILLGRNLQAKIADFGLSKTYLSDAQTHISATAAGTAGYMDPEYYLTGRLTESSDVYSFGVVLLEAATGEPPLLPGHGHITQRVKQRIAAGDIGSIADSRLGGAYDVSSMWMVVDTAMACTAEADAGRPTMADVVAHLKDSLALEDARDNDCSVPPRRALQRDDDDDTVMSSFGPSVR

SEQ ID NO: 1545 - DNA, 2607 bp, Citrus clementina; identical to SEQ ID NO: 689
  clementine0.9_033075m

SEQ ID NO: 1546 - protein, 869 aa, Citrus clementina; identical to SEQ ID NO: 690
  clementine0.9_033075m

SEQ ID NO: 1547 - DNA, 2319 bp, Citrus clementina
  clementine0.9_002959m
atgttaacgactttcgtttttggattcctgtgcatagttgttcttacggctgtggttcatgcacagagtcaatcaggttttatcagcatcgactgcggaataccggaaaatgcaaactataccgacagtataacgggcataaattacgtttcagatgcaagcaacatagacacgggggtaagccataaaatatcttctgaattcaacaaagaaatcacagagcgacaattttccaatttgagaagtttcccggaaggaatcagaaattgttacaccctaaaacccgacagtgaccatgaaaagtttctgatcagggcgagattcatgtacggcaattacaatggccaagataaaccgccaagttttaatctcatgctcgaagcagatgtgtgggactcagtgcaattcccggattcagggagtattgttagcaaagagatcatccacatccctaagagagagtatatacatgtctgtcttgtgaacacagactctgggacacctttcatatcagcattagaattgaggcctttgccaaatttgacatatatgacacaatcaggctcactgtcacgctatgggcgctgggatgtaggttcaacaaccaataaaacattcaggtacccagatgacgtttatgatcgcatatggattcctcacaacttctattcctgggcacaaattagcacctcgagcaatatgaaatcaaccggtaacttccaaccgccatccacagtcatgcagagtgccgtcataccagcaaacggtgggagttccttaatgctcagctggaagcctgctaatcgcatgatcaagaattatgtctacttttacttttcggaatttgaaagtgaacgagccaaaaaccagactagagatttaaacatctatataaatggaaagttatggtatggacctctgtctccctcgtacttggacacagatacagtattcagcacgacacccacgatgaatagagatagacatgacataataataaacacaactgaaaattcagcactccctcccatcctgaatgccttagagatatatcaggtcaaagaattcctgcaattgcttacaaaccaacaagatgtggatgctatcatgaatatcaaatcaaaatacgaactgctgagagattggcagggagatccgtgtgccccaaatgattacttgtggcaaggtcttaattgcagctacgatgctaatcaagccccaaggatcaaatccctaaacttatcgtcaagtggaattgctggggagatccttcctcatatattcagccttacatccatagaatctttggacttatcaaacaatagtttgacgggatcagtacccgagtttctagcagagctacaattcctgagggtgctcaacttgggaggtaacaatctccaaggttcacttccagatggactcattgaaaaagagaagaatggttcactgtcgttaagcgtggatgggaatcccaacctctgtctttcggcttcatgcaaagggaaaaagaataagtttattgttcctttgctagcatccgttgtttcattttcggtcctcttagctgcattggcaattttacggagccttagaaggcggaaacaagcccatcataaaaacttgacaatccttgttgggtattgtgatgagaacacaaagatgggactggtctatgagttcatggccaatggaaacttacaggcacatctcttaggattggaatatcttcatgatggttgtaagccacccatagtccaccgggatgtgaagtccgcaaacatcttactgaatgaaaaattccaagccaaattagctgattttggcctttccagaatttttccagttgaaggaggaagtcatgtgtcgacaacagtagttggaacccctggataccttgaccctgagtactatatatcaaacaggttaacagagaaaagtgatgtttacagctttggagtagttctcttagagttaatcacaggtcaacctgtgattcaaaaaactcctgagagaactctcataggtcagtgggtaagttccatgcttgccagaggggatattaaaaatattgtcgaccaaagattacaaggagatttcgacacaaacacagtctggaaagctgtagaaatagctatggcttgtattcattccatttccactagaaggccaacaatgaatcaggttgtgattgaactgaacgattgtttagcaatggaaataggtcgtacaaaggcgcacgagactgcaccagatggaactcctgatgaattgatgatagatttgaatctgcaaagtgatgtatttcccttagctaga

SEQ ID NO: 1548 - protein, 773 aa, Citrus clementina
  clementine0.9_002959m
MLTTFVFGFLCIVVLTAVVHAQSQSGFISIDCGIPENANYTDSITGINYVSDASNIDTGVSHKISSEFNKEITERQFSNLRSFPEGIRNCYTLKPDSDHEKFLIRARFMYGNYNGQDKPPSFNLMLEADVWDSVQFPDSGSIVSKEIIHIPKREYIHVCLVNTDSGTPFISALELRPLPNLTYMTQSGSLSRYGRWDVGSTTNKTFRYPDDVYDRIWIPHNFYSWAQISTSSNMKSTGNFQPPSTVMQSAVIPANGGSSLMLSWKPANRMIKNYVYFYFSEFESERAKNQTRDLNIYINGKLWYGPLSPSYLDTDTVFSTTPTMNRDRHDIIINTTENSALPPILNALEIYQVKEFLQLLTNQQDVDAIMNIKSKYELLRDWQGDPCAPNDYLWQGLNCSYDANQAPRIKSLNLSSSGIAGEILPHIFSLTSIESLDLSNNSLTGSVPEFLAELQFLRVLNLGGNNLQGSLPDGLIEKEKNGSLSLSVDGNPNLCLSASCKGKKNKFIVPLLASVVSFSVLLAALAILRSLRRRKQAHHKNLTILVGYCDENTKMGLVYEFMANGNLQAHLLGLEYLHDGCKPPIVHRDVKSANILLNEKFQAKLADFGLSRIFPVEGGSHVSTTVVGTPGYLDPEYYISNRLTEKSDVYSFGVVLLELITGQPVIQKTPERTLIGQWVSSMLARGDIKNIVDQRLQGDFDTNTVWKAVEIAMACIHSISTRRPTMNQVVIELNDCLAMEIGRTKAHETAPDGTPDELMIDLNLQSDVFPLAR

SEQ ID NO: 1549 - DNA, 2286 bp, Citrus clementina; identical to SEQ ID NO: 685
  clementine0.9_030629m

SEQ ID NO: 1550 - protein, 763 aa, Citrus clementina; identical to SEQ ID NO: 686
  clementine0.9_030629m

SEQ ID NO: 1551 - DNA, 2403 bp, Citrus clementina; identical to SEQ ID NO: 687
  clementine0.9_030812m

SEQ ID NO: 1552 - protein, 801 aa, Citrus clementina; identical to SEQ ID NO: 688
  clementine0.9_030812m

SEQ ID NO: 1553 - DNA, 1767 bp, Citrus clementina
  clementine0.9_035026m
atgaatgattaccaaggaccatctactgtcatgcagactgcggtcataccaacaaatggtagcaactccttgcagttaagttgggagcctattgatcccaaattcctttattatgcctatttgtacttttctgaatttgaaaatgtgcaagccaataaccagaccagagaaataatcatctatatcaatggaatagattggtttggccctttctctcccttgcactttgccgcaaacactatatacagcacatggccaatattgactgcagaaaaaattgagttctcaatcaacacaacagaaagttcaaccctaccgcctatcctgaatgcctatgagatttatcgggcaaaagaattcctgcaatttctgacaaaccaacaagatggacttaattgcagctaccctgaatatgatcctcctaggatcacatccctgaatctatcatcgagtggaatagctggggacatagctccatatatatctactctcacgtccatacaaatattggatttatcaaacaataatttgacggggcctgttcctgattttctatcacaactaccatttttgacagagctaaacttgaaaggtacaattccaaatggacttattgaaaagcagaagaatggtttgctgtcattgagtgtggaaggaaatccagatctctgtcctgaagcttcctgcacagctgatgagagcaatggcagcagagacaataaatttgttgttccagtagtagcatccgttgtttcactttgcgtccttgtaactgcaatggccatattatggagccttagaaggagaatgcaagttgcaaagaatggatcattcgagctgaaaaatcaaaggttctcatactccaatgtactaaggattactaataacttcgagagggtgcttgggaatggaggatttgggacagtttaccatggatacttagatggtactgaagttgctgtgaagatgctctctccatcatcagctcaaggttacaagcagttccaagctgaggtcgagcttttgatgagaattcatcataaaaacttgacaacgcttgttggatattgcgatgagggcacaaacaggggactaatctatgagttcatggccaatggaaacttacaagcacttctcttaggtgaagaagcggatatcttgagttgggaagggagacttcggatagcaatagaggctgcaaagggattggagtatcttcacagtggttgcacaccacccatagtacacagagatgtgaagtccacaaacattttattgagtgaaaagtttcaggcaaaaatagctgatttcggcctttctagaactttcccggtcgaaggaagtggaactcatgtaacaacaactattgctggaacccctggatactttgaccctgcgtactacatatcaaacaggttaacagaaaaaagtgatgtgtataacttcggagtggttctcttggagataatcacaagcaaatctgtgattgagagaacccatgagaggactcatataactcagtgggtaagtttcatgctggggaagggagatatagaaagtattgtggatccaagattacttgaagattttgatatcaactctgtctggaaaacggtagaaatagctatggcttgtgtttctcaaacttccactaaaaggccaaccatgaatcaggtagtgatggaattgaacgagtctttagcaattgaaactgctcgtttgaaggctgctggcaaggagtatgaatcaaaagattctatcgaatca

SEQ ID NO: 1554 - protein, 590 aa, Citrus clementina
  clementine0.9_035026m
MNDYQGPSTVMQTAVIPTNGSNSLQLSWEPIDPKFLYYAYLYFSEFENVQANNQTREIIIYINGIDWFGPFSPLHFAANTIYSTWPILTAEKIEFSINTTESSTLPPILNAYEIYRAKEFLQFLTNQQDGLNCSYPEYDPPRITSLNLSSSGIAGDIAPYISTLTSIQILDLSNNNLTGPVPDFLSQLPFLTELNLKGTIPNGLIEKQKNGLLSLSVEGNPDLCPEASCTADESNGSRDNKFVVPVVASVVSLCVLVTAMAILWSLRRRMQVAKNGSFELKNQRFSYSNVLRITNNFERVLGNGGFGTVYHGYLDGTEVAVKMLSPSSAQGYKQFQAEVELLMRIHHKNLTTLVGYCDEGTNRGLIYEFMANGNLQALLLGEEADILSWEGRLRIAIEAAKGLEYLHSGCTPPIVHRDVKSTNILLSEKFQAKIADFGLSRTFPVEGSGTHVTTTIAGTPGYFDPAYYISNRLTEKSDVYNFGVVLLEIITSKSVIERTHERTHITQWVSFMLGKGDIESIVDPRLLEDFDINSVWKTVEIAMACVSQTSTKRPTMNQVVMELNESLAIETARLKAAGKEYESKDSIESI

SEQ ID NO: 1555 - DNA, 2574 bp, Citrus clementina; identical to SEQ ID NO: 681
  clementine0.9_028518m

SEQ ID NO: 1556 - protein, 858 aa, Citrus clementina; identical to SEQ ID NO: 682
  clementine0.9_028518m

SEQ ID NO: 1557 - DNA, 2514 bp, Citrus clementina; identical to SEQ ID NO: 683
  clementine0.9_032331m

SEQ ID NO: 1558 - protein, 838 aa, Citrus clementina; identical to SEQ ID NO: 684
  clementine0.9_032331m

SEQ ID NO: 1559 - DNA, 2565 bp, Glycine max; identical to SEQ ID NO: 663
  Glyma07g01620.1

SEQ ID NO: 1560 - protein, 855 aa, Glycine max; identical to SEQ ID NO: 664
  Glyma07g01620.1

SEQ ID NO: 1561 - DNA, 2463 bp, Glycine max; identical to SEQ ID NO: 665
  Glyma08g21190.1

SEQ ID NO: 1562 - protein, 821 aa, Glycine max; identical to SEQ ID NO: 666
  Glyma08g21190.1

SEQ ID NO: 1563 - DNA, 2835 bp, Glycine max; identical to SEQ ID NO: 667
  Glyma13g42930.1

SEQ ID NO: 1564 - protein, 945 aa, Glycine max; identical to SEQ ID NO: 668
  Glyma13g42930.1

SEQ ID NO: 1565 - DNA, 2568 bp, Glycine max; identical to SEQ ID NO: 669
  Glyma15g02520.1

SEQ ID NO: 1566 - protein, 857 aa, Glycine max; identical to SEQ ID NO: 670
  Glyma15g02520.1

SEQ ID NO: 1567 - DNA, 2199 bp, Glycine max; identical to SEQ ID NO: 671
  Glyma13g42940.1

SEQ ID NO: 1568 - protein, 733 aa, Glycine max; identical to SEQ ID NO: 672
  Glyma13g42940.1

SEQ ID NO: 1569 - DNA, 2685 bp, Glycine max; identical to SEQ ID NO: 673
  Glyma15g02450.1

SEQ ID NO: 1570 - protein, 895 aa, Glycine max; identical to SEQ ID NO: 674
  Glyma15g02450.1

SEQ ID NO: 1571 - DNA, 2418 bp, Glycine max; identical to SEQ ID NO: 675
  Glyma15g02490.1

SEQ ID NO: 1572 - protein, 806 aa, Glycine max; identical to SEQ ID NO: 676
  Glyma15g02490.1

SEQ ID NO: 1573 - DNA, 2400 bp, Glycine max; identical to SEQ ID NO: 677
  Glyma15g02510.1

SEQ ID NO: 1574 - protein, 800 aa, Glycine max; identical to SEQ ID NO: 678
  Glyma15g02510.1

SEQ ID NO: 1575 - DNA, 2709 bp, Glycine max; identical to SEQ ID NO: 679
  Glyma15g42040.1

SEQ ID NO: 1576 - protein, 903 aa, Glycine max; identical to SEQ ID NO: 680
  Glyma15g42040.1

SEQ ID NO: 1577 - DNA, 2259 bp, Glycine max
  Glyma08g21140.1
ggatttataagcattgactgtggagcaagtaacgattacttggacgaggaaacaagtatcttttataagacagacacagatttcatagaaacgggagaaaacttgttgacgtcttctgtatttattaacacaaatatccctggtttaggaagacagctacacacattgagaagcttccctgagggaaataggaactgttatactctgaagcccgagtataagcaaggtgaacagcaaagttatctgattcgggctatgttcggatatggaaactacgatggaaaaaatcatgcccctacgttcgatctctatctcggggtcaactactggaaaaatgttaacacggcagacagatcctatatttgggccgagattattcatgctcccacaacagacaccatacaagtgtgtctgttgatcagtgattggaaagggagaatgaagagggaaaaagttcgtgagttgaaatttctcactcatatttttaacaaaaggatcgacaatgtttcctataggtacaaggacgatatctatgatcgcaggtggtactggcgcgatgttaaagattggtataagatcaatacaaccatagatgttaataaatctggcaatgatatttataaagtaccagctgaagtcttgaaaaccgcagtgcagtccttcaatcgctcatatgacttgtactatgactatgaaattgaatggaatgttctcttggacaagtattccagatattatgtctactttcactttgctgaaattcaacagcttgctccagggctcagaaggataatcaacatcactctcaatgatgaaaacatactctctgagcctataactctcgaatatatgaagcctgtcactattagtaacaaatatgcaactcaaggttccgttcgctttttaattagagcaactgcagaatcggatgctcccccaattctcaatgcttttgaggtttatcaattaataacagatctaaattcaacaacagatattaaagatgttgatgccatggagaacatcaaacgctactatgggatatccagaatagattggcaaggggacccatgtcttccagaaaaattcagatggagtggcctggactgcagctacggcatcaatcctagaatcatatcattgaaccttagctcaagcaaactaggagggcagatagccgcttcagtctcagatctttcagaactacagtcccttgttgatggaaatcaaaatcttagcacctcgactccatgccacaagagaaacaaggttgtaattccgttggtagtaacacttgtgggagccttcatcctttcggcagtatcactatttgtttttagaagatactgtgtttcttccatatcagttgttgtgaactcgaagaaacaagagttcagctactcagaggttcaaagtattacgaataattttgagagggttgtgggtaaaggaggatttggaactgtctactatggttgcataggtgaaacacaagtagccgtgaagatgctctctcattcaactcaaggtgttcggcaatttcagacagaggcaaatattctcacaagagtacaccatagatgctttactccacttattggatattgcaatgaaggcaccagaacagcactcatctatgaatacatgaccaacggagacctagctgagaagctatcaggttgggaacagagatttcaagttgctttggattctgcaataggcttggagtaccttcataatggttgcaagcccccaattattcacagagatgttaagactagaaatattttactcgacgagaatctccgcgccaaaatatctgattttggattgtcaagaatcttttcagatgatggtgacacccatgtatcaacagcaattgcaggcaccccaggataccttgacccagaatacaacataacaaacaggttgaatgaaaaaagtgacgtgtatagttttgggattgttcttctagagataatcacggggaggacagtcatactgaaaacccaggtgagaactcacataatcaaatgggtaagttccatgctggctgatgatggtgaaattgatggtgttgtggatacaaggttacaaggagaatatgacagtgaggctgcaaggaaagtaatagatgttgcaatggcctgtgttgctccgagttctgttaataggccaacaatgaatcaagtggtcatggaactaaaacaatgtttccccgtggggaaacttgggactacgtccactggatccagtgaa

SEQ ID NO: 1578 - protein, 754 aa, Glycine max
  Glyma08g21140.1
GFISIDCGASNDYLDEETSIFYKTDTDFIETGENLLTSSVFINTNIPGLGRQLHTLRSFPEGNRNCYTLKPEYKQGEQQSYLIRAMFGYGNYDGKNHAPTFDLYLGVNYWKNVNTADRSYIWAEIIHAPTTDTIQVCLLISDWKGRMKREKVRELKFLTHIFNKRIDNVSYRYKDDIYDRRWYWRDVKDWYKINTTIDVNKSGNDIYKVPAEVLKTAVQSFNRSYDLYYDYEIEWNVLLDKYSRYYVYFHFAEIQQLAPGLRRIINITLNDENILSEPITLEYMKPVTISNKYATQGSVRFLIRATAESDAPPILNAFEVYQLITDLNSTTDIKDVDAMENIKRYYGISRIDWQGDPCLPEKFRWSGLDCSYGINPRIISLNLSSSKLGGQIAASVSDLSELQSLVDGNQNLSTSTPCHKRNKVVIPLVVTLVGAFILSAVSLFVFRRYCVSSISVVVNSKKQEFSYSEVQSITNNFERVVGKGGFGTVYYGCIGETQVAVKMLSHSTQGVRQFQTEANILTRVHHRCFTPLIGYCNEGTRTALIYEYMTNGDLAEKLSGWEQRFQVALDSAIGLEYLHNGCKPPIIHRDVKTRNILLDENLRAKISDFGLSRIFSDDGDTHVSTAIAGTPGYLDPEYNITNRLNEKSDVYSFGIVLLEIITGRTVILKTQVRTHIIKWVSSMLADDGEIDGVVDTRLQGEYDSEAARKVIDVAMACVAPSSVNRPTMNQVVMELKQCFPVGKLGTTSTGSSEI

SEQ ID NO: 1579 - DNA, 2373 bp, Glycine max; identical to SEQ ID NO: 755
  Glyma08g21170.1

SEQ ID NO: 1580 - protein, 792 aa, Glycine max; identical to SEQ ID NO: 756
  Glyma08g21170.1

SEQ ID NO: 1581 - DNA, 2401 bp, Glycine max; identical to SEQ ID NO: 695
  Glyma13g42910.1

SEQ ID NO: 1582 - protein, 802 aa, Glycine max; identical to SEQ ID NO: 696
  misc_feature (802)..(802): Xaa can be any naturally occurring amino acid
  Glyma13g42910.1

SEQ ID NO: 1583 - DNA, 3726 bp, Vitis vinifera; identical to SEQ ID NO: 691
  GSVIVT01016910001

SEQ ID NO: 1584 - protein, 1242 aa, Vitis vinifera; identical to SEQ ID NO: 692
  GSVIVT01016910001

SEQ ID NO: 1585 - DNA, 2682 bp, Solanum lycopersicum; identical to SEQ ID NO: 693
  Solyc03g121230.2.1

SEQ ID NO: 1586 - protein, 894 aa, Solanum lycopersicum; identical to SEQ ID NO: 694
  Solyc03g121230.2.1

SEQ ID NO: 1587 - DNA, 2715 bp, Citrus clementina; identical to SEQ ID NO: 699
  clementine0.9_001865m

SEQ ID NO: 1588 - protein, 905 aa, Citrus clementina; identical to SEQ ID NO: 700
  clementine0.9_001865m

SEQ ID NO: 1589 - DNA, 2613 bp, Glycine max; identical to SEQ ID NO: 701
  Glyma15g02440.1

SEQ ID NO: 1590 - protein, 871 aa, Glycine max; identical to SEQ ID NO: 702
  Glyma15g02440.1

SEQ ID NO: 1591 - DNA, 2754 bp, Vitis vinifera; identical to SEQ ID NO: 703
  GSVIVT01016933001

SEQ ID NO: 1592 - protein, 918 aa, Vitis vinifera; identical to SEQ ID NO: 704
  GSVIVT01016933001

SEQ ID NO: 1593 - DNA, 2412 bp, Vitis vinifera; identical to SEQ ID NO: 705
  GSVIVT01016915001

SEQ ID NO: 1594 - protein, 804 aa, Vitis vinifera; identical to SEQ ID NO: 706
  GSVIVT01016915001

SEQ ID NO: 1595 - DNA, 2178 bp, Vitis vinifera; identical to SEQ ID NO: 707
  GSVIVT01016916001

SEQ ID NO: 1596 - protein, 726 aa, Vitis vinifera; identical to SEQ ID NO: 708
  GSVIVT01016916001

SEQ ID NO: 1597 - DNA, 2718 bp, Vitis vinifera; identical to SEQ ID NO: 709
  GSVIVT01016917001

SEQ ID NO: 1598 - protein, 906 aa, Vitis vinifera; identical to SEQ ID NO: 710
  GSVIVT01016917001

SEQ ID NO: 1599 - DNA, 5520 bp, Vitis vinifera; identical to SEQ ID NO: 711
  GSVIVT01016922001

SEQ ID NO: 1600 - protein, 1840 aa, Vitis vinifera; identical to SEQ ID NO: 712
  GSVIVT01016922001

SEQ ID NO: 1601 - DNA, 4437 bp, Vitis vinifera; identical to SEQ ID NO: 713
  GSVIVT01016925001

SEQ ID NO: 1602 - protein, 1479 aa, Vitis vinifera; identical to SEQ ID NO: 714
  GSVIVT01016925001

SEQ ID NO: 1603 - DNA, 2319 bp, Vitis vinifera; identical to SEQ ID NO: 715
  GSVIVT01016934001

SEQ ID NO: 1604 - protein, 773 aa, Vitis vinifera; identical to SEQ ID NO: 716
  GSVIVT01016934001

SEQ ID NO: 1605 - DNA, 2307 bp, Vitis vinifera; identical to SEQ ID NO: 717
  GSVIVT01016936001

SEQ ID NO: 1606 - protein, 769 aa, Vitis vinifera; identical to SEQ ID NO: 718
  GSVIVT01016936001

SEQ ID NO: 1607 - DNA, 2574 bp, Vitis vinifera; identical to SEQ ID NO: 719
  GSVIVT01016937001

SEQ ID NO: 1608 - protein, 858 aa, Vitis vinifera; identical to SEQ ID NO: 720
  GSVIVT01016937001

SEQ ID NO: 1609 - DNA, 2259 bp, Vitis vinifera; identical to SEQ ID NO: 721
  GSVIVT01016943001

SEQ ID NO: 1610 - protein, 753 aa, Vitis vinifera; identical to SEQ ID NO: 722
  GSVIVT01016943001

SEQ ID NO: 1611 - DNA, 4362 bp, Vitis vinifera; identical to SEQ ID NO: 725
  GSVIVT01016948001

SEQ ID NO: 1612 - protein, 1454 aa, Vitis vinifera; identical to SEQ ID NO: 726
  GSVIVT01016948001

SEQ ID NO: 1613 - DNA, 2619 bp, Vitis vinifera; identical to SEQ ID NO: 723
  GSVIVT01016939001

SEQ ID NO: 1614 - protein, 873 aa, Vitis vinifera; identical to SEQ ID NO: 724
  GSVIVT01016939001

SEQ ID NO: 1615 - DNA, 2595 bp, Solanum lycopersicum; identical to SEQ ID NO: 697
  Solyc03g093380.1.1

SEQ ID NO: 1616 - protein, 865 aa, Solanum lycopersicum; identical to SEQ ID NO: 698
  Solyc03g093380.1.1

SEQ ID NO: 1617 - DNA, 2490 bp, Eucalyptus grandis; identical to SEQ ID NO: 727
  Eucgr.I00390.1

SEQ ID NO: 1618 - protein, 831 aa, Eucalyptus grandis; identical to SEQ ID NO: 728
  Eucgr.I00390.1

SEQ ID NO: 1619 - DNA, 2562 bp, Eucalyptus grandis; identical to SEQ ID NO: 729
  Eucgr.I00392.1

SEQ ID NO: 1620 - protein, 854 aa, Eucalyptus grandis; identical to SEQ ID NO: 730
  Eucgr.I00392.1

SEQ ID NO: 1621 - DNA, 2460 bp, Eucalyptus grandis
  Eucgr.I00453.1
atggaaagatcaattacagctttctcatttgcgctgcttgcttctttagcttcaacacttgtccttgtggtccaagcccagccaggttttatcaacatcgattgtggggcatcccatgactacaccgatgagaacactaatatagcatataaaatggatgatgggttcgttgactccgggaaaaacatgcagacatccggcacatcgtttcaagatattcgacagtatttgaacaatgtaaggatttttcccgatggaaggatgaattgttatactttgagaccagaccaaggcaaaaacagaacctactatatcagggcatggttttggtacaagaactataatgaggatcccgaggctcctgttttcaacaggcgtcctgttttcgacctgtacatcgatgttaattattgggccacggtggactacatttttggtgtcgaagagatcatgtatgtgcccaaggtagatgatatacgtgtgtgtcttgtgaacactggcaatggagtgccctttatttcggcgttggaactaagagctttggacgatggtatctattcatcgggatttgggctcttgcaaacccgtgggcggtaccctgacgacgtttatgatcggatctggacacctcagaacttcagtaactggaccagactgaaaaccacatctgtgattgatttatctaagaataataatgcatataaggttccctcggaagttcttcagaccgctcaaggaacaatgagttcgagttctcccttggagttcacaatttacattaacgataatcaattcaccaagacagtgagccttgaatacttaaagccagtggttgtagtttccactctagttagcgggccgctcatcattgtctcaattaattcgacgaataagtctggaaatccacctatcctcaatgccatggagttctataaggttgttgatcttccaaatgtacccacagcacaagatgatgtgaaagctatcaattatatcaaagcagcgtatcacattaagagagaaagctggcaaggtgatccatgcgtaccaagcgagttcacatgggatggtctaaattgtagttatggaaatcctccaagaattacatccctgaaactgaactctagcaatttgatgggccacatagtcccatcactttctcatctatcaatgatggaatacttagatttgtccgacaatcagcttacaggagaaataccggaaactctggctgaattaccaaatcttagctttctaaatttaagtggaaacaacctgattggatcagttcctgaagctcttaagaaaatggttgtggaaaataatttatacatgagtttgataggaaacacgaatctttgcctagctgatccttgcccgcataagaagaaacaaaacaccgtcattgttccagttgttacatccgtttcaggcttctttgtggttctttttggtgctttggctattatgtggttaatcaaacagaaacaaatggcagaatcttgtgagagaacgctgagattaaaggatcgaccttttaagtatggagagatttcaaaaatcactgggaactttggacgagtgattggagaaggtggatttggtaaggtatatcttggcacactagataatggcactgtagttgctgtgaagatgtgctctaaattgtcaaagcaagggtacaaggaatttcatgccgaggcacaactcttagcgattgtacaccatggaaatttggtttccttggttggatattgtgatgattctaagcacgtggcattaatatatgaatacatggctaatggaaatttaaggcaacatttatcaggtatcttttgtcatcatttctttggcattgttaacattgtttttgcgaaaatttcaggtttggattatttgcataatggttgcaagccacccatcctccacagagacttgaagacttcaaacatcttgttgaatgaagacttacgagccaaaatagctgattttggcctatcaagagcttttgcaactgaaaatgactcccatgtgtcaactcatccagcaggcactttcggctacctaggccccgagtttcaatcttctggaaactgtgacaagaagagcgatgtttacagttttggaattgtactttttgagttaatcacgggccaacctgcggtaatgagaggctgggatggcagccacttcatgcacatacttgaatggctaattcctatcgttgaaagtggtgatatacgaagggttatggatccaaggttacaaggagaattcgacatcaactcagcttggaaagtggtggagattgctatgtcttgtgcacaaccaagggtgattcataggccggacatatatcatgtattgacagagttgaaggagtctttggtgagcaaatcaagcggttcttttgaagtgacctctttggagatccattgtaacagtgtccctatagcaagg

SEQ ID NO: 1622 - protein, 820 aa, Eucalyptus grandis
  Eucgr.I00453.1
MERSITAFSFALLASLASTLVLVVQAQPGFINIDCGASHDYTDENTNIAYKMDDGFVDSGKNMQTSGTSFQDIRQYLNNVRIFPDGRMNCYTLRPDQGKNRTYYIRAWFWYKNYNEDPEAPVFNRRPVFDLYIDVNYWATVDYIFGVEEIMYVPKVDDIRVCLVNTGNGVPFISALELRALDDGIYSSGFGLLQTRGRYPDDVYDRIWTPQNFSNWTRLKTTSVIDLSKNNNAYKVPSEVLQTAQGTMSSSSPLEFTIYINDNQFTKTVSLEYLKPVVVVSTLVSGPLIIVSINSTNKSGNPPILNAMEFYKVVDLPNVPTAQDDVKAINYIKAAYHIKRESWQGDPCVPSEFTWDGLNCSYGNPPRITSLKLNSSNLMGHIVPSLSHLSMMEYLDLSDNQLTGEIPETLAELPNLSFLNLSGNNLIGSVPEALKKMVVENNLYMSLIGNTNLCLADPCPHKKKQNTVIVPVVTSVSGFFVVLFGALAIMWLIKQKQMAESCERTLRLKDRPFKYGEISKITGNFGRVIGEGGFGKVYLGTLDNGTVVAVKMCSKLSKQGYKEFHAEAQLLAIVHHGNLVSLVGYCDDSKHVALIYEYMANGNLRQHLSGIFCHHFFGIVNIVFAKISGLDYLHNGCKPPILHRDLKTSNILLNEDLRAKIADFGLSRAFATENDSHVSTHPAGTFGYLGPEFQSSGNCDKKSDVYSFGIVLFELITGQPAVMRGWDGSHFMHILEWLIPIVESGDIRRVMDPRLQGEFDINSAWKVVEIAMSCAQPRVIHRPDIYHVLTELKESLVSKSSGSFEVTSLEIHCNSVPIAR

SEQ ID NO: 1623 - DNA, 2169 bp, Eucalyptus grandis
  Eucgr.J02698.1
atgtacgtgtccccagcagatgatatccaagtgtgtcttgtcaatactggcaatggggtgcccttcatttcggcattggaactaagacatcttgatgatgatggcatctatcgattaaaatctggattcttggaactctttgatcgacgggacattggagctgccttggactctttcatcaggtaccctgacgatgtttacgatcggatttgggaagttgacgactatggagttgacgactatgattggaactttctgaacaccacatctgtcattaattcatctgacgataatgatgcttataactataaggttcccagtaaagttcttacgaccgctcgaagtacaatcaatgcccgtactgccttgtatttagagtggacaccttcaagctctacagagaaatggattgtgtacttttatttcgttgagattgagagactgataaacggcccccagagagagttcacagtttccatgaatgataatcaattcatggagatagtgagccttgaatacttaaagccagtggttgtagtctccactcctgttagtgggtcgtcactcatcaacttctcgattgaatcgacaaataagtccggaagtccaccaatcctcaatgccgtggagttctataccgttggtgatcttccaaatgtaccgacagcacaagatgatgtgaaagctattaaggacatcaaaacaacatatcacatccagaaagaaagctggcaaggtgacccatgtgtaccaagcaaatacacatgggatggtctaaattgtagcaatggaaatcctccaaggatcatatcattgaaattgggctcaagcaatttgatgggcgacatagtctcatcactgtcacgtctatcaaaaatggaagacttagatttgtccaacaatcagcttacaggagcaatactagaaactctggcagaattaccaaatcttagatttctaaatctaagtggaaacaacctaagtggatcagttcctgaagctcttaagaaaagggttctggacaatactttgatcatgagtttggcaggaaacccgaatctttgcctagccgatccttgcccgcagaagaagaaacaaaattccattctcgttctagttgtcacatcagtttcgggattctttttaattctctttggtgctttggctattgtttggttaattaaacggaaaagaagagcagaatctagtgaaatgacgttgagattaaagaatcgacctttcaagtatggagaggtttcaagaatcactagaaactttggacgagtgattggtgaaggtggatttggaaaggtttatcttggtacactagacgacggcaccatggttgctgtgaagattctctctaaatcatcaaagcaagggtacaaggaatttcaagctgaggcacaactcttaatgattgttcatcatggaaacttggtttctctatttggatattgtggtgattccaagcacatagctttaatatatgaatacatggtcaatggaaatttaaggcaacatttatcagaagaccatccaaaggtcttgacgtggagtaatagactacaaatagctgtggatgtagcacaaggtttggattatttgcataacggttgcaagccacccatcattcatagagacttgaagactacaaacatcttgttgaacgaagacttccgagccaaaatagctgattttggcctatcaagaacttttgcgactgaaaacgactcttatgtgtcaacttgtcctgcaggcactcctggctacctcgatcctgagtttcatttttctggaatcttaaataggaagagtgatgtttatagttttggaatcatactacttgagttgatcacgggccgacctgcaataatgagaagtcagggtggcagcgctagcatgcacttactgcagtggttgattcctattgttgaaagcggtgatataaagaggattatggatcccatgttacaaggaaaatttgacgtcaactcggcttggaaagtagtggagattgctatgtcctgtacgcgatcaacagcaagtcaaaggccagacataaatgatgtactggtagagttgaaggagtctttggggagcgaatcaagtggttcctttgaaatgacctccttgaagctccattcttacaatgcccctgtggcaagg

SEQ ID NO: 1624 - protein, 723 aa, Eucalyptus grandis
  Eucgr.J02698.1
MYVSPADDIQVCLVNTGNGVPFISALELRHLDDDGIYRLKSGFLELFDRRDIGAALDSFIRYPDDVYDRIWEVDDYGVDDYDWNFLNTTSVINSSDDNDAYNYKVPSKVLTTARSTINARTALYLEWTPSSSTEKWIVYFYFVEIERLINGPQREFTVSMNDNQFMEIVSLEYLKPVVVVSTPVSGSSLINFSIESTNKSGSPPILNAVEFYTVGDLPNVPTAQDDVKAIKDIKTTYHIQKESWQGDPCVPSKYTWDGLNCSNGNPPRIISLKLGSSNLMGDIVSSLSRLSKMEDLDLSNNQLTGAILETLAELPNLRFLNLSGNNLSGSVPEALKKRVLDNTLIMSLAGNPNLCLADPCPQKKKQNSILVLVVTSVSGFFLILFGALAIVWLIKRKRRAESSEMTLRLKNRPFKYGEVSRITRNFGRVIGEGGFGKVYLGTLDDGTMVAVKILSKSSKQGYKEFQAEAQLLMIVHHGNLVSLFGYCGDSKHIALIYEYMVNGNLRQHLSEDHPKVLTWSNRLQIAVDVAQGLDYLHNGCKPPIIHRDLKTTNILLNEDFRAKIADFGLSRTFATENDSYVSTCPAGTPGYLDPEFHFSGILNRKSDVYSFGIILLELITGRPAIMRSQGGSASMHLLQWLIPIVESGDIKRIMDPMLQGKFDVNSAWKVVEIAMSCTRSTASQRPDINDVLVELKESLGSESSGSFEMTSLKLHSYNAPVAR

SEQ ID NO: 1625 - DNA, 2151 bp, Eucalyptus grandis
  Eucgr.J02865.1
atgtacgtgtcccgagcagatgatatccaagtgtgtcttgtcaatactggcaatggggcgcccttcatttcggcattggaactaagacatatagatgatgatggcatctatcgattaagatctggattcttggaactctttgagcgactggacatcggaggtgcctcggactctttcatcaggtaccctgacgatgtttacgatcggatttggttccctggcaagaatatgaattggatccttctgagcaccacatctgtcattgattcatctgacgataatgatgcttataaggttcccattaaagttctttcaactgctgaaagtacaatcaatgccagtactcccttgcatttatactggataccttcaagctctgcagagaaatggattgtgtacttttatttcgttgagattgagagactgacaaacggcctccagagggagttcacagtttccatgaatgataatcaattcatggagatagtgagccttgaatacttaaagccagtggttgtagtctccactcctgttagtgggtcgtcggaaatgaccttctcgattgaatcgaaaaataagtccggaagtcccccaatcctcaatgccgtggagttctataccgttggtgatcttccatatgtacccacagcagaagatgatgtgaaagctattaatgacatcaaaacgacatatcacattcagaaagaaagctggcaaggtgacccatgtataccaagcatatacacatgggatggtctaaattgtagcaatggaaatcctccaaggatcatatcattgaaattgagctcaagcaatttggtgggcgacatagtctcatcactgtcacgtctatcaacaatggaagacttagatttgtccaacaataagcttacgggagcaataccagaaactctggcagaattaccaaatcttagatttctaaatctaagtggaaacaacctaattggatcagttcctgaagctcttaagaaaagggttctggacaatactttaatcatgagtttggcaggaaacacaaatctttgcctagccgatccttgcgtgcagaagaagaaacaaaattccatcctcgttccagttgttacatcagtttcaggcttctttttagttctctttggtgctttggctattgtttggttaatgaaacggaaaagaaaagcagaatctagcgaaatgacattgagattaaagaatcgacctttcaagtatggagaggtttcaagaatcactagaaactttggacgagtgattggtgaaggtggatttggaaaggtttatcttggcacactagatgacggcaccatggttgctgtgaagattctctctaaatcatcaaagcaagggtacaaggaatttcaagccgaggtacaactcttaatgattgttcgtcacgaaaacttggtttctctatttggatattgtggtgatttcaagcacatagctttaatatatgaatacatggtcaatggaaatttaaggcaacatttatcagaggaccatccgaaggtcttgacgtggagtaagagactacaaatagctgtggatgtagcacaaggtttggattatttgcataacggttgcaagccacccatcattcatagagacttgaagactacaaacatcttgttgaacgaagacttccgagccaaaatagctgattttggcctatcaagaacttttgccactgaaaacgactcttatgtgtcaacttgtcctacaggcactcctagctacctcgatcccgagtttcatttttctggaatcttaaataggaagagtgatatttatggttttggaatcatactccttgagttgatcacgggccgacctgcaataatgagaagtcagggtggtagtgccagcatgcacttacttcagtggttgattcctattgttgaaagtggtgatataaagaggattatggatcccatgttacaaggaaaattcgatgtcaactcggcttggaaagtagtggagattgctatgtcctgtacgcgatcaacagcaaatcaaaggccagacataaatgatgtactggtagagttgaaggagtccttggggagcaaatcaagtggttcctttggaatgacctcgttgaagctccattcttataatgcccctgtggcaagg

SEQ ID NO: 1626 - protein, 717 aa, Eucalyptus grandis
  Eucgr.J02865.1
MYVSRADDIQVCLVNTGNGAPFISALELRHIDDDGIYRLRSGFLELFERLDIGGASDSFIRYPDDVYDRIWFPGKNMNWILLSTTSVIDSSDDNDAYKVPIKVLSTAESTINASTPLHLYWIPSSSAEKWIVYFYFVEIERLTNGLQREFTVSMNDNQFMEIVSLEYLKPVVVVSTPVSGSSEMTFSIESKNKSGSPPILNAVEFYTVGDLPYVPTAEDDVKAINDIKTTYHIQKESWQGDPCIPSIYTWDGLNCSNGNPPRIISLKLSSSNLVGDIVSSLSRLSTMEDLDLSNNKLTGAIPETLAELPNLRFLNLSGNNLIGSVPEALKKRVLDNTLIMSLAGNTNLCLADPCVQKKKQNSILVPVVTSVSGFFLVLFGALAIVWLMKRKRKAESSEMTLRLKNRPFKYGEVSRITRNFGRVIGEGGFGKVYLGTLDDGTMVAVKILSKSSKQGYKEFQAEVQLLMIVRHENLVSLFGYCGDFKHIALIYEYMVNGNLRQHLSEDHPKVLTWSKRLQIAVDVAQGLDYLHNGCKPPIIHRDLKTTNILLNEDFRAKIADFGLSRTFATENDSYVSTCPTGTPSYLDPEFHFSGILNRKSDIYGFGIILLELITGRPAIMRSQGGSASMHLLQWLIPIVESGDIKRIMDPMLQGKFDVNSAWKVVEIAMSCTRSTANQRPDINDVLVELKESLGSKSSGSFGMTSLKLHSYNAPVAR

SEQ ID NO: 1627 - DNA, 2166 bp, Eucalyptus grandis
  Eucgr.J02863.1
atgtacgtgtcctcggcagatgatatacaagtgtgtcttgtcaatactggcaagggggtgcccttcatttcggcattggaactaagacatatagatgatgatggcatctatcgattaagatctggattcttggaactccaatggcgagaggacatcggaggtgccccggactctttcatcaggtaccctgacgatgtttacgatcggatttgggcgacgaaaaactatcctaattggatctctctagacaacacatctatcattaattcatctgacaatactgatgcatataaagttcccagcaaagttcttcagaccgctcaacgttcaatcaatgccagtactcccttgtatttacaatggaaaccttcaagctctgtagagacatggactgtgtatttttatttcgttgatattaagagactgacaaacggcctccagagggagttcacaatttccatgaatgataatcaattcagggagacagtgagccttgaatacttaaagccagtggttgtagtctccgctcctattagtgggttgcccatcaccttctcgattgaatcgataaataagtctggatatccaccgatcctcaatgccgtggagttctatgccattcgtgatcctccaaatgtacccacagcacaagatgatgtgaaatctattaatgacatcaaaacaacgtatcacattcggagagaaagctggcaaggtgacccatgtgtaccaagcaaatacacgtggaatggtctagattgtagctatggaaatcctccaaggattatatcattgaaattgagctcgagcaatttgacaggcgacatagtctcatcactgtcacatctgtcaacaatggaatacttagatttgtctgacaatcagcttacaggagtgataccagaaactctggcaggattaccaaatcttagatttctaaatttaagcagaaataacctgattggatcggttcctgaagctcttaagaaaagggtcgtggacagaactttaaacatgagcttggcaggaaacaagaatctttgcctagctgatccttgtccgcagaagaagaaacaaaattccatcctcattccaattgttacatcagtttcaagcttctttttagttctctttggtgctttagctatcgtttggttaattaaacagagacgaaaagcagaatctagtgaaataacgttgagattaaagaatcgacctttcaagtatacagaggtttcaagaatcactggaaattttggacgagtgattggtgaaggtggattcggaaaggtttatcttggtacactagataatggcaccacagttgctgtgaagactctctctaaatcatcaaagcaagggtacaaggaatttcaagctgaggtgcaactcttaatgcttattcatcacggaaacttggtttctttgtttggatattgtggtgattccaggcacattgctttaatatatgaatacatggccaacggaaatttaaggcaacatttatcagttaggatgcatccaacagaggaccatccaaaggtcttgacgtggagtaagagaatacaaatagctatggatgcagcaaaaggtttggattatttgcataatggttgcaagccacccatcatccatagagacttgaagactacgaacattttgttgaacgaagacttccaagccaaaatagctgattttggcctatcaaaaacttttgtgactcaaaatgactcttatgtgtcatcttgtcccgcgggcactcctggctacattgaccccgagtttcatttttctggaatctttaataggaagagtgatgtttatagttttggaatcatactctttgaattgatcacgggccaatctgcaataatgagaagccaggatggcaatgccagaatgcacatacttcaatggttgattcctattgttgaaagtggggatatagagaagattatggatccaatgttacaaggagaattcgacgtcaactcggcttggagagtaacggagatcgctatgtcctgtacgcgatcaacagcaagtcaaaggccggacataaatgatgtactagcagagttgaaagtgtctttggtgagcaaatcaagcggttcctttgaaattacctccccagagctccattctgacaatgcccctatggcaagg

SEQ ID NO: 1628 - protein, 722 aa, Eucalyptus grandis
  Eucgr.J02863.1
MYVSSADDIQVCLVNTGKGVPFISALELRHIDDDGIYRLRSGFLELQWREDIGGAPDSFIRYPDDVYDRIWATKNYPNWISLDNTSIINSSDNTDAYKVPSKVLQTAQRSINASTPLYLQWKPSSSVETWTVYFYFVDIKRLTNGLQREFTISMNDNQFRETVSLEYLKPVVVVSAPISGLPITFSIESINKSGYPPILNAVEFYAIRDPPNVPTAQDDVKSINDIKTTYHIRRESWQGDPCVPSKYTWNGLDCSYGNPPRIISLKLSSSNLTGDIVSSLSHLSTMEYLDLSDNQLTGVIPETLAGLPNLRFLNLSRNNLIGSVPEALKKRVVDRTLNMSLAGNKNLCLADPCPQKKKQNSILIPIVTSVSSFFLVLFGALAIVWLIKQRRKAESSEITLRLKNRPFKYTEVSRITGNFGRVIGEGGFGKVYLGTLDNGTTVAVKTLSKSSKQGYKEFQAEVQLLMLIHHGNLVSLFGYCGDSRHIALIYEYMANGNLRQHLSVRMHPTEDHPKVLTWSKRIQIAMDAAKGLDYLHNGCKPPIIHRDLKTTNILLNEDFQAKIADFGLSKTFVTQNDSYVSSCPAGTPGYIDPEFHFSGIFNRKSDVYSFGIILFELITGQSAIMRSQDGNARMHILQWLIPIVESGDIEKIMDPMLQGEFDVNSAWRVTEIAMSCTRSTASQRPDINDVLAELKVSLVSKSSGSFEITSPELHSDNAPMAR

SEQ ID NO: 1629 - DNA, 2148 bp, Eucalyptus grandis
  Eucgr.J02863.2
atgtacgtgtcctcggcagatgatatacaagtgtgtcttgtcaatactggcaagggggtgcccttcatttcggcattggaactaagacatatagatgatgatggcatctatcgattaagatctggattcttggaactccaatggcgagaggacatcggaggtgccccggactctttcatcaggtaccctgacgatgtttacgatcggatttgggcgacgaaaaactatcctaattggatctctctagacaacacatctatcattaattcatctgacaatactgatgcatataaagttcccagcaaagttcttcagaccgctcaacgttcaatcaatgccagtactcccttgtatttacaatggaaaccttcaagctctgtagagacatggactgtgtatttttatttcgttgatattaagagactgacaaacggcctccagagggagttcacaatttccatgaatgataatcaattcagggagacagtgagccttgaatacttaaagccagtggttgtagtctccgctcctattagtgggttgcccatcaccttctcgattgaatcgataaataagtctggatatccaccgatcctcaatgccgtggagttctatgccattcgtgatcctccaaatgtacccacagcacaagatgatgtgaaatctattaatgacatcaaaacaacgtatcacattcggagagaaagctggcaaggtgacccatgtgtaccaagcaaatacacgtggaatggtctagattgtagctatggaaatcctccaaggattatatcattgaaattgagctcgagcaatttgacaggcgacatagtctcatcactgtcacatctgtcaacaatggaatacttagatttgtctgacaatcagcttacaggagtgataccagaaactctggcaggattaccaaatcttagatttctaaatttaagcagaaataacctgattggatcggttcctgaagctcttaagaaaagggtcgtggacagaactttaaacatgagcttggcaggaaacaagaatctttgcctagctgatccttgtccgcagaagaagaaacaaaattccatcctcattccaattgttacatcagtttcaagcttctttttagttctctttggtgctttagctatcgtttggttaattaaacagagacgaaaagcagaatctagtgaaataacgttgagattaaagaatcgacctttcaagtatacagaggtttcaagaatcactggaaattttggacgagtgattggtgaaggtggattcggaaaggtttatcttggtacactagataatggcaccacagttgctgtgaagactctctctaaatcatcaaagcaagggtacaaggaatttcaagctgaggtgcaactcttaatgcttattcatcacggaaacttggtttctttgtttggatattgtggtgattccaggcacattgctttaatatatgaatacatggccaacggaaatttaaggcaacatttatcagaggaccatccaaaggtcttgacgtggagtaagagaatacaaatagctatggatgcagcaaaaggtttggattatttgcataatggttgcaagccacccatcatccatagagacttgaagactacgaacattttgttgaacgaagacttccaagccaaaatagctgattttggcctatcaaaaacttttgtgactcaaaatgactcttatgtgtcatcttgtcccgcgggcactcctggctacattgaccccgagtttcatttttctggaatctttaataggaagagtgatgtttatagttttggaatcatactctttgaattgatcacgggccaatctgcaataatgagaagccaggatggcaatgccagaatgcacatacttcaatggttgattcctattgttgaaagtggggatatagagaagattatggatccaatgttacaaggagaattcgacgtcaactcggcttggagagtaacggagatcgctatgtcctgtacgcgatcaacagcaagtcaaaggccggacataaatgatgtactagcagagttgaaagtgtctttggtgagcaaatcaagcggttcctttgaaattacctccccagagctccattctgacaatgcccctatggcaagg

SEQ ID NO: 1630 - protein, 716 aa, Eucalyptus grandis
  Eucgr.J02863.2
MYVSSADDIQVCLVNTGKGVPFISALELRHIDDDGIYRLRSGFLELQWREDIGGAPDSFIRYPDDVYDRIWATKNYPNWISLDNTSIINSSDNTDAYKVPSKVLQTAQRSINASTPLYLQWKPSSSVETWTVYFYFVDIKRLTNGLQREFTISMNDNQFRETVSLEYLKPVVVVSAPISGLPITFSIESINKSGYPPILNAVEFYAIRDPPNVPTAQDDVKSINDIKTTYHIRRESWQGDPCVPSKYTWNGLDCSYGNPPRIISLKLSSSNLTGDIVSSLSHLSTMEYLDLSDNQLTGVIPETLAGLPNLRFLNLSRNNLIGSVPEALKKRVVDRTLNMSLAGNKNLCLADPCPQKKKQNSILIPIVTSVSSFFLVLFGALAIVWLIKQRRKAESSEITLRLKNRPFKYTEVSRITGNFGRVIGEGGFGKVYLGTLDNGTTVAVKTLSKSSKQGYKEFQAEVQLLMLIHHGNLVSLFGYCGDSRHIALIYEYMANGNLRQHLSEDHPKVLTWSKRIQIAMDAAKGLDYLHNGCKPPIIHRDLKTTNILLNEDFQAKIADFGLSKTFVTQNDSYVSSCPAGTPGYIDPEFHFSGIFNRKSDVYSFGIILFELITGQSAIMRSQDGNARMHILQWLIPIVESGDIEKIMDPMLQGEFDVNSAWRVTEIAMSCTRSTASQRPDINDVLAELKVSLVSKSSGSFEITSPELHSDNAPMAR

SEQ ID NO: 1631 - DNA, 2613 bp, Eucalyptus grandis; identical to SEQ ID NO: 731
  Eucgr.J02704.1

SEQ ID NO: 1632 - protein, 871 aa, Eucalyptus grandis; identical to SEQ ID NO: 732
  Eucgr.J02704.1

SEQ ID NO: 1633 - DNA, 2241 bp, Eucalyptus grandis
  Eucgr.J02705.1
atggagatatccaaagaactcatcaacaagcaatcccgacaatggttgaaaaatctgagaagttttcccagtgggacgagaaattgctacaccttgaaaccagacaaaggcaagaacaacacctacttgattagggcatcattttggtatgcggactatgatgatgagaaccgaacgcctgtattcgacctatacatcgatgttaattattgggccacaattgatgcttttgatgaagtgcgccgcgaaattatctatgtggcccaaagggatgagatacaagtgtgcctcgtaaatattggtcaaggagtgccctttatctcggcattggaacttagacctttgaacaattctatctatcaaattgagagaggttttttgatgcttgggttcagagatgacgtcggaggcttaaattcgaccatcaggtacccggacgatgtttatgatcgcatctgggaaagttggagcccttccacctggcgtatactcaagcccgggaagtctgcctctgatttatccaataacaacgatgagtataaggttccaggggaagtcctgaggacagctcaaacgaatgacaccatgagctatacttatacgccggacaacgtgtcgtctaaatgtattgggtacttccatttcgccgaaacccaaatcttgccgagtggccagcaaagagagctcgcggtttccacaagcaatagccaattcaaggagacggtgagactcgagtacttgaagtcagtgaccgtagtttccactcccgtctccgggtcccagatcagcttctcattcgaagcaacaacgaggcagtctggatatctgccgccgatcatcaatgccttggagatctttgaaattaaagaacttccgaatgtaccaacagcccaagatgatgtcaaagctctcatcagtaccaaggcagagtatacagtgaataaaaatagctggaaaggtgatccatgtgtaccaagcaaatttgcgtgggagggtctgaattgtagctatggaaatcctccgagggttatttcgttagatctgtccaacaatcaacttacaggagccataccagaaactttggcaaatctgccaaagttgagaattctaaatctcagcggaaacaagcttaatggttcagttcctaatggtcttaaaagaagttgttgcatcggtttcagtattattcgtagttatctgtttggtcactatttggttgattacgaggaaacggataagaggaacctttttggtacagaatccagtgaaaggacgctgggattaaagaatcgaccttttaagtatggagaggtttcgagaatcactgggaactttgaacaagtgattggtgaaggtggatttggaaaggtatatcttggtacactagataacagcactatagttgcagtgaagatgctttctgaatcatcaaagcaaggggacaaggaatttcaagccgaggcacgactcttaatgattgttcaccacagaaacttagtttctctatttggatattgcaatgagtccaagcacatggcattgatatatgaatacatggcaaatggaaatttaaggcaacatttatcgggtgcgtttttatgtcctgttgtattgtttcttctcgaaaatgaaattgttaaactctattttgtgctcacagccataggtaaagttgaaatccattcaatagaggaccattcgaaggtcttgacttggcgtaagagactacatatagctgtggatgcagcacaaggtttggattatttgcataatggttgcaagccacccatcatccacagagacttgaagactacaaatatcttgttgaacgaagacttccaagccaaaataggtgattttggcctttcaagagcttttgcaactgaaaatgacatctatgtgtcaacttgccccgcgggcactcccggttacctcgatcccgagtttcaatcttctggaaacttaaccaagaagagtgatgtttatagtttcggaatcatactctttgagttgatcacgggccgacctgcaataatgagaagtcgggatggtagtgccagtgtgcacatacttgaatggttgattcctatcgtggaaagtggtgatatacatagcattatggatccaaggttacaaggagaattcgacatcaactcagcttggaaactagtggagattgctatgtcttgtacacgaccaacggcaattcaaaggccagatataaatcacatatggcagagt

SEQ ID NO: 1634 - protein, 747 aa, Eucalyptus grandis
  Eucgr.J02705.1
MEISKELINKQSRQWLKNLRSFPSGTRNCYTLKPDKGKNNTYLIRASFWYADYDDENRTPVFDLYIDVNYWATIDAFDEVRREIIYVAQRDEIQVCLVNIGQGVPFISALELRPLNNSIYQIERGFLMLGFRDDVGGLNSTIRYPDDVYDRIWESWSPSTWRILKPGKSASDLSNNNDEYKVPGEVLRTAQTNDTMSYTYTPDNVSSKCIGYFHFAETQILPSGQQRELAVSTSNSQFKETVRLEYLKSVTVVSTPVSGSQISFSFEATTRQSGYLPPIINALEIFEIKELPNVPTAQDDVKALISTKAEYTVNKNSWKGDPCVPSKFAWEGLNCSYGNPPRVISLDLSNNQLTGAIPETLANLPKLRILNLSGNKLNGSVPNGLKRSCCIGFSIIRSYLFGHYLVDYEETDKRNLFGTESSERTLGLKNRPFKYGEVSRITGNFEQVIGEGGFGKVYLGTLDNSTIVAVKMLSESSKQGDKEFQAEARLLMIVHHRNLVSLFGYCNESKHMALIYEYMANGNLRQHLSGAFLCPVVLFLLENEIVKLYFVLTAIGKVEIHSIEDHSKVLTWRKRLHIAVDAAQGLDYLHNGCKPPIIHRDLKTTNILLNEDFQAKIGDFGLSRAFATENDIYVSTCPAGTPGYLDPEFQSSGNLTKKSDVYSFGIILFELITGRPAIMRSRDGSASVHILEWLIPIVESGDIHSIMDPRLQGEFDINSAWKLVEIAMSCTRPTAIQRPDINHIWQS

SEQ ID NO: 1635 - DNA, 2505 bp, Eucalyptus grandis; identical to SEQ ID NO: 733
  Eucgr.J02905.1

SEQ ID NO: 1636 - protein, 835 aa, Eucalyptus grandis; identical to SEQ ID NO: 734
  Eucgr.J02905.1

SEQ ID NO: 1637 - DNA, 2412 bp, Eucalyptus grandis; identical to SEQ ID NO: 735
  Eucgr.J02909.1

SEQ ID NO: 1638 - protein, 804 aa, Eucalyptus grandis; identical to SEQ ID NO: 736
  Eucgr.J02909.1

SEQ ID NO: 1639 - DNA, 2406 bp, Eucalyptus grandis; identical to SEQ ID NO: 737
  Eucgr.J02909.2

SEQ ID NO: 1640 - protein, 802 aa, Eucalyptus grandis; identical to SEQ ID NO: 738
  Eucgr.J02909.2

SEQ ID NO: 1641 - DNA, 2400 bp, Eucalyptus grandis; identical to SEQ ID NO: 739
  Eucgr.J02909.3

SEQ ID NO: 1642 - protein, 800 aa, Eucalyptus grandis; identical to SEQ ID NO: 740
  Eucgr.J02909.3

SEQ ID NO: 1643 - DNA, 2445 bp, Eucalyptus grandis; identical to SEQ ID NO: 741
  Eucgr.J01421.1

SEQ ID NO: 1644 - protein, 815 aa, Eucalyptus grandis; identical to SEQ ID NO: 742
  Eucgr.J01421.1

SEQ ID NO: 1645 - DNA, 2442 bp, Eucalyptus grandis; identical to SEQ ID NO: 743
  Eucgr.J01421.2

SEQ ID NO: 1646 - protein, 814 aa, Eucalyptus grandis; identical to SEQ ID NO: 744
  Eucgr.J01421.2

SEQ ID NO: 1647 - DNA, 2046 bp, Eucalyptus grandis
  Eucgr.J01715.1
atgccggtgaacacccaaaccaactaccaacaacaatcaaagaatcttaggatcttccccactggagaaaggaattgttacacattaaagccaaatgaaggaaagggcaacacatatttggtcagggcttcattttggtatggggattatgatggcaagaatcaaaccccggtatttgacctctacattgatgtgaactattggaccacggtgaactcttcatcttggatatacgaagagattatatacactccttcaagagactatatacaagtttgcttggtgaataccagctcaggagttccattcttatcagctctcgacttgcggttgttggataagtcgatttaccaaatcaactctggtgcacttgtaaccagatggagatataatttagggagcaattacacgtacagacatccacaagatgtatatgatcgcatctggacgggtcggacttatgaaaagttccagtcagtcagcaacatgacagccatcgagacaagtacaagtgatgatgcctttaaagttccacctgaagttttgatgaccgccgtacaaacacaatctgtcactgctaatttgactctgcgatggtcatcaaacaactctgctaatgtttggtttatgtactttcactttgtggaattgcaactgcgaaagaaagatatccgagaactcacggtacttgtacagaataaagtcgtgaaaaccgtcatgctcgagaaccaaaggccggtgaccttaagctcatctcccataggtggaccatctttggacttgactattaatgcgacagaccgctctactctgccacctctcctcaatgccgtcgagattttcgccgaggcacaacttccactttcaccaacttttcttgatgacttcaatgctatgtatgatgtcaagagaacatatgaggtgatcgaggctagctggcagggggatccatgtgttcctagacagtactcatggagcggactccattgtagcaacgatagtgctccgagaatcatctcgttgaacctgagctttagtggactgaaaggacggatagatacattgatctcccatttgacagcagtcgaatccctggatttatccaacaactcgttaactgggtccgtacctgagtttttatcacaaatgccaagcttgaaagttctgaatttaagcggaaacaacttgaacggctctgttcctcaaactctcttgaagaagaaggcagatggcacgttgctactaaggttagatggaaatccaaatctttgccaatcagacaattgtccaaccagcaatgtgcagccgacgaaaaagggcatctctgttgctccaatcatcgcatcagttgcagctgttctggtcttgattttattgggagctcttgcagtattatggataatcagaagaagacaaatccaaaacgttactaccactactacgactaccaactctactggaggatctattgggacattcaggttgtcaaaaaatcaaccttttacacctactgaggttacaagaattactgatgacttcagaacagtaatcggagagggaggatttgggaaagtttactttggcaaacttgatgatggcactgaagtcgcagtaaaaatattatctcaatcatcaaagcaaggctacaaggagtttcgagcagaggcgcaactcctgatggtcgttcaccataaaaatctggtttcactcattggatattgcgaagaatatgaaagcatggcgctgatatatgaattcatgttcaatggaaatgttcggcaacatttgtcagcacaaaacgcgaatgttttaagttggagccagagactacaaatcgcaattgatgcagctcaagggttggagtacctacataatgggtgcaaaccccccattgtccatagggatttaaagacgcccaatattttactggacaaaaacatgcaagcgaagattgctgattttggattatcgaaggcatttgtgacagagcttgagtctcatatttcaactcacccagcagggacacctggttatctcgatccagag

SEQ ID NO: 1648 - protein, 682 aa, Eucalyptus grandis
  Eucgr.J01715.1
MPVNTQTNYQQQSKNLRIFPTGERNCYTLKPNEGKGNTYLVRASFWYGDYDGKNQTPVFDLYIDVNYWTTVNSSSWIYEEIIYTPSRDYIQVCLVNTSSGVPFLSALDLRLLDKSIYQINSGALVTRWRYNLGSNYTYRHPQDVYDRIWTGRTYEKFQSVSNMTAIETSTSDDAFKVPPEVLMTAVQTQSVTANLTLRWSSNNSANVWFMYFHFVELQLRKKDIRELTVLVQNKVVKTVMLENQRPVTLSSSPIGGPSLDLTINATDRSTLPPLLNAVEIFAEAQLPLSPTFLDDFNAMYDVKRTYEVIEASWQGDPCVPRQYSWSGLHCSNDSAPRIISLNLSFSGLKGRIDTLISHLTAVESLDLSNNSLTGSVPEFLSQMPSLKVLNLSGNNLNGSVPQTLLKKKADGTLLLRLDGNPNLCQSDNCPTSNVQPTKKGISVAPIIASVAAVLVLILLGALAVLWIIRRRQIQNVTTTTTTTNSTGGSIGTFRLSKNQPFTPTEVTRITDDFRTVIGEGGFGKVYFGKLDDGTEVAVKILSQSSKQGYKEFRAEAQLLMVVHHKNLVSLIGYCEEYESMALIYEFMFNGNVRQHLSAQNANVLSWSQRLQIAIDAAQGLEYLHNGCKPPIVHRDLKTPNILLDKNMQAKIADFGLSKAFVTELESHISTHPAGTPGYLDPE

SEQ ID NO: 1649 - DNA, 2478 bp, Eucalyptus grandis; identical to SEQ ID NO: 745
  Eucgr.J02925.1

SEQ ID NO: 1650 - protein, 826 aa, Eucalyptus grandis; identical to SEQ ID NO: 746
  Eucgr.J02925.1

SEQ ID NO: 1651 - DNA, 2457 bp, Eucalyptus grandis; identical to SEQ ID NO: 747
  Eucgr.J02912.1

SEQ ID NO: 1652 - protein, 820 aa, Eucalyptus grandis; identical to SEQ ID NO: 748
  Eucgr.J02912.1

SEQ ID NO: 1653 - DNA, 2136 bp, Eucalyptus grandis
  Eucgr.J02920.1
atgaagatgctgcatgtcttgattggttgtctagctctagcagtcattgctcgcgggcaacaaaatccaggtttcataagcatagattgcggagcacctaatgattaccatgatgaccagctcaacatatactacaaggctgatgcaggatacgtagattccggaacaaacgtgcaggtgtctacccaggtcatctgccaaaacaaccaacaacaatcaaagaatctccggatcttccctagtggagaaaggaattgttatacattaatgccagatgaaggaaagggcagcacatatttggtcagggcttcattttggtatggtaattatgatggcaaagatcaaaccccagcatttgacctccatattgatgttaactattggatcacggtgaactcttcgtcttggatatacaaagagattatttacactcctccgagagattacatacaaatttgtttggtgaatatcggcttgggagttccatttatatcagctctggagttgcggctgctggataactcaacttaccagatcaattccagtgcacttgtaaccaactggaaatataatttggggagcctaagcacatacatgcatccgcaagatgtatatgatcgcatctggaacaataagacttatagtggaggttggtcgtccgttagcaacgcgacggccatcgagacaatacaaaatgtcactgatcctctaagtctgttttggacctcggagaactccaccactgtctggtatatatacttccactttgtggaattgcaattggaaaagggtcaattcagagaattcgccatatatgtacaagacaaattcgtggaaacggtcatgctcgagaacctaaagccagtgaccgtagcctcattgcccataagtggacataatttgaacttgactattagtgcgacggcccgctctagtctgccaccgctcctcaatgccgtcgagaacctgagctccagtggactgaaaggaccgatagctacatcaatctccaatttgacagcagttgtatccctggatttatccaacaattcattaattggggccgtgccagactttttagctcaaatgccgagcttgaaagttctgaatttaagtggaaacaacatgaatggctctgttcctcaaactctgttgaagaagaaggcagatggatcgttgctattaagcttagatggaaatccaaatctttgccaatcagacaattgtcagaccagcaatgtgcagccaaagaaaaagggcatctctgttgccccaatcattgcatcagttgcagccattctggtcttggtttcattgggagctcttgcagtgttgtggataatcaaaagaagacaaatccaagacgttactactattactacaactaccaactctagcgaaggatatactgggacattaaagttgtcaaaaaatcgaccttttacatccactgaggttacaagaattactgataactttagaactgtaattggagagggaggatttgggaaagtctactttggcagacttgatgatggcattcaagtcgcggtaaaaatgttatctcgatcatcaaagcaaggctacaaggaatttcacgcagaggcacaactcttgatggttgttcaccacagaaatctagtttcacttatcggatattgcgaagaatttgaaaacatggcactgatttacgaattcatgtcaaatggaaatgttcggcaacatttgtcagggttagagtacctgcataatggctgtaaacctcccgttgtccatagagatttaaagacgcccaatattttactaaacgaaaacatgcaagcgaagattgctgattttggattatcgaaggcattgtttcatacatccggaaacttgagcaagaagagcgatgtatacagttttggcatagttttattcgagttaatcactggccaccccgacattataagaagtccagagggcagcatgcacatacttcgctgggtaactccactcatagaaagaggggacatccaaagcattgtcgacccgaggttaaatggccaattcaacatcggttctgcatggaaagcggttgagatagccatgtcgtgtgtgccgacgacagctgttcaaaggccggacatgaacacc

SEQ ID NO: 1654 - protein, 712 aa, Eucalyptus grandis
  Eucgr.J02920.1
MKMLHVLIGCLALAVIARGQQNPGFISIDCGAPNDYHDDQLNIYYKADAGYVDSGTNVQVSTQVICQNNQQQSKNLRIFPSGERNCYTLMPDEGKGSTYLVRASFWYGNYDGKDQTPAFDLHIDVNYWITVNSSSWIYKEIIYTPPRDYIQICLVNIGLGVPFISALELRLLDNSTYQINSSALVTNWKYNLGSLSTYMHPQDVYDRIWNNKTYSGGWSSVSNATAIETIQNVTDPLSLFWTSENSTTVWYIYFHFVELQLEKGQFREFAIYVQDKFVETVMLENLKPVTVASLPISGHNLNLTISATARSSLPPLLNAVENLSSSGLKGPIATSISNLTAVVSLDLSNNSLIGAVPDFLAQMPSLKVLNLSGNNMNGSVPQTLLKKKADGSLLLSLDGNPNLCQSDNCQTSNVQPKKKGISVAPIIASVAAILVLVSLGALAVLWIIKRRQIQDVTTITTTTNSSEGYTGTLKLSKNRPFTSTEVTRITDNFRTVIGEGGFGKVYFGRLDDGIQVAVKMLSRSSKQGYKEFHAEAQLLMVVHHRNLVSLIGYCEEFENMALIYEFMSNGNVRQHLSGLEYLHNGCKPPVVHRDLKTPNILLNENMQAKIADFGLSKALFHTSGNLSKKSDVYSFGIVLFELITGHPDIIRSPEGSMHILRWVTPLIERGDIQSIVDPRLNGQFNIGSAWKAVEIAMSCVPTTAVQRPDMNT

SEQ ID NO: 1655 - DNA, 2631 bp, Populus trichocarpa; identical to SEQ ID NO: 749
  POPTR_0019s12400.1

SEQ ID NO: 1656 - protein, 877 aa, Populus trichocarpa; identical to SEQ ID NO: 750
  POPTR_0019s12400.1

SEQ ID NO: 1657 - DNA, 2013 bp, Populus trichocarpa
  POPTR_0019s12850.1
tacaaagatgacgtgtacgatcgcatatggcggtttgacgtcaacctcaccgattcagtttcaaatggcaccgaaacaaatattgatatccagggcagtgatgatccctgccgtctacctgtcgaagtcttgagaacggcggttcagcctcgaaatggccttaattcattgagctacagctatccatcaccgcatacagagaatttcacacctgagtttcttgtcttctttcattttgctgaaatattcgagcagactgcaataggcaaattacgagaattcaccattactttgaatggcttaaactatggtccctttacccttgaatacttgaagccattgaccatacgttcaaatataactcaagttcaagaaggtcaagttaggttttctattgatgcaacgttgcggtctgaccttccacctatcctaaatgcctttgagatcttcaaactattgccactccctgattcaccgacaaaccaaacagacgttgatgcaatcatggccatcaaggaagcatacaaaatagatagagttgactggcagggagatccatgtttgccacttattacgtggactggtttgcagtgcaacgatgataaccctccaaggatcatctctatgaatctaagttcaagtcaattatcagggaatatagctgtttcactcttgaacctcacagcaatcaagtccttgaatttatcaaacaatgaattgacagggacagtgccagaagcttttgcgcagctaccagatcttactatcctagatttgagcgggaacaaactcacaggtgcagttccccatagtctcaaggaaaagtctaacaatggacagttgaagctgagtttggatggaaatctggatttatgcaagttggatacatgtgaaaagaagcagcgaagttttcctgttccagttattgcatctgtcatatcagttttggtgctcctcctccttagcattataactatcttctggaggttgaaaagagtgagatggaatgtgtcattatcttcctcagtgggcttatcgagaaaagaattgtcactgaaatcaaagaatcaaccatttacatacgttgaaatagttagcattaccaacaatttccaaaccattattggagaaggaggatttggaaaagtatatcttggcaacctgaaagatggtcgtcaagttgctgtcaagttgttatctcaatcctcaaggcaaggttataaagaatttctagcggaggtccaactattgatgattgttcatcacaaaaacttggtgtccctcgttggttactgtaatgagcatgaaaatatggcacttgtttatgaatacatggcaaatgggaacttgaaggagcaactgttagaaaatagcacaaatatgttgaattggagggaaaggctgcaaattgcagtagacgcagcacaaggtttggaatatctgcataatggttgtaggccgccaatagtccatagagatttgaaatcatcaaacatcttattaactgaaaaccttcatgccaagattgctgattttgggttgtccaaagccttcgcaaccgaagaagattcgcatgtcataactgttcctgcaggcacgcccggatacattgatcctgaatttcgagcatcaggacacttaaataagaaaagtgatgtttacagctttggtattcttctgtgtgagctaataactggtcaaccgcctttaataaggggccataaaggccacactcatatacttcaatgggtgagtcctctagttgaaagaggtgatatccagagcattatcgatccaaggttgcaaggtgaattcaacactaattatgcttggaaagctctggagatagcattgtcctgcgtgccctcgacttcaacacaaaggccggacatgagtgatattttgggagagctaaaggaatgtctggccatggagatgtcatctgaaataagcatgcgcggttccgttgaaatgagcttggtgcctggcacagatatggctccaaatcttagg

SEQ ID NO: 1658 - protein, 671 aa, Populus trichocarpa
  POPTR_0019s12850.1
YKDDVYDRIWRFDVNLTDSVSNGTETNIDIQGSDDPCRLPVEVLRTAVQPRNGLNSLSYSYPSPHTENFTPEFLVFFHFAEIFEQTAIGKLREFTITLNGLNYGPFTLEYLKPLTIRSNITQVQEGQVRFSIDATLRSDLPPILNAFEIFKLLPLPDSPTNQTDVDAIMAIKEAYKIDRVDWQGDPCLPLITWTGLQCNDDNPPRIISMNLSSSQLSGNIAVSLLNLTAIKSLNLSNNELTGTVPEAFAQLPDLTILDLSGNKLTGAVPHSLKEKSNNGQLKLSLDGNLDLCKLDTCEKKQRSFPVPVIASVISVLVLLLLSIITIFWRLKRVRWNVSLSSSVGLSRKELSLKSKNQPFTYVEIVSITNNFQTIIGEGGFGKVYLGNLKDGRQVAVKLLSQSSRQGYKEFLAEVQLLMIVHHKNLVSLVGYCNEHENMALVYEYMANGNLKEQLLENSTNMLNWRERLQIAVDAAQGLEYLHNGCRPPIVHRDLKSSNILLTENLHAKIADFGLSKAFATEEDSHVITVPAGTPGYIDPEFRASGHLNKKSDVYSFGILLCELITGQPPLIRGHKGHTHILQWVSPLVERGDIQSIIDPRLQGEFNTNYAWKALEIALSCVPSTSTQRPDMSDILGELKECLAMEMSSEISMRGSVEMSLVPGTDMAPNLR

SEQ ID NO: 1659 - DNA, 2076 bp, Populus trichocarpa; identical to SEQ ID NO: 753
  POPTR_0144s00240.1

SEQ ID NO: 1660 - protein, 692 aa, Populus trichocarpa; identical to SEQ ID NO: 754
  POPTR_0144s00240.1

SEQ ID NO: 1661 - DNA, 2343 bp, Populus trichocarpa; identical to SEQ ID NO: 751
  POPTR_0086s00230.1

SEQ ID NO: 1662 - protein, 781 aa, Populus trichocarpa; identical to SEQ ID NO: 752
  POPTR_0086s00230.1

SEQ ID NO: 1663 - DNA, 2289 bp, Populus trichocarpa
  POPTR_0086s00270.1
atgatattgccattgagtcacattctaccgagcaaatttctgtgcattttacttcacaggtatctttatagtagagataatcagtctaatcgtttggttttctcttctaaccaaaattctgaaggtttcatcagcattgattgtggggcggaggaagattatctggataggaatactggaatatcttacaaatccgacaaagatttcattagtacgggcaagaataaggtcgtagctccagagtattcctataggaaattggtgaatagcttgagaacctttcctgaaggtaaaaggaattgttatacattgaaacctagagaggaatcaaactcaaatgtttgcgacatattactggaatacctcggggttaactattgggacacagtggatattaatgtcgaagatatgtttgcgacatattacgaaattattcattattcagtaactgataccatttatgtgtgtctcgtaaatacgggttccggagttcctttcatcaatggattggatttacggttcatgaatgattccccgtatagaactatgaatcgattttacaatgatgacgtgtatgatcgcatctggcggcttgacgtcaacctcaacgattcagtgtcaattagcaccgaaacaaatattgatatccagggcagtgataatccctgccgtctaccagtcgaagtcttgagaacagcggttcagcctcgaaatggccttaattcattgagctacaactatacacggtatacagagaattctgagtttcatgtcttctttcactttgctgaaatcgagcagattgcaccaggcgaaatacgagaattcaccattactttgaatggtttaaactatgggctctttacccttgaatacttgaagccattgaccataggtccatataaattacaagatcaagttaggttttctattgatgcaacgttgcggtctgaccttccacctatcctaaatgcctttgagatcttcaaactatggccactccctgattcaccgacaaaccaaacagacgttgatgcaatcatggccatcaagaaagcatacaaaatagatcgagttgactggcaaggagatccatgtttaccatttactacgtggtctggtttgcagtgcaacaatgataatcctccaaggatcatctcgctgaatctaagttcaagtcaattatcagggaatatagttgtttcactcttgaacctcacagcaatccaatccttatatttgagcaggaacaaactcacaggtgtagttccccgtagtctcaaggaaaagtctaacagtggacagttgcagctgagaaaagaattgtcactgaaatcaaagaatcaaccatttacatacactgaaatagttagcattaccaataatttccaaaccattattggagaaggaggatttggaaaagtatatcttggcaacctaaaagatggccgccaagttgctgtcaagttgttttctcaatcctcaaggcaaggttataaagaatttctagcggaggtcgaactattgatgattgttcatcacagaaacttggtatccctggttggttactgtaatgagcatgaaaatatggcacttgtttatgaatacatggcaaatgggaacttgaaggagaaattgttagaaaataacacaaatatgttgaattggagggaaaggctgcaaattgcagtagacgcagcacaaggtttggaatatctgcataatggttgtaggccgccaatagtccatagagatttgaaatcatccaacatcttattaactgaaaaccttcaagccaagattgctgatttcgggctgtccaaagccttcacaaccgaaggagactcacatgtcataactgatcctgcaggcacgcccggatacattgatcctgaatttcaagcatcaggaaacttaaataagaaaagtgatgtttatagcttcggtattcttttgtgtgagctaataaccggtcaaccgcctttaataaggggccataagggccacactcacatacttcaatgggtgagtcctctagttgaaagaggggatatccagagcattatagatccaaggttgcaaggtgaattcaacactaattgtgcttggaaagctctggagatagcactgtcctgcgtgcccccgacttcaacacaaaggccggacatgagtgatattttgggagagctaaaggaatgtctggtcatagagatgtcatctaaaatgagcatgcgcgattccgtcaaaattagcttggtgcttggcacagatatggctccaaatcttagg

SEQ ID NO: 1664 - protein, 763 aa, Populus trichocarpa
  POPTR_0086s00270.1
MILPLSHILPSKFLCILLHRYLYSRDNQSNRLVFSSNQNSEGFISIDCGAEEDYLDRNTGISYKSDKDFISTGKNKVVAPEYSYRKLVNSLRTFPEGKRNCYTLKPREESNSNVCDILLEYLGVNYWDTVDINVEDMFATYYEIIHYSVTDTIYVCLVNTGSGVPFINGLDLRFMNDSPYRTMNRFYNDDVYDRIWRLDVNLNDSVSISTETNIDIQGSDNPCRLPVEVLRTAVQPRNGLNSLSYNYTRYTENSEFHVFFHFAEIEQIAPGEIREFTITLNGLNYGLFTLEYLKPLTIGPYKLQDQVRFSIDATLRSDLPPILNAFEIFKLWPLPDSPTNQTDVDAIMAIKKAYKIDRVDWQGDPCLPFTTWSGLQCNNDNPPRIISLNLSSSQLSGNIVVSLLNLTAIQSLYLSRNKLTGVVPRSLKEKSNSGQLQLRKELSLKSKNQPFTYTEIVSITNNFQTIIGEGGFGKVYLGNLKDGRQVAVKLFSQSSRQGYKEFLAEVELLMIVHHRNLVSLVGYCNEHENMALVYEYMANGNLKEKLLENNTNMLNWRERLQIAVDAAQGLEYLHNGCRPPIVHRDLKSSNILLTENLQAKIADFGLSKAFTTEGDSHVITDPAGTPGYIDPEFQASGNLNKKSDVYSFGILLCELITGQPPLIRGHKGHTHILQWVSPLVERGDIQSIIDPRLQGEFNTNCAWKALEIALSCVPPTSTQRPDMSDILGELKECLVIEMSSKMSMRDSVKISLVLGTDMAPNLR

SEQ ID NO: 1665 - DNA, 2334 bp, Eucalyptus grandis
  Eucgr.C00943.1
atgaaagatgatggtggagatgtcaatcggttcccttcagctgctcttcctttgcattctcactgcagttccagcaaatgggcagcttcaaacaggaacatctcctctgactatgcatacccgaacaaccccattctgcctcagccactttcggatctccgaagctttcctcaaggaaacaagaactgttacaccctaagacctgctgcgggtaacgccagcttatatttaataagagctagtttcttttatgcaaactatgatggactcaatgctccgcctcagttcgatctttatctcgatgccaatctctggttaacggtgaaattcagcaatacttctgacatcgtgacttcagagactgtcagttttgcatcttcggaggctatttacgtttgtctcgtgaacattggtgtgggaattcctttcatatcggcattggagcttaggccgctgaacagttcgacatatgactccgaatatgggaaatctgcttcattacttctctttcaaaggttgaatgtcggttcaatcgagggaagtgttgagccgcttcagagaaacgtttcaagaaaattcaatatatcatggaatggatctcaaatctctgggccttttagtccgctctacctctatgcagccacgatatctaactcaaaagccttggtgggaggtgaacatcgaatcatgatctataaaacagctgattcagctcttccgcccatactgaatgctgttgagatctacatggcgaggttgttggatgaattgctaacaaacagcgaagatgtcaatgctttgctcagtgtcaaaacaacatatcaaataaagaagaactgggcgggcgatccatgtgggccaaagaagtacccatgggaagggctcacatgcaactacggcagttcgattccccctcatgtaatctacctgaacttaagctcgagcaaattgaatggggcaattactgctgctttggtagaactttcgtcattggaatccttggacctgtcgaacaatagcttaaccggaccagtgccggagttcttggaagaactcaaaaacttgaagtacctggacttgagaggcaacaatctgtcaggagctgtgcctaaagctcttttagaaagatcgaatgtggggtcgctcacattgagtgtcgatgaacaaaacctctgtggctctgcttcttgcaaaaggaagaagggtatcatcattcccatcgtttcatcattgtcatcagtgatggccctatgtgctgccctggtggtgctctggaaactaagaagaaaatggaaatcaggcacaggttctccgaatgaggagggaagatatttagcatcagagaagaggcatttcacatatcctgaggtagtaagcatgacaaacaacttccagacagttattgggaagggcggattcggtgatgtctacctcggcatcatgaatgaaggaacccaagttgcagtgaagatgctatctgcatcatcttcacaagggctcagagaattccgaactgaggctgaacttctaatgcgaattcaccataagaacttggcctccttcattggatattgtgatgagagcaacaaaatggtgctgatatacgaatacttggctaagggcaatctgaaaaattatctttcagacagtgattcacgttcattgagttgggaatcaaggcttcgcatcgcaatagacgctgcacaaggactcgagtatttacaccatggatgcaaaccgccgattgttcacagagacgtgaagactgccaacattctattgagcgaaagcatggaggctaaaatagcagattttggactttccaaggttatccccagtgacggccttagtaacatgacgacttccgtcgtgggtactactggatatcttgacccagagtactacatttctcgcaaactgaacgagaaaagcgatgtctacagtttcggcattgttcttttggagctgatcacgggacagcccgcaatcatcaaagccgaaatgccagtccatattctggaatgggtgagtcctttcattcaaagaggggatatcctagaccttgtcgatcaaaggttgcagggagactttgacgagagttcggcacgtagagcggtagagatagcaacggcatgcgcagcatccacgtccctacatcgaccgaccatgggttacgtgttgccagagcttaagcactgcttggaaatggagttgtccaggggcttggaaagaactcccggaccgagggacgaggcaatcagcacgacggtttcgacaagttcgccggaaattcagtcgaccaactttgattctatgtcagctatttcgccaagg

SEQ ID NO: 1666 - protein, 778 aa, Eucalyptus grandis
  Eucgr.C00943.1
MKDDGGDVNRFPSAALPLHSHCSSSKWAASNRNISSDYAYPNNPILPQPLSDLRSFPQGNKNCYTLRPAAGNASLYLIRASFFYANYDGLNAPPQFDLYLDANLWLTVKFSNTSDIVTSETVSFASSEAIYVCLVNIGVGIPFISALELRPLNSSTYDSEYGKSASLLLFQRLNVGSIEGSVEPLQRNVSRKFNISWNGSQISGPFSPLYLYAATISNSKALVGGEHRIMIYKTADSALPPILNAVEIYMARLLDELLTNSEDVNALLSVKTTYQIKKNWAGDPCGPKKYPWEGLTCNYGSSIPPHVIYLNLSSSKLNGAITAALVELSSLESLDLSNNSLTGPVPEFLEELKNLKYLDLRGNNLSGAVPKALLERSNVGSLTLSVDEQNLCGSASCKRKKGIIIPIVSSLSSVMALCAALVVLWKLRRKWKSGTGSPNEEGRYLASEKRHFTYPEVVSMTNNFQTVIGKGGFGDVYLGIMNEGTQVAVKMLSASSSQGLREFRTEAELLMRIHHKNLASFIGYCDESNKMVLIYEYLAKGNLKNYLSDSDSRSLSWESRLRIAIDAAQGLEYLHHGCKPPIVHRDVKTANILLSESMEAKIADFGLSKVIPSDGLSNMTTSVVGTTGYLDPEYYISRKLNEKSDVYSFGIVLLELITGQPAIIKAEMPVHILEWVSPFIQRGDILDLVDQRLQGDFDESSARRAVEIATACAASTSLHRPTMGYVLPELKHCLEMELSRGLERTPGPRDEAISTTVSTSSPEIQSTNFDSMSAISPR

SEQ ID NO: 1667 - DNA, 2199 bp, Glycine max
  Glyma01g00790.1
atggaaataatcagtgtggcacaatcaggtgtcacacatgtttgccttgtgaacaagggagcaggaactccttttatctcaggcttggaacttagaccacttaatagttctatttatgacactgagtttggagaatctgcttcactgtcacttttcaaacgatgggacattgggtctaccaatggaagtggtagatatgaggatgatatttatgatagaatctggtcccccttcaattcctcatcctgggaatctgtcaacacttccacaccaataaatgtcaatgatgatggctatagacccccatttaaagtcattagaactgctgctagaccaaggaatggcagtgatactttggaattttcttggacccctgatgatccgagttggaaattttatgtctacttgtactttgctgaagtggaacagcttgagaaaacccaactgaggaaattcaatatagcttggaatggatctccattgtttgatgattccctaataccgcgccacttgtttgcaaccactctttctaattcaaaatccttggtagcaaatgaacataagatttctatccacaaaacaaaagattcaactcttccacccattcttaatgcggttgagatttatgtagcaagacagctagatgcccttgcaacatttgaagaagatgttgatgctattctgtccataaaggaaaactatagaattcaaagaaattgggtgggtgatccatgtgagccaaagaactactcttgggaaggtttaaaatgcaactatagcacctcacttcctccccgaattatatctctgaatatgagctcaagcagtttgagtggaataataacttctgccatttccaatctctcctcgttggaatctttggacttacataacaatagcttaactggagcaatgcctcagtttttggaagaattgatatcccttaaatatttggatttaaagggcaatcaattttcaggatctgttcctaccattcttttagaaagatcaagggctggattactcacattgagggtggatgatcaaaatctcggggacacaggagggaacaataaaaccaagaaaattgttattcccgtagtggtatcagtatcagttttagttatattgattgctttcactctcttttggaaacttagaagaaatgaacgatcagacgaggagattagtatgctcaacaaaggaggaaaaaccgtaacaacgaagaactggcaatacacatattcagaggtgttggacatcaccaacaactttgaaatggcaattggtaagggaggatttggaactgtgtactgtggggagatgaaagatggcaaacaagttgcagtcaagatgctttctccatcatcatctcaagggccaaaggaatttcggactgaggctgagcttttgatgacagttcatcacaaaaatttggtatccttcgttggctactgtgatgatgataacaagatggcactcatttacgagtacatggccaatggcagcctgaaagattttctcttgctctcagatggaaattcacattgcttgagttgggaaaggagaatacagatagcaatcgatgctgcagaggggttggattacctacaccatggatgcaagccaccaataatacacagggatgtaaagtcagccaacattcttttaagtcaagactttgaagctaagatagcagattttggcctctccagggagtttaggaaagataaccaagatcaacaatttcaagtcattcacaaagatgctacatatgaaaaatctgcagtaatgggcacaacagggtaccttgatccagagtactacaaattagggagactgaatgagaaaagtgacatctatagttttggaattgttctactggaattactcacaggtcgccctgcaatattaaaaggcaaccgagtaatgcacatacttgagtggataagacctgagcttgaaagaggagatttgagtaaaattatagatccaaggctccaaggaaaatttgatgctagttctgggtggaaagctttaggaatagcaatgtcatgctctacatcaacctccattcagagacctacaatgagtattgtgatagcagagctgaaacagtgcttgaaattggaatcccctaaatataatttcaattttctcatacctcaatctttgcgggtattagtagtaaataatcta

SEQ ID NO: 1668 - protein, 733 aa, Glycine max
  Glyma01g00790.1
MEIISVAQSGVTHVCLVNKGAGTPFISGLELRPLNSSIYDTEFGESASLSLFKRWDIGSTNGSGRYEDDIYDRIWSPFNSSSWESVNTSTPINVNDDGYRPPFKVIRTAARPRNGSDTLEFSWTPDDPSWKFYVYLYFAEVEQLEKTQLRKFNIAWNGSPLFDDSLIPRHLFATTLSNSKSLVANEHKISIHKTKDSTLPPILNAVEIYVARQLDALATFEEDVDAILSIKENYRIQRNWVGDPCEPKNYSWEGLKCNYSTSLPPRIISLNMSSSSLSGIITSAISNLSSLESLDLHNNSLTGAMPQFLEELISLKYLDLKGNQFSGSVPTILLERSRAGLLTLRVDDQNLGDTGGNNKTKKIVIPVVVSVSVLVILIAFTLFWKLRRNERSDEEISMLNKGGKTVTTKNWQYTYSEVLDITNNFEMAIGKGGFGTVYCGEMKDGKQVAVKMLSPSSSQGPKEFRTEAELLMTVHHKNLVSFVGYCDDDNKMALIYEYMANGSLKDFLLLSDGNSHCLSWERRIQIAIDAAEGLDYLHHGCKPPIIHRDVKSANILLSQDFEAKIADFGLSREFRKDNQDQQFQVIHKDATYEKSAVMGTTGYLDPEYYKLGRLNEKSDIYSFGIVLLELLTGRPAILKGNRVMHILEWIRPELERGDLSKIIDPRLQGKFDASSGWKALGIAMSCSTSTSIQRPTMSIVIAELKQCLKLESPKYNFNFLIPQSLRVLVVNNL

SEQ ID NO: 1669 - DNA, 2655 bp, Glycine max; identical to SEQ ID NO: 757
  Glyma07g15270.1

SEQ ID NO: 1670 - protein, 885 aa, Glycine max; identical to SEQ ID NO: 758
  Glyma07g15270.1

SEQ ID NO: 1671 - DNA, 1986 bp, Glycine max
  Glyma07g15270.2
atggcaagttcaatcgggtgcatactgttgttgacactttgtgttgtcctcgtagctttagttcatgcacagcaacaaataggcttcataagcattgattgcgggagtagtccaccaaataatgagtacacagatgacataactaaaataaggtacaccactgatggagcctatatacaaactggggttaataagaatatctcctctgagtatgcatacccaaagaatccgaatctgccactaccactctcagatctcagaagctttcctcagggagaaaggaactgctataggttagtagccggaagaagaggcagtttacatttgataagggcttccttcttgtatggaaactatgatggagtaaacaagccaccagagtttgatctctatgttgatgtcaagttttggtcaacagtcaaatttagaaatgcctcagaagaagttactatggaaataataagtgtggcagaatcaggtgtcacacatgtttgccttgtgaataagggagcaggaactccttttatctcaggattggaacttagaccacttaatagttctatttatagcactgagtttggggaatctgcttcactgtcacttttcaaacgatgggacattgggtcactcaatggaagtggtagatatgaagatgatatttatgatagaatatggtcccccttcaattcctcatcctgggaatctgtcagcacttccacaccaataaatgtcaatgatgatggatttagaccaccatttgaagtcattagaactgctgctagaccaaggaatggcagtgatactttggaattttcttggaccccagatgatccgagttggaaattttatgtctacttgtactttgctgaagtggaacagctggagaaaacccaactgaggaaattcaatatatcttggaatggatctccattgtttgatgattctctagtaccgcgccacttgtttgcaaccactctttccaattcaaaatccttggtagcaaatgaacataggatttctatccacaaaacaaaagattcaacgcttccacccattcttaatgcagttgagattttcgtagcaagacagctagatgcccttgcaacatttgaacaagatgttgatgctattctgtccataaaggaaagctatagaattcaaagaaattgggtgggtgatccatgtgagccaaagaactattcttgggaaggcttaaaatgcaactatagcacctcacttcctccccgaattatatctctgaatatgagctctagcagtttgagtggaataataacttctgccatttccaatctctcctcgttggaatctttggacttacataacaatagcttaactggaacaatgcctcagtttttggaagaattgaaatcccttaaatatttggatttaaaggacaatcaattttcaggttctgttcctaccattcttgtagaaagatcaagggatggattactcacgttgagagtggatgatcaaaatctcggtgactcaggagggaacaataaaaccaaggaaattgtcattcccatagtggtatcagtatcagttttagttatagtggttgctttcattctcttttggaaacttagaagaaatgaacgatcagacgaggagattagtacgctcagcaaaggaggaacaactgtaacaacgaagaactggcaatactcgtattcggaggtcttggacatcaccaacaactttgaaatggcaattggtaagggaggatttggaactgtgtactgtgggaagatgaaagatggcaaacaagttgcagtcaagatgctttctccatcatcatctcaagggccaaaggaatttcagactgaggctgagcttttgatgacagttcatcacaaaaatttggtatccttcgttggttactgtgataatgataacaagatggcactcatatacgagtacatggccaatggcagcgtgaaagattttatcttgctctcaggg

SEQ ID NO: 1672 - protein, 662 aa, Glycine max
  Glyma07g15270.2
MASSIGCILLLTLCVVLVALVHAQQQIGFISIDCGSSPPNNEYTDDITKIRYTTDGAYIQTGVNKNISSEYAYPKNPNLPLPLSDLRSFPQGERNCYRLVAGRRGSLHLIRASFLYGNYDGVNKPPEFDLYVDVKFWSTVKFRNASEEVTMEIISVAESGVTHVCLVNKGAGTPFISGLELRPLNSSIYSTEFGESASLSLFKRWDIGSLNGSGRYEDDIYDRIWSPFNSSSWESVSTSTPINVNDDGFRPPFEVIRTAARPRNGSDTLEFSWTPDDPSWKFYVYLYFAEVEQLEKTQLRKFNISWNGSPLFDDSLVPRHLFATTLSNSKSLVANEHRISIHKTKDSTLPPILNAVEIFVARQLDALATFEQDVDAILSIKESYRIQRNWVGDPCEPKNYSWEGLKCNYSTSLPPRIISLNMSSSSLSGIITSAISNLSSLESLDLHNNSLTGTMPQFLEELKSLKYLDLKDNQFSGSVPTILVERSRDGLLTLRVDDQNLGDSGGNNKTKEIVIPIVVSVSVLVIVVAFILFWKLRRNERSDEEISTLSKGGTTVTTKNWQYSYSEVLDITNNFEMAIGKGGFGTVYCGKMKDGKQVAVKMLSPSSSQGPKEFQTEAELLMTVHHKNLVSFVGYCDNDNKMALIYEYMANGSVKDFILLSG

SEQ ID NO: 1673 - DNA, 942 bp, Arabidopsis thaliana
  AT1G57560.1
atgaagagacattcttgttgttacaaacaaaagctgagaaaaggtctttggtctcctgaagaagatgagaaacttctcaattacattaccaaacatggccatggttgctggagttctgtccctaaactcgcaggtctcgagagatgtggaaagagctgtagactcagatggatcaattacttaagacctgatttaaagagaggagctttctcttcagaggaacagaatctcattgtcgagcttcatgctgttcttggaaacagatggtcgcaaattgctgcgaggcttcccgggagaaccgacaacgagataaagaacttgtggaattcgtgcattaagaagaagctgatgaagaaaggcattgaccctattacacataaacccctctccgaggttggtaaagaaacaaacagaagcgacaataacaattccacaagtttttcctcagaaactaatcaagacttgtttgtcaagaaaacgtctgattttgccgagtattctgcgtttcagaaagaagaatccaactctgtttcactcagaaattcgctctcttccatgatcccaacgcaattcaacatcgacgatggttctgtctcaaatgcgggttttgatacacaagtatgcgtgaaaccctcgattattcttcttcctcctccaaacaacacttcaagcactgtctctggacaggatcatgtaaacgtgtcagagcctaattgggaatcaaacagtggaaccacaagccacctcaacaatcccggtatggaagaaatgaaatggtccgaggagtacctaaacgaatcgttattctctacccaagtttacgtgaaatcagagacggatttcaactccaacattgcctttccttggagccaaagccaagcttgtgacgtattccccaaggatcttcagagaatggccttctcttttggtggtcagaccctt

SEQ ID NO: 1674 - protein, 314 aa, Arabidopsis thaliana
  AT1G57560.1
MKRHSCCYKQKLRKGLWSPEEDEKLLNYITKHGHGCWSSVPKLAGLERCGKSCRLRWINYLRPDLKRGAFSSEEQNLIVELHAVLGNRWSQIAARLPGRTDNEIKNLWNSCIKKKLMKKGIDPITHKPLSEVGKETNRSDNNNSTSFSSETNQDLFVKKTSDFAEYSAFQKEESNSVSLRNSLSSMIPTQFNIDDGSVSNAGFDTQVCVKPSIILLPPPNNTSSTVSGQDHVNVSEPNWESNSGTTSHLNNPGMEEMKWSEEYLNESLFSTQVYVKSETDFNSNIAFPWSQSQACDVFPKDLQRMAFSFGGQTL

SEQ ID NO: 1675 - DNA, 1098 bp, Arabidopsis thaliana
  AT1G09540.1
atggggagacattcttgctgttacaaacaaaagctgaggaaagggctttggtctcctgaagaagacgagaagcttcttactcacatcaccaatcacggccatggctgctggagctctgtccctaaactcgctggtttgcagagatgtgggaagagttgtcgactaagatggatcaattacttgagacctgatttaaagagaggagctttttctcctgaagaagagaatctcatcgtcgaacttcatgccgtccttggaaacagatggtcacagattgcgtcaaggcttccgggtagaaccgacaacgagatcaagaatctatggaactcaagcatcaagaagaaactgaaacaaagaggcattgacccaaacacacacaagcccatctctgaagttgagagttttagcgacaaagacaaaccaacaacaagcaacaacaaaagaagcggtaacgatcacaagtctcctagttcctcttctgcgactaaccaagacttcttcctcgaaaggccatctgatttatccgactacttcggatttcagaagcttaacttcaactccaatctaggactctctgttacaactgattcttcactctgctcgatgattccgccgcagtttagccccgggaacatggttggttctgtccttcagacaccagtatgcgtaaagccctcgattagtcttcctcccgacaacaacagttcgagtcctatctccggaggagatcatgtgaaattggctgcaccaaactgggaatttcagacaaacaacaataatacctcaaatttcttcgacaatggcggattctcatggtctatcccaaattcttctacttcttcttcacaagtcaaaccaaatcataacttcgaagaaataaaatggtcagagtatttgaacacaccgttcttcatagggagtactgtacagagtcaaacctctcaaccaatctacatcaaatcagaaacagattacttagccaatgtttcaaacatgacagatccttggagccaaaacgagaacttgggcacaactgaaactagtgacgtgttctccaaggatcttcagagaatggccgtctcttttggtcagtccctt

SEQ ID NO: 1676 - protein, 366 aa, Arabidopsis thaliana
  AT1G09540.1
MGRHSCCYKQKLRKGLWSPEEDEKLLTHITNHGHGCWSSVPKLAGLQRCGKSCRLRWINYLRPDLKRGAFSPEEENLIVELHAVLGNRWSQIASRLPGRTDNEIKNLWNSSIKKKLKQRGIDPNTHKPISEVESFSDKDKPTTSNNKRSGNDHKSPSSSSATNQDFFLERPSDLSDYFGFQKLNFNSNLGLSVTTDSSLCSMIPPQFSPGNMVGSVLQTPVCVKPSISLPPDNNSSSPISGGDHVKLAAPNWEFQTNNNNTSNFFDNGGFSWSIPNSSTSSSQVKPNHNFEEIKWSEYLNTPFFIGSTVQSQTSQPIYIKSETDYLANVSNMTDPWSQNENLGTTETSDVFSKDLQRMAVSFGQSL

SEQ ID NO: 1677 - DNA, 1044 bp, Arabidopsis thaliana
  AT4G01680.2
atgggaagacattcatgttgttacaaacagaaactgaggaaaggactttggtctcctgaagaagatgagaagcttcttcgttacatcactaagtatggtcatggttgctggagctctgtccctaaacaagctggtacgtttttatttatccaaattcatcttttgtttggtttacagagatgtggaaaaagttgtagattaagatggataaattatttaagaccagatttgaagagaggagcattttctcaagatgaagaaaatctcattattgaacttcatgccgttcttggcaatagatggtctcagatagctgcacagcttcctggaagaaccgacaatgaaatcaagaatctttggaattcttgtttgaagaagaaattgaggctgagaggaattgacccggttacacacaagctcttaaccgaaatcgaaaccggtacagatgacaaaacaaaaccggttgagaagagtcaacagacctacctcgttgagactgatggctcctctagtaccactacttgtagtactaaccaaaacaacaacactgatcatctttataccggaaatttcggttttcaacggttaagtctagaaaacggttcaagaatcgcagccggttctgacctcggtatctggattccccaaaccggaagaaaccatcatcatcatgtcgatgaaaccatccctagtgcagtggtactacccggttcaatgttctcatccggtttaaccggttatagatcctccaatctcggtttaattgaattggaaaactcattctcaaccgggccaatgatgacagagcatcagcaaattcaagagagtaactacaacaattcaacattctttggaaatgggaatctgaattggggattaacaatggaggaaaatcaaaatccattcacaatatcgaatcattcaaattcgtccttatacagtgatataaaatcagagaccaatttttttggcacagaggctacaaatgttggtatgtggccatgtaaccagctccagcctcagcaacatgcatatggccatata

SEQ ID NO: 1678 - protein, 348 aa, Arabidopsis thaliana
  AT4G01680.2
MGRHSCCYKQKLRKGLWSPEEDEKLLRYITKYGHGCWSSVPKQAGTFLFIQIHLLFGLQRCGKSCRLRWINYLRPDLKRGAFSQDEENLIIELHAVLGNRWSQIAAQLPGRTDNEIKNLWNSCLKKKLRLRGIDPVTHKLLTEIETGTDDKTKPVEKSQQTYLVETDGSSSTTTCSTNQNNNTDHLYTGNFGFQRLSLENGSRIAAGSDLGIWIPQTGRNHHHHVDETIPSAVVLPGSMFSSGLTGYRSSNLGLIELENSFSTGPMMTEHQQIQESNYNNSTFFGNGNLNWGLTMEENQNPFTISNHSNSSLYSDIKSETNFFGTEATNVGMWPCNQLQPQQHAYGHI

SEQ ID NO: 1679 - DNA, 1056 bp, Arabidopsis thaliana
  AT5G26660.1
atgggaagacattcttgttgttttaagcagaagctaagaaaaggcctttggtctcctgaagaagatgagaaacttctcaattacatcactagacatggtcatggctgttggagttctgtccctaaactcgcaggtttgcaaagatgtggaaagagttgtagacttaggtggataaattatttgagaccagatttaaagagaggagctttctctcaagacgaagaaagcttgatcattgagctccatgctgcattaggcaacagatggtctcaaatcgcaacgcggttaccgggaagaacagacaacgagatcaaaaacttttggaactcatgtcttaagaagaagctgagaagaaaaggcattgacccaacaacacataaacccttaataacaaacgagcttcaatctcttaacgtcatagatcagaaactgacgtcatcagaagtagtaaagtcaacgggttcgataaacaacctacatgatcagtcaatggtcgtctcatcgcaacaaggtccatggtggttcccggcgaatacaactacgactaatcaaaactctgcgttttgctttagttcaagtaatactacaacggtttcagaccagatcgtatctttaatctcttcaatgtctacgtcatcatctccgacaccaatgacttcaaacttcagtcctgctccaaacaactgggaacaactcaactactgcaacacagtaccaagtcagagcaacagtatctacagtgccttctttggtaatcaatacacagaagctagccaaaccatgaacaataataatccactagtagatcaacatcatcatcatcaagacatgaagtcatgggcatcagagattcttcattacacagaacacaaccaaagctcagaaactgttatagaagcagaagtgaagccagacattgccaactactactggagatcagcatcatcatcgtcgtcaccaaaccaagaagctgcaacattactacacgatgctaacgtggaagtgtacggtaaaaatctacaaaagcttaataacatggtgtttgatcagagcctt

SEQ ID NO: 1680 - protein, 352 aa, Arabidopsis thaliana
  AT5G26660.1
MGRHSCCFKQKLRKGLWSPEEDEKLLNYITRHGHGCWSSVPKLAGLQRCGKSCRLRWINYLRPDLKRGAFSQDEESLIIELHAALGNRWSQIATRLPGRTDNEIKNFWNSCLKKKLRRKGIDPTTHKPLITNELQSLNVIDQKLTSSEVVKSTGSINNLHDQSMVVSSQQGPWWFPANTTTTNQNSAFCFSSSNTTTVSDQIVSLISSMSTSSSPTPMTSNFSPAPNNWEQLNYCNTVPSQSNSIYSAFFGNQYTEASQTMNNNNPLVDQHHHHQDMKSWASEILHYTEHNQSSETVIEAEVKPDIANYYWRSASSSSSPNQEAATLLHDANVEVYGKNLQKLNNMVFDQSL

SEQ ID NO: 1681 - DNA, 1287 bp, Brachypodium distachyon
  Bradi2g11080.1
atggggaggcattcctgctgttacaagcagaagctgaggaaggggctctggtctcctgaggaggatgagaaactcctgaaccatataaacaagcatgggcacggctgctggagcactgtcccaaaacttgcagggcttcagaggtgtggcaagagctgtaggctgaggtggatgaactacctgagacctgacttgaaaagaggtgcattcgaacaggaggaagaagacctcatcatcgaactccatgctgtcctagggaacaagtggtctcaaattgcaacacggctggctggaagaactgacaatgagatcaagaatctttggaactcgtgcatcaagaagaagctgcggcagaaaggcctcgaccccaacactcacaagccccttgctgatgaagctgatcgcaggaaagtagctcccaccatgagtactgaaaggacctccgagtctagcgatgtcgaccagtccagtgctggtgcccttggcaacttgagccatcttctcactgagacggcacaatcaccagagctcctgccagtgcttggtaagcagcgcgccaaaactccaagcttgacatgtgtgaaggtgccacccaaggagttttttctcgaccagctggcttctggtcatgagagccttcccagctgccattcatcactccccatgcccaacttccctttccagcagccaccttgctacagcaatggatttagcagcagggatggtggaagcaagaactcactctggtggtttaaccagaatgagtccagtggcagcgcgatttccactgtgatgccgccagtttcaccatcaactctctcaacatccacagtgctcaatctgtcaccagacaatccacattctggaggcactggcatccacagtgcccaattctactgggatactgctaatcctagcagcagttgcagtacgcgaagcagcggaaataataacttgggtttcgagctgcaaagcacaagctcgcttctagagaacagcgtcttcccatgggcagagttagcacaagataaagatagccaagttcacctagaggaagaactcaagtggcctgagttgctccatggtaccttcccagagacatcaacagcaatgcagaaccttagccaatcgctgtacgaagacgtggttaaggccgaaagccaattcaacatggaggggctctgtgcagcttggtctcaaaatctgcagccacaacaacatctccagctagtaacagatatgtatgacaaggatttgcaaagaatgtcatcaccttttgagaatatc

SEQ ID NO: 1682 - protein, 429 aa, Brachypodium distachyon
  Bradi2g11080.1
MGRHSCCYKQKLRKGLWSPEEDEKLLNHINKHGHGCWSTVPKLAGLQRCGKSCRLRWMNYLRPDLKRGAFEQEEEDLIIELHAVLGNKWSQIATRLAGRTDNEIKNLWNSCIKKKLRQKGLDPNTHKPLADEADRRKVAPTMSTERTSESSDVDQSSAGALGNLSHLLTETAQSPELLPVLGKQRAKTPSLTCVKVPPKEFFLDQLASGHESLPSCHSSLPMPNFPFQQPPCYSNGFSSRDGGSKNSLWWFNQNESSGSAISTVMPPVSPSTLSTSTVLNLSPDNPHSGGTGIHSAQFYWDTANPSSSCSTRSSGNNNLGFELQSTSSLLENSVFPWAELAQDKDSQVHLEEELKWPELLHGTFPETSTAMQNLSQSLYEDVVKAESQFNMEGLCAAWSQNLQPQQHLQLVTDMYDKDLQRMSSPFENI

SEQ ID NO: 1683 - DNA, 1284 bp, Oryza sativa
  LOC_Os01g18240.1
atggggagacattcctgctgctacaagcagaagctgaggaaggggctctggtcacctgaggaggatgagaagctcatgaaccacataaccaagcatggccatggctgctggagcaccgttccaaaacttgcagggcttcagagatgtggcaaaagctgcaggctgagatggataaactacttgaggcctgacctaaagagaggtgcattctctcaggaggaagaggacctcatcgttgagctccatgctgttctgggaaacaggtggtctcaaattgcaacacggctgcctggaagaactgacaatgagatcaagaatctctggaattcatgcatcaagaagaagctgcggcagaaaggcattgacccaaacacccacaagccccttgccgaggttgatcgaagcaaagcaactcccaccatcagcaatgacaggacctctgaatccagcgatgttgacccatctagtggcgttgctcttcacaacttgagccatcttctgagcgagacggcgcaatcatcagagctgctgccagtgaaggtaactaaacctcgcacacaagctccgggcttggcacgtctgaaggtgccaccgaaggaactatttctagaccagcttacttctggccatgagaacctccctagctgccgttcatctggcccaattcccaatttcccgttccagcagctgttgtgctacaataatgattttaacagcatggacgttggaaacaggaattcactctggtataaccagaatgagtccagtagcagcacaatttccactgtgatgcccccagtttcaccatcaactctctcgacatcaacaggccttaatccatcaccagacaatgcaaactctcgaggcactggcatccacaattcccaattctattgggacaccaacaatcctagcagcagtagcagtacagggagtagtggtaacaacgggttgggattcgagctgcaaagcacaagctcccttttggagaccaacatattcccatggtcagatttagcaccagaaaaggatagccaagcacaactagaggaagaactcaagtggcctgacttgctccatggaacgttctcagagatgccagcgcccatgcagaaccttagccagtcactgtatgaagacgttgtcaaagcagagagccaattcaacatggaggggctctgtgcagcttggtctcaaaacctgctgccacagcaacatcttccagtagtatcagatatgtatgacaaggatttgcaaaggatgtccttgtcttttgagaatatc

SEQ ID NO: 1684 - protein, 428 aa, Oryza sativa
  LOC_Os01g18240.1
MGRHSCCYKQKLRKGLWSPEEDEKLMNHITKHGHGCWSTVPKLAGLQRCGKSCRLRWINYLRPDLKRGAFSQEEEDLIVELHAVLGNRWSQIATRLPGRTDNEIKNLWNSCIKKKLRQKGIDPNTHKPLAEVDRSKATPTISNDRTSESSDVDPSSGVALHNLSHLLSETAQSSELLPVKVTKPRTQAPGLARLKVPPKELFLDQLTSGHENLPSCRSSGPIPNFPFQQLLCYNNDFNSMDVGNRNSLWYNQNESSSSTISTVMPPVSPSTLSTSTGLNPSPDNANSRGTGIHNSQFYWDTNNPSSSSSTGSSGNNGLGFELQSTSSLLETNIFPWSDLAPEKDSQAQLEEELKWPDLLHGTFSEMPAPMQNLSQSLYEDVVKAESQFNMEGLCAAWSQNLLPQQHLPVVSDMYDKDLQRMSLSFENI

SEQ ID NO: 1685 - DNA, 1281 bp, Zea mays
  GRMZM2G017520_T01
atggggaggcactcctgctgttacaagcagaagctgaggaaggggctctggtctcctgaggaagatgagaagctcatgaaccacataaccaagcacgggcatggctgctggagcactgtccccaagcttgcagggcttcagaggtgtggcaagagctgcaggctgaggtggataaattacctgaggcctgaccttaaaagaggcgcattctctgaggaggaggaagacctcatcgtcgaacttcatgctgtactggggaacaggtggtctcagattgcaacaaggttgcctggaagaactgacaacgagattaagaatctctggaactcgagcatcaagaagaagctccggcagaaaggcattgaccccaacacccacaagccgctccttgtcgaggttgaacgcagcaaagcagctccaacgaccagtaccgagaggacctctgagtccagtgatgttgacccttcaagtggcggcgcacttggcaactcgagccatcttcttctcagcgagacagcacaatcaccacagctgccagcgctcggtaagcatcgcagagaaactactagcctcgcacatctaagggtgccgcccaaggagttgttccttgaccagctggtttctggtcatgagaacctcactggctgccgcacagcaggcccagttccaaatttccctttccaacagctcatgtgctacagcaatgaatttggcaacaagaatggtgctagtaacaattcactctggtttaaccacaatgagacaagtggcagcaccatttccactgtgatgccaccagtttcgccatcaactctctcaacatcaacagggctcaataggtcaccagacaacccacactcgggaggcactggtattcagagcacccagttctactgggacactgctaatcctagcagctgcagcagtagaggaagcagcggaagcaacggcttgggatttgagctgcaaagcacaagctcgcttctggagagtagtgttttcccatggacagaattaacaccagacaaaaatagccaagttcaccttggggaagaactcaagtggcccgacttgctccacggaacattcacggacacacctgcaaccatgcagaatcttagccagtcactgtacgaagatgttatcaaagccgagagccaattcaacatagagggcctctgtgcagcctggtctcaaaatctgcagccacagcaacatctgcaggtatcagatttgtatgacaaggatttgcaaaggatgtccttgtcttttgagaatatc

SEQ ID NO: 1686 - protein, 427 aa, Zea mays
  GRMZM2G017520_T01
MGRHSCCYKQKLRKGLWSPEEDEKLMNHITKHGHGCWSTVPKLAGLQRCGKSCRLRWINYLRPDLKRGAFSEEEEDLIVELHAVLGNRWSQIATRLPGRTDNEIKNLWNSSIKKKLRQKGIDPNTHKPLLVEVERSKAAPTTSTERTSESSDVDPSSGGALGNSSHLLLSETAQSPQLPALGKHRRETTSLAHLRVPPKELFLDQLVSGHENLTGCRTAGPVPNFPFQQLMCYSNEFGNKNGASNNSLWFNHNETSGSTISTVMPPVSPSTLSTSTGLNRSPDNPHSGGTGIQSTQFYWDTANPSSCSSRGSSGSNGLGFELQSTSSLLESSVFPWTELTPDKNSQVHLGEELKWPDLLHGTFTDTPATMQNLSQSLYEDVIKAESQFNIEGLCAAWSQNLQPQQHLQVSDLYDKDLQRMSLSFENI

SEQ ID NO: 1687 - DNA, 1272 bp, Setaria italica
  Si001565m
atggggaagcactcctgctgttacaagcagaagctgaggaaggggctctggtctcctgaggaagacgagaagctcatgaaccacataaccaagcatgggcatggctgctggagcactgttccaaagcttgcagggcttcaaaggtgtggcaagagctgcaggctgaggtggataaattacctgaggcctgaccttaaaagaggtgcattctctcaggaggaggaagaccttatcattgaacttcatgctgtcttgggcaacaggtggtctcagattgcaacacggttgcctggaagaactgataacgagatcaagaatctctggaattcaagcatcaagaagaagctccggcagaaaggcatcgaccccaacacccacaagccccttgctgaggttgatcgcaaaatagctccaacaatcagtactgagagaacctccgagtccagcgatattgacccttcaagtggtggtgcacttggcaacttgagccatctcctcagtgagacagcacaatcaccagagctgctgccagtgctcggtaagcatcgcaaagaaactactagtttggcacatctaagggtgccatcgaaggagctattccttgaccagcttgtttctggtaatgataacctccccagctgccgctcaacaggcccaattccaaatttccctttccagcagttgatgtgttacagcaatgaatttggcggcaagcatggaggcagcacgaatccactctggtttaaccagaatgagtcaagctgcagcaccatttccactgtgatgccaccagtttcgccatcaactctctcaacatcaacaggactcaataggtcaccggacaatccacactctggaggtactggcattcagagtaaccaattctactgggacaccactaatcctagcagcagtagcagtaaaggaagcagtggaagcaatagcttgggatttgagctgcaaagcacaagctcaattctggagaatagtatcttcccatggacagatttatcgccagataaaaatagccacctagaggaagaactcaagtggcctgacctgctccatggaaccttcacagatacaccagcaaccatgcagaatcttagccaatcactgtatgaagatgtggtcaaagccgagaaccaattcaacatggagggcctctgtgcagcttggtctcaaaatttgcagccacagcaacatctgcaggtagcatcagatttgtatgacaaggatttgcagagaatgtccttgtctttcgagaatatc

SEQ ID NO: 1688 - protein, 424 aa, Setaria italica
  Si001565m
MGKHSCCYKQKLRKGLWSPEEDEKLMNHITKHGHGCWSTVPKLAGLQRCGKSCRLRWINYLRPDLKRGAFSQEEEDLIIELHAVLGNRWSQIATRLPGRTDNEIKNLWNSSIKKKLRQKGIDPNTHKPLAEVDRKIAPTISTERTSESSDIDPSSGGALGNLSHLLSETAQSPELLPVLGKHRKETTSLAHLRVPSKELFLDQLVSGNDNLPSCRSTGPIPNFPFQQLMCYSNEFGGKHGGSTNPLWFNQNESSCSTISTVMPPVSPSTLSTSTGLNRSPDNPHSGGTGIQSNQFYWDTTNPSSSSSKGSSGSNSLGFELQSTSSILENSIFPWTDLSPDKNSHLEEELKWPDLLHGTFTDTPATMQNLSQSLYEDVVKAENQFNMEGLCAAWSQNLQPQQHLQVASDLYDKDLQRMSLSFENI

SEQ ID NO: 1689 - DNA, 1281 bp, Brachypodium distachyon
  Bradi2g36730.1
atggggaggcattcttgttgctacaagcaaaaattgagaaaggggctatggtcccctgaggaggatgagaagctcatgaatcacataaccaagcatggccatggctgctggagctcagtccctaaactcgcagggctccaaaggtgtggcaagagctgcaggctgagatggataaactacctgaggccagacctcaagagaggtgcgttcgctcaggacgaggaagacctcatcattgagctccacgctgtacttgggaacagatggtcacaaattgcagcacagatgcctggaaggactgacaatgagatcaagaacctctggaactcgtccctcaagaagaagctgcgacaaaaaggcattgatcccaacacccacaaacccctcactgaggttgatcgcagtggagcagctcccaccatcagtaccgagaggacctctggttccagtgacgtcaacccgtcaagtgctggtgctctagggaacttcagccacctcctcagcgagacagcccaatcatcaatgctgctgccagtgtatgataagaaacgccctgaaactgcaagcttggcacgccctaaggtgccagcaaaggaattgtttctggaccagcttactgctggtcatgagagcccatcaagctgccgttcatcaggtccaacgctgtatttccctttccagcagccattaggctacagcaatgagtgtggcaatggtgacggtgcaaatatgaattcactctggttcaaccagaatgatttcaactgcagcacaatttccaccatgatgccaacagtttcaccatcagccctctcaacatcaatgggcctgaatctcccaccagacaatcaccgccacgggggcactggcatcagcagcgcccctttctactgggatggtgttaatcctagcagcagcggcagtactgggagcagtggaagcaacagtatgggattcgagccgcagagcacaaactcaattctggagaacagtgtattcccatggactgatatcggacaagaaaaagataccagagttcaattagtggaggaactcaagtggcctgacttgctccatggaacctttgcagaggcaaccacagcattgcagaaccaaagccaatcattatatgatgatgtgatcaaggcagagagccaattcaacatggaagggatatgtgcttcttggttccagaatcagccgccacagcaacagctgcaagcgccatcagacatgtatgacaaagacttgcaaagaatgcccttgtcttttgagcatatg

SEQ ID NO: 1690 - protein, 427 aa, Brachypodium distachyon
  Bradi2g36730.1
MGRHSCCYKQKLRKGLWSPEEDEKLMNHITKHGHGCWSSVPKLAGLQRCGKSCRLRWINYLRPDLKRGAFAQDEEDLIIELHAVLGNRWSQIAAQMPGRTDNEIKNLWNSSLKKKLRQKGIDPNTHKPLTEVDRSGAAPTISTERTSGSSDVNPSSAGALGNFSHLLSETAQSSMLLPVYDKKRPETASLARPKVPAKELFLDQLTAGHESPSSCRSSGPTLYFPFQQPLGYSNECGNGDGANMNSLWFNQNDFNCSTISTMMPTVSPSALSTSMGLNLPPDNHRHGGTGISSAPFYWDGVNPSSSGSTGSSGSNSMGFEPQSTNSILENSVFPWTDIGQEKDTRVQLVEELKWPDLLHGTFAEATTALQNQSQSLYDDVIKAESQFNMEGICASWFQNQPPQQQLQAPSDMYDKDLQRMPLSFEHM

SEQ ID NO: 1691 - DNA, 1281 bp, Oryza sativa
  LOC_Os05g04820.1
atggggaggcattcttgctgctacaagcagaaattgaggaaggggctctggtcccctgaggaggatgagaagctcatgaatcacataaccaagcatggccatggctgctggagttctgttcctaaacttgcagggctccaaagatgcggcaagagctgcaggctgaggtggataaactatctgaggcctgacctcaagagaggtgcattctctcaggaggaagaagacctcatcattgagctccatgctgtccttgggaacaggtggtctcagattgcagctcagctgcctgggaggactgacaacgagatcaagaatctctggaattcttgcatcaagaagaagctccggcagaaaggcattgatcccaacacccacaagcccctcaccgaggctgatcgcaggggagcagcacccacagtcagcaccgagaggacctcagggtccagcgacgtcaacccgtcaagtgctggtgctctagggaacttgagccacctcctcagcgagacagcacaatcatcaatgctgctgccggtgtatgataagaatcaccctgaaactgcaagcttgccacgccctaaggtgccaccaaaggagttgtttcttgaccagcttactgccggtcacgagagcccatcaagttgccgctcatcaggtccaaccctgtattttcctttccagcaaccattaggctacagtaatgaatgtggcactggggatggtgcgagtatgaattcactctggttcaaccagaatgatttcaactgcagcacaatctccaccgtgatgccaccagtttcaccatcagccctctcaacatcaatggggctgaatcttcccccagaaaatcctcgtcacggaggcactggcattggcaacaccccgttctactgggatggttccaatcctagcagcagcggcagtactgggagcagcggaagcaacagtatgggattcgagccacagagcacaacctcaattttggagaacagtgtattcccatggacagatatcggacaagagaaagataccagagttcacttagtggaggaactcaagtggcctgatttgctccatggaacctttgctgaggcgacgacagccatgcagaaccagagccaatcattatacgatgatgtgatcaaggcagagagccaattcaacatggaagggatatgtgcctcttggttccagaatcagcaaccacaacaacagctgcaagcagcatcagacatgtatgataaagacttgcaaagattgcccttgtcttttgaacatatc

SEQ ID NO: 1692 - protein, 427 aa, Oryza sativa
  LOC_Os05g04820.1
MGRHSCCYKQKLRKGLWSPEEDEKLMNHITKHGHGCWSSVPKLAGLQRCGKSCRLRWINYLRPDLKRGAFSQEEEDLIIELHAVLGNRWSQIAAQLPGRTDNEIKNLWNSCIKKKLRQKGIDPNTHKPLTEADRRGAAPTVSTERTSGSSDVNPSSAGALGNLSHLLSETAQSSMLLPVYDKNHPETASLPRPKVPPKELFLDQLTAGHESPSSCRSSGPTLYFPFQQPLGYSNECGTGDGASMNSLWFNQNDFNCSTISTVMPPVSPSALSTSMGLNLPPENPRHGGTGIGNTPFYWDGSNPSSSGSTGSSGSNSMGFEPQSTTSILENSVFPWTDIGQEKDTRVHLVEELKWPDLLHGTFAEATTAMQNQSQSLYDDVIKAESQFNMEGICASWFQNQQPQQQLQAASDMYDKDLQRLPLSFEHI

SEQ ID NO: 1693 - DNA, 1290 bp, Zea mays
  GRMZM2G127490_T01
atggggaggcattcttgctgctacaagcaaaagttgagaaaggggctctggtcccccgaggaggatgagaaactcatgaaccacataacaaagcatggccatggctgctggagttctattcccaaactcgctgggctccaaaggtgcggaaagagttgtaggctgaggtggataaactatctgaggccagacctcaagagaggggcattctcccaagacgaagaagacctcatcattgagctgcacgctgtccttggaaacaggtggtctcaaattgcagctcagctgccagggaggactgataatgagatcaagaatctatggaactcgtgcatcaagaagaagctcaggcagaaaggcattgatcccaacacccacaagccccttactgaggctgatcgcagcggagcagctcccaccatcagcaccgagagaacctcagggtccagcgaaatcaacccatcaagcgctggtgctctgggaaacttgagccacctcctcagcgagacggctcaatcatcaatgctgatgcccgtgtatgacaagaatcgcgctgaaactccaaacttggcacgccctaaggtgccaccaaaggagttgttcctggagcagcttactgctggacacgagagtccatcaacctgccgctcatcaggccaaactctctatttccctttccaacagcctttaggctacaacagtgagagtggcagtggcgatggggcgaatatgaattcactctggttcaaccagagtgacttcaactgcagcacaatttctacagtgatgccgccagcttcaccatcggccctctctacatcaatggggctgaatcttccacctgataattctcgacatggaggaactggcattggaagtactgcagtagattcattctactgggatggtactaatcctagcagcagtagcagtactgggagcagaggaagcaacagtatgggatttgaaccacagagcacgagctcaattctggagaacagtgtcttccaatggacagacatcggacaagaaaaagatacaagagctcacctggtagaggaacttaagtggcctgacttgctccatggaacctttgccgagacgaccacagccatgcagaaccagagccagacgctctatgatgacgtgatcaaggcagagagccaattcagcatggaagggatatgtgcttcttggttccagaatcagcagccacagcaacagcttcaggcaacaccagacatgtatgacaaggacttgcaaagaatgcaactgtcttttgagaatatc

SEQ ID NO: 1694 - protein, 430 aa, Zea mays
  GRMZM2G127490_T01
MGRHSCCYKQKLRKGLWSPEEDEKLMNHITKHGHGCWSSIPKLAGLQRCGKSCRLRWINYLRPDLKRGAFSQDEEDLIIELHAVLGNRWSQIAAQLPGRTDNEIKNLWNSCIKKKLRQKGIDPNTHKPLTEADRSGAAPTISTERTSGSSEINPSSAGALGNLSHLLSETAQSSMLMPVYDKNRAETPNLARPKVPPKELFLEQLTAGHESPSTCRSSGQTLYFPFQQPLGYNSESGSGDGANMNSLWFNQSDFNCSTISTVMPPASPSALSTSMGLNLPPDNSRHGGTGIGSTAVDSFYWDGTNPSSSSSTGSRGSNSMGFEPQSTSSILENSVFQWTDIGQEKDTRAHLVEELKWPDLLHGTFAETTTAMQNQSQTLYDDVIKAESQFSMEGICASWFQNQQPQQQLQATPDMYDKDLQRMQLSFENI

SEQ ID NO: 1695 - DNA, 1278 bp, Zea mays
  GRMZM2G171781_T01
atggggaggcattcttgctgctacaagcagaagctgagaaaggggctctggtcccctgaggaggatgagaaactcatgaatcacataacaaagcatggccatggctgctggagctctgttcccaaactcgctgggcttcaaaggtgcggaaagagttgtaggctgaggtggataaactatctgaggccagacctcaagagaggggcattcgcccaagacgaagaagacctcatcatcgagctgcacgctgtcctcgggaacaggtggtctcaaattgcagcgcagctgccagggaggactgataatgagatcaagaatctatggaactcgtgcatcaagaagaagctgaggcagaaaggcattgatcccaacacccacaagccacttactgaggctgatcgcggcggtgcagctcccaccatcagcaccgagagaacctcagggtccagcgacgtcaacccatcaagcactggtcctctggggaacttgagccccctcctcagcgagacggctcaatcatcaatgctgatgcccgtgtacgacaagaatcgtgctgaaacaccaaacttggcacgccctaagctgccaccaaaggagctgttcctggagcagcttactgctggacatgagagtccatcaacctgccactcatcaggccaaactctctatttccctttccaacagcctttaggctacaacagtgagagtggcagcagcgatggggcgaatatgaattcactctggttcaaccagagtgacttcaactgcagcacaatttctacagtgatgccgccagtttcaccatcggccctctctacatcaatggggctgaatcttccacctgataatcctcgacatggaggaactggcattggaagtaccgcagtagattcattctactgggatggtactaatcctagcagcagtagcagtactgggagcagagggagcaacagtatgggatttgaaccacagagcacgagcacaattctggagaacagtgtcttcccatggacagacattggacaagaaaaagatacaagggctcacctagttgcggaacttaagtggcctgactcctttgccgagacgaccacagccatgcagaaccagagccaaacgctttatgatgatgtgatcaaggcagagagccaattcaacatagaagggatatgtgcttcttggttccagaatcagcagccacagcaacagctgcaggtagcaccagacatgtatgacaaggacttgcaaagaatgcaactatcttttgagaatatc

SEQ ID NO: 1696 - protein, 426 aa, Zea mays
  GRMZM2G171781_T01
MGRHSCCYKQKLRKGLWSPEEDEKLMNHITKHGHGCWSSVPKLAGLQRCGKSCRLRWINYLRPDLKRGAFAQDEEDLIIELHAVLGNRWSQIAAQLPGRTDNEIKNLWNSCIKKKLRQKGIDPNTHKPLTEADRGGAAPTISTERTSGSSDVNPSSTGPLGNLSPLLSETAQSSMLMPVYDKNRAETPNLARPKLPPKELFLEQLTAGHESPSTCHSSGQTLYFPFQQPLGYNSESGSSDGANMNSLWFNQSDFNCSTISTVMPPVSPSALSTSMGLNLPPDNPRHGGTGIGSTAVDSFYWDGTNPSSSSSTGSRGSNSMGFEPQSTSTILENSVFPWTDIGQEKDTRAHLVAELKWPDSFAETTTAMQNQSQTLYDDVIKAESQFNIEGICASWFQNQQPQQQLQVAPDMYDKDLQRMQLSFENI

SEQ ID NO: 1697 - DNA, 1290 bp, Setaria italica
  Si022112m
atggggaggcattcttgctgctacaagcaaaagttgagaaaggggctctggtctccggaggaggatgagaaactcatgaatcacataacaaagcatggccatggctgctggagttctgttcccaaactcgcagggctccaaaggtgcggaaagagttgcaggctgaggtggataaactatttgaggccagacctcaagagaggggcattctctcaagaggaagaagacctcatcattgagctgcatgctgtccttggcaacaggtggtctcaaattgcagcacagctgcctggaaggactgacaacgagatcaagaacctatggaactcatgcatcaagaagaaactgaggcagaaaggcattgatcccaacacccacaagccgcttgctgaggctgattgcagcggagcagctcccaccatcagcactgagaggacctcaggatccagcgacgtcaacccatcaagcactggtgctctggggaacttgagccacctcctcagcgagacagctcaatcatcaatgctgctgccagtgtatgacaagaatcaccctgaaactccaaacttagcacgccctaaggtgcctccaaaggagttatttctggaccagcttactgctggacacgagagttcatcaacctgccgctcatcaggccaaacgttgtatttcccttttcaacagccattaggctacagcagtgagagtggcagtggtgacggtgcaagtatgaactcactctggttcaaccagaatgacttcaactgcagcacaatttccactgtgatgccaccagtttcaccatcagccctatcaacatcgatggggctgaatctcccaccaaataatcctcgacatggaggcactggcattggaagtgcctcagtagattcattatactgggatggtacaaatcctagcagcagtagcagtactgggagcagaggaagcaacagtttgggatttgaaccacagagcacaagctcaattctggagaacagtgtgttcccatggacagacgtcggacaagaaaaagattcaagagctcacttagtagaggaacttaagtggcctgacttgctccatggaacctttgctgaaacgaccgtagccatgcaggaccagagccaatcactctatgatgacgtgatcaaggcagagagccaattcaacatggaagggatatgtgcttcttggtaccagaatcagcagccacagcaacagctgcaggcagcaccagacatgtatgacaaggacctgcaaagaatgcaactgtcttttgagaatatc

SEQ ID NO: 1698 - protein, 430 aa, Setaria italica
  Si022112m
MGRHSCCYKQKLRKGLWSPEEDEKLMNHITKHGHGCWSSVPKLAGLQRCGKSCRLRWINYLRPDLKRGAFSQEEEDLIIELHAVLGNRWSQIAAQLPGRTDNEIKNLWNSCIKKKLRQKGIDPNTHKPLAEADCSGAAPTISTERTSGSSDVNPSSTGALGNLSHLLSETAQSSMLLPVYDKNHPETPNLARPKVPPKELFLDQLTAGHESSSTCRSSGQTLYFPFQQPLGYSSESGSGDGASMNSLWFNQNDFNCSTISTVMPPVSPSALSTSMGLNLPPNNPRHGGTGIGSASVDSLYWDGTNPSSSSSTGSRGSNSLGFEPQSTSSILENSVFPWTDVGQEKDSRAHLVEELKWPDLLHGTFAETTVAMQDQSQSLYDDVIKAESQFNMEGICASWYQNQQPQQQLQAAPDMYDKDLQRMQLSFENI

SEQ ID NO: 1699 - DNA, 1290 bp, Setaria italica; identical to SEQ ID NO: 1697
  Si022113m

SEQ ID NO: 1700 - protein, 430 aa, Setaria italica; identical to SEQ ID NO: 1698
  Si022113m

SEQ ID NO: 1701 - DNA, 1218 bp, Eucalyptus grandis
  Eucgr.B02197.1
atggggaggcactcctgctgttacaagcagaagctaaggaaaggcttgtggtctccagaagaagatgagaagcttgttaggcatatcgttaagtatggacatggttgctggagctctgtgcctaaactagctggattgcagaggtgtgggaagagttgtagattgaggtggatcaattacttgaggcctgatttgaagagaggcacattctcacaacaagaggaggacttgataattgagcttcatgctgttcttggaaacaggtggtctcaaattgcgtcacagttgccaggaagaacagacaatgagatcaagaacctgtggaactccagcatcaagaagaagctcattcaaaaaggcattgaccccaacactcacaagccgctttctgaggtcaagaacggaagagaaggggagaaaacgccgaaatccggcaattttggcaacagaacctcaggagggtttagttctatgtacaatcttgaattcgacgctcccaagtcagaggaaagaaagccaatttcacaagatgcagagccatattcactcactggttctttaagcttgaaaattcaccacccggacaccagtaagtctatcaatcccgcacctgccagaaaattgttctcagaaaagtccgcagaccttagcgagaagatccctttcgagccgacccgtattttccctttccagcaactaagctacggttcaagtgctgattattcatttgatccatatctgaaccacaacttcatgctttctgattcgaagtccgccctccactccacttcagcacctgccattttgccacaatctcacagttttagctcattgactgcacaaccccacgagagcttgaagccccatttcggtctcttctccaacgggaagatcaggagcagtgaatcgcagagcagccttttcccctgggacctgcatgctgagaaagaagaagacgaaacccaccagccgaacttcagtggcaacgagtcagaggatctgaaatggtcagactatctgaacatgccattcctgatagctaacccagggcaaggtcaagaaaagcaggctccaccaaatggggttgtgtcagacgcaagattcatctcagaattgtcctgtgttgaagggaataaccagcagcaagaactgccctcacagggttcagacatttactgcaagggtatcaggagattagctgcaacttttgggaattac

SEQ ID NO: 1702 - protein, 406 aa, Eucalyptus grandis
  Eucgr.B02197.1
MGRHSCCYKQKLRKGLWSPEEDEKLVRHIVKYGHGCWSSVPKLAGLQRCGKSCRLRWINYLRPDLKRGTFSQQEEDLIIELHAVLGNRWSQIASQLPGRTDNEIKNLWNSSIKKKLIQKGIDPNTHKPLSEVKNGREGEKTPKSGNFGNRTSGGFSSMYNLEFDAPKSEERKPISQDAEPYSLTGSLSLKIHHPDTSKSINPAPARKLFSEKSADLSEKIPFEPTRIFPFQQLSYGSSADYSFDPYLNHNFMLSDSKSALHSTSAPAILPQSHSFSSLTAQPHESLKPHFGLFSNGKIRSSESQSSLFPWDLHAEKEEDETHQPNFSGNESEDLKWSDYLNMPFLIANPGQGQEKQAPPNGVVSDARFISELSCVEGNNQQQELPSQGSDIYCKGIRRLAATFGNY

SEQ ID NO: 1703 - DNA, 936 bp, Vitis vinifera
  GSVIVT01017716001
atggggaagcactcttgctgttacaagcagaagctaaagagaggcctgtggtctccagaagaagatgagaagcttttcaggtatatcacggagcatggacatgggtgctggagctctgtccctaaacaagcaggtttgcaaaggtgtggcaagagttgcaggctaaggtggattaactatttgaggcctgatttgaagaggggcgccttcacaggacaggaagagaagcttatagttgaactgcatgaaattcttggcaacaggtggtctcagattgcttcccacttaccgggaagaacagacaatgaaattaaaaaccagtggaactctagcattaagaagaaactcaggcagaaaggcatcgacccaaacacccacaagccactttctgaaattgacaaccgaccaacggccaataattcctccatggagctggagctagagctagagccactactaaacaatgaggaaagcctcactaccattttttgcaggcctggggaggtgacaggacggttgaattatgagtctaatccccactttccatttgatctgcatcccggatcatggttaagccaaaacagcatctcttcccagctcaactcccaattccattccacctccatttctacttttctccaaactgattttagctcaactgggtcagttctgcctctacaatctcccagaggaatccagtatgcttctgctagctccagcagcagccaattctcttggggactggccgattggggattatcagatcaagaaggcaaattgggagataacaaacagttggagcatctcagcacaccttctttttctaattggaataagaactgcttctcagattacaagtgtttctgcctttacaggtcgcatgcatgtccatcttattgcatagggtatgaccaaatacaaatccaaggtaatggg

SEQ ID NO: 1704 - protein, 312 aa, Vitis vinifera
  GSVIVT01017716001
MGKHSCCYKQKLKRGLWSPEEDEKLFRYITEHGHGCWSSVPKQAGLQRCGKSCRLRWINYLRPDLKRGAFTGQEEKLIVELHEILGNRWSQIASHLPGRTDNEIKNQWNSSIKKKLRQKGIDPNTHKPLSEIDNRPTANNSSMELELELEPLLNNEESLTTIFCRPGEVTGRLNYESNPHFPFDLHPGSWLSQNSISSQLNSQFHSTSISTFLQTDFSSTGSVLPLQSPRGIQYASASSSSSQFSWGLADWGLSDQEGKLGDNKQLEHLSTPSFSNWNKNCFSDYKCFCLYRSHACPSYCIGYDQIQIQGNG

SEQ ID NO: 1705 - DNA, 783 bp, Populus trichocarpa
  POPTR_0010s00690.1
atggggaggcaatcttgcggttacaagcagaaactaagaaaagggttgtggtccccggacgaagatgagaagcttttgaggtacattaccgagcatggacatggatgctggagctccgtccccaagcttgcaggtcttgaaaggtgcggaaagagttgcaggctgaggtggatcaattacttaagaccagacttgaagagaaccagattctcaagccaggaagagaacctcgtaatccaacttcagtcagttctaggcaacaggtggtctcgaattgcagcacagttaccaggaagaacggacaatgagataaagaatctatggaactcttccattaagaagaaactcatgcagaaaggtattgaccccaacacccacaagccactctctgaggttaagctttctactagcaagtgccctgagaaggcctcaagagaactggatacagcgatctcactcaatctcaaggcagatagttcaaagccatcactcattgatgtatcgagctctaaaagtcacaaaagatactttcttcttctcatcgtctctctctctaacgcctacttctatgatgatgattggggtgggggggaacatgggactacagccttggcaagcaatttccaggagtccagcaaggcaccatctcagattgatgccatgcatgatctgttaaagagtaaaaattttacgtcttctgtatggagcagattgagtactagtgcacaagactttcaaatttctaagatgccaacatgcctagaaatcatgccaagcgtgaac

SEQ ID NO: 1706 - protein, 261 aa, Populus trichocarpa
  POPTR_0010s00690.1
MGRQSCGYKQKLRKGLWSPDEDEKLLRYITEHGHGCWSSVPKLAGLERCGKSCRLRWINYLRPDLKRTRFSSQEENLVIQLQSVLGNRWSRIAAQLPGRTDNEIKNLWNSSIKKKLMQKGIDPNTHKPLSEVKLSTSKCPEKASRELDTAISLNLKADSSKPSLIDVSSSKSHKRYFLLLIVSLSNAYFYDDDWGGGEHGTTALASNFQESSKAPSQIDAMHDLLKSKNFTSSVWSRLSTSAQDFQISKMPTCLEIMPSVN

SEQ ID NO: 1707 - DNA, 585 bp, Vitis vinifera
  GSVIVT01028235001
atggggaggcactcttgttgttacaagcagaagctaaggaaaggcctatggtctcctgaagaagatgagaaacttctgaggcatattaccaagtatggccatggctgctggagctctgtcccaaagcaagcaggtctgcaaaggtgtgggaagagctgcagattgaggtggattaactacttgaggcctgatttgaagagaggcacattctccctacaggaagagaatcttataattgagcttcattcagttcttgggaacaggtggtcccaaatcgcagcacagctgcctggacgcactgacaatgaaataaagaatttgtggaactcttgcttgaagaagaagctcaggcagagaggcattgaccccaacacccacaaacccctctctgaggttgaaaatagagaagacagcaaccctcccaccgacagccaggacaaagcttcaggagtatccagtgaattgaacctcctcaagacaataaacagcaacaacaacaataacagcaacagcaatttgatgctgccaaccatcagatgtggtggggtatttggcccctcagcaattgaattacccatccaatgc

SEQ ID NO: 1708 - protein, 195 aa, Vitis vinifera
  GSVIVT01028235001
MGRHSCCYKQKLRKGLWSPEEDEKLLRHITKYGHGCWSSVPKQAGLQRCGKSCRLRWINYLRPDLKRGTFSLQEENLIIELHSVLGNRWSQIAAQLPGRTDNEIKNLWNSCLKKKLRQRGIDPNTHKPLSEVENREDSNPPTDSQDKASGVSSELNLLKTINSNNNNNSNSNLMLPTIRCGGVFGPSAIELPIQC

SEQ ID NO: 1709 - DNA, 1167 bp, Vitis vinifera
  GSVIVT01031341001
atggggaggcactcttgctgctacaagcagaagctgaggaaaggcctgtggtctcccgaggaagatgagaaacttctgatgcatattaccaagtatggacatgggtgttggagctccgtccctaaactagcaggtttgcagaggtgtgggaagagctgcaggctaagatggattaactacttgaggcctgatttgaagaggggagcattctcacaacaggaagagagcctgataattgaactccatgcagttctaggcaacagatggtcgcagattgcagctcaattaccgggaagaacggataatgaaataaaaaatttgtggaactcctgcattaagaagaagcttagacaaaaaggcatcgaccccaacactcacaaaccgcttgtggaggctgagaacggacaagataagctgcctaattccgataaaagcaatgaaaaagccaatgaactgaaccttgttgaggccgagaatttaaagccactttcaactgctgcggagcagccttctggcttggtggggcatttctcttttcagcagttgaattatgggcccaatattgggctctcatccagaactgggaagtcggcaccttcagtaataatgccagcagcagcaatgggagcaggaacagtgatcctgaagacatcaaatggtctgagtatctccataccccatttctattgggcaccacactacagaaccaaagccctcaacctatctatagtgagactaagccaggaatacatttcacaacagatgggtcaagtactggctggcatcagaaccagcaggaacaacccatacaagcttcagctgacatatataccaaggatctccagagacttggtgtggcttttggacagatttgttaacttgtatttaacatgtggagcctctaattcaagggacgagagaatcacggggggttttcagtccaagaaggatttggaaaaaacatcttctggtcaggtgtgtgctatagaattttcttatgattttgtaaataggtctgatacaaaagggctgagctatttcttaatgaatatttgtaatggaaacaagcttctgttcatcttttttcatgggagtatggtatggaataaggtttcttttgatgtctattcctcttctatgcttcatttgtttcggattcataggttg

SEQ ID NO: 1710 - protein, 389 aa, Vitis vinifera
  GSVIVT01031341001
MGRHSCCYKQKLRKGLWSPEEDEKLLMHITKYGHGCWSSVPKLAGLQRCGKSCRLRWINYLRPDLKRGAFSQQEESLIIELHAVLGNRWSQIAAQLPGRTDNEIKNLWNSCIKKKLRQKGIDPNTHKPLVEAENGQDKLPNSDKSNEKANELNLVEAENLKPLSTAAEQPSGLVGHFSFQQLNYGPNIGLSSRTGKSAPSVIMPAAAMGAGTVILKTSNGLSISIPHFYWAPHYRTKALNLSIVRLSQEYISQQMGQVLAGIRTSRNNPYKLQLTYIPRISRDLVWLLDRFVNLYLTCGASNSRDERITGGFQSKKDLEKTSSGQVCAIEFSYDFVNRSDTKGLSYFLMNICNGNKLLFIFFHGSMVWNKVSFDVYSSSMLHLFRIHRL

SEQ ID NO: 1711 - DNA, 1338 bp, Citrus clementina
  clementine0.9_010206m
atggggaggcactcttgttgttacaagcagaagctaaggaaaggtttgtggtcacccgaagaagatgagaagcttttgaggcatattactaagtatggccatggttgctggagctctgtccccaagcaagctggtttacagagatgtggtaagagttgcagacttagatggattaattatttgaggcctgatttgaagagaggcacattctcacagcaagaagagaaccttataattgagcttcatgcagttctggggaatagatggtctcagattgcggcacaactgcccggtagaaccgacaatgaaataaagaatctgtggaattcttgcttaaagaagaagctcaggcagagaggcattgaccctgtaacgcataagccactttctgaagttgaaaatggagaagacaagaatcaaacaacaaacagccaagacaaagtctctggggtatctggtgaattgaacctcctcaacactgagcttaccgcaaagcatgggacaacggcagctttaaatgagcagaaaccaacttcagttactgcacaagcctaccatttgtcggaaatacaaggctcttcaatccccagcacagtcaacaacaatagaagcaatttttatacacacagatttgcaagttccaaccaagaaagcagcagcatcaccaatagccagccttcagattttgtggggcattttcctcttcaacaattgaattgtgcttccaatgcaagactttcaacagcagcctcaaattcccctctctggtttatgcaaaccagtaaatcattcgatataaattctcaattctcgtccaatgcaatgcccacaatcctgccccctgtatctagctcatcattattttcagctcctatgagctacaaaacatctgtcactcttccctcagataatcattcgataccctcttttacggtcaatggatcccggtactgggaagccggtggtgcctcaaacagcaacagtgtaagcagtagcagcacagagctgcagagcaccagctccttccttgagagcagcatcttcccttggggactagcagattgcagctcatcagagaaagaaggtcaaatcaatcttattgatagccaccctgacgatgttaagtggccagaatatttccaaaccccatcattgctaatggccgctgctttgcaaaatcaaacttctcaatccttatacaatgagataaaatctgaaacacatttcctgactgatagctcgagtggtatatggcctcaaaaccagcaacaacctttacaaaattctgacatatgtgctaaggagatccagagacttactgcaacgtatggacatatt

SEQ ID NO: 1712 - protein, 446 aa, Citrus clementina
  clementine0.9_010206m
MGRHSCCYKQKLRKGLWSPEEDEKLLRHITKYGHGCWSSVPKQAGLQRCGKSCRLRWINYLRPDLKRGTFSQQEENLIIELHAVLGNRWSQIAAQLPGRTDNEIKNLWNSCLKKKLRQRGIDPVTHKPLSEVENGEDKNQTTNSQDKVSGVSGELNLLNTELTAKHGTTAALNEQKPTSVTAQAYHLSEIQGSSIPSTVNNNRSNFYTHRFASSNQESSSITNSQPSDFVGHFPLQQLNCASNARLSTAASNSPLWFMQTSKSFDINSQFSSNAMPTILPPVSSSSLFSAPMSYKTSVTLPSDNHSIPSFTVNGSRYWEAGGASNSNSVSSSSTELQSTSSFLESSIFPWGLADCSSSEKEGQINLIDSHPDDVKWPEYFQTPSLLMAAALQNQTSQSLYNEIKSETHFLTDSSSGIWPQNQQQPLQNSDICAKEIQRLTATYGHI

SEQ ID NO: 1713 - DNA, 1305 bp, Eucalyptus grandis
  Eucgr.K00555.1
atggggaggcactcttgctgctacaagcagaagctgaggaaaggcctctggtcacctgaagaagacgagaagctcctcaggtacatcacgcagtatggccatggttgctggagctctgttcctaagcttgcaggtctgcagaggtgtgggaagagctgcagattgaggtggattaactacctgaggcctgatttgaagaggggcacattctctcaagaagaggaggacctcatcattgaacttcatgcagttctggggaacaggtggtctcagattgcggcgcaattgcctggaagaactgacaatgaaatcaagaacctgtggaactcttgcctgaagaagaagctgaggcaaaagggtatcgaccctgccactcacaagcccctctctgaggttgaacatggtggcgatgacaagagcacgacacccaaaagccacgaaagagccgcattctccgggtcctcaaatggtctgtcccagacccaacaagctcccaattcagagaacactctgcttgagcattgttccagttcaaacgccaacaatagcagcaagatcagcaatctgatgaattctagtcttgacaaagactgcttcccaaatgggcttctgagctccacctccagttgtcagccttctgatgatttggtgggtcatttcccacttcagccactgggaaattacgcgtccatttcaaggctctcagaagcaatctccaaccatagtccttggttcggacaaagcggcaaaagtttcagcataaacacggaattcggctgcagcacgatgcctgccatccttccgcattcaaacatttcatttcaccatgacccagtaggctttagacctgccatgaccgttccgaatgataattactgtttcaagccgttcacagtcgatgaatccagatattgggaagtcaatgctcctaccagtagcggtgcggcgaatgcagaattgttaggcagtggctcgtacttcgagaatagtatgctctcttggggactagagaattgcaacacaatggggaaagaagccgatatgaacaatcctccgggcggccatatcggggatatcaagttgcccgattactttcacgacccactattgataggagccgcttcacaacaccaagcgccgcaatctctgtacaacgagatcaagccggacactcattttgataccaattatagctcaagcgccatgtggcttcaaaatcagcaagaccaaggacttttgccatcatctgatacatcatcatgtcctaagaacatccaaagacttactgctctctttggacacatt

SEQ ID NO: 1714 - protein, 435 aa, Eucalyptus grandis
  Eucgr.K00555.1
MGRHSCCYKQKLRKGLWSPEEDEKLLRYITQYGHGCWSSVPKLAGLQRCGKSCRLRWINYLRPDLKRGTFSQEEEDLIIELHAVLGNRWSQIAAQLPGRTDNEIKNLWNSCLKKKLRQKGIDPATHKPLSEVEHGGDDKSTTPKSHERAAFSGSSNGLSQTQQAPNSENTLLEHCSSSNANNSSKISNLMNSSLDKDCFPNGLLSSTSSCQPSDDLVGHFPLQPLGNYASISRLSEAISNHSPWFGQSGKSFSINTEFGCSTMPAILPHSNISFHHDPVGFRPAMTVPNDNYCFKPFTVDESRYWEVNAPTSSGAANAELLGSGSYFENSMLSWGLENCNTMGKEADMNNPPGGHIGDIKLPDYFHDPLLIGAASQHQAPQSLYNEIKPDTHFDTNYSSSAMWLQNQQDQGLLPSSDTSSCPKNIQRLTALFGHI

SEQ ID NO: 1715 - DNA, 1392 bp, Populus trichocarpa
  POPTR_0002s18700.1
atggggaggcactcttgttgctacaagcagaagctacggaaaggcctgtggtcacctgaggaagatgagaaacttttaagtcatattactaagtatggtcatggttgttggagttctgtcccaaagcaagctggtttgcaaaggtgtggcaagagctgcagactaagatggattaattacttaaggcctgatttgaagagaggcacattctcacatctggaagagaacctcataattgaacttcatgcggttctaggaaacaggtggtctcagattgcggcgcagttgcctggaaggactgacaatgaaataaagaatctgtggaactcttgcttaaagaaaaaacttaagcagagaggcattgaccctgtcacccataaaccactttctgaggttgaagatggagaagacaagaatccagctgccagtagaaaccaagataaagcctctgcagtatccaatactgaactcaacctcctcaaagctgatcattctaagccattaggagcaaatttacaagaaaaaagatcatcttcaatttctcctcatggcaatcaattggagagggaaagtacttccagcttcaaggccatgaatgaaaacaacaacaataccaatgaccatggtaacaataatttgatgacaccaacaagcaacaaggactttttcttcgataggtttacagctttcctccatgaaggctccacgagtaattgcccgccctcgggttttgtgggacatttccctcttcagcaattgaattatgcatccaatgccaggctcgcgacgaactcaattccttctctttggttgagccaaaccagtaaagcttttggcatgaattgtgaattctcttcgactatgataccctccattcctccaccagctgtaacaagctcatttctttcttcttctatgggctacaagccttccattactgttccaccagacaatccttcattgccctcttttacaaccaacagttatcggccgtgggaaaccggtgctcccagcaacaatagtaacagcagtactggaagcaatggcagtactgagctgcaaagcaacagctccttctttgagaacaccatcttttcttggggattaggagactgtagctcaacagaaaaggaggcacagaaccacttgattggaagccaacaggaggacatcaggtggcctgaatatcttcaaaatccattgctcatggctgcttctttgcaaaatcaaaatcagcaatccttgtacaatgagataaaaacagaaacacatctcctaacagaaaatccaagtggtatgtggcctgataaccagcaggaacaggaacctttacagaatcctgatatatgtccgaaagatatgcagagaatcacagcatcttatggatatgtt

SEQ ID NO: 1716 - protein, 464 aa, Populus trichocarpa
  POPTR_0002s18700.1
MGRHSCCYKQKLRKGLWSPEEDEKLLSHITKYGHGCWSSVPKQAGLQRCGKSCRLRWINYLRPDLKRGTFSHLEENLIIELHAVLGNRWSQIAAQLPGRTDNEIKNLWNSCLKKKLKQRGIDPVTHKPLSEVEDGEDKNPAASRNQDKASAVSNTELNLLKADHSKPLGANLQEKRSSSISPHGNQLERESTSSFKAMNENNNNTNDHGNNNLMTPTSNKDFFFDRFTAFLHEGSTSNCPPSGFVGHFPLQQLNYASNARLATNSIPSLWLSQTSKAFGMNCEFSSTMIPSIPPPAVTSSFLSSSMGYKPSITVPPDNPSLPSFTTNSYRPWETGAPSNNSNSSTGSNGSTELQSNSSFFENTIFSWGLGDCSSTEKEAQNHLIGSQQEDIRWPEYLQNPLLMAASLQNQNQQSLYNEIKTETHLLTENPSGMWPDNQQEQEPLQNPDICPKDMQRITASYGYV

SEQ ID NO: 1717 - DNA, 1392 bp, Populus trichocarpa
  POPTR_0014s10680.1
atggggaggcactcttgttgctacaagcagaagctaaggaaaggcctgtggtcgcctgaggaagatgagaaactcttaaggcatatcaccaagtatggccatggttgttggagctctgtcccaaagcaagctggtttgcaaaggtgtggcaagagctgcagactaaggtggattaattacttgaggcctgatttgaagagaggcacattctcacagcaggaagagaacctcataattgagcttcatgcagttctaggaaataggtggtctcagattgcggcacaattgcctggaaggacagacaatgaaataaagaatctatggaactcctgcttaaagaaaaaacttcggcagagaggcattgaccctgttacccacaaaccactttctgaggttgaaaatggagaagacaagaatccacctgctagtggcacccaagataaagcctctgcagtctccaatactgaactcaacctcctcaaagctgataattctaagtcatcaggagcaaatttacaagaaaaaagatcatctccaatttctccaaatggctaccaattggagagggaaagtacttccggctccaaggtcatgaatggcaacggcaataacaccaatgaccatgttaacaacaatttgatgacaccaacaagcaacaaagactttttcttggataggtttacagcctcccaccatcaaggttccacaagtaactgccagccttcggatttcgtggggcatttccctcttcagcaattgaattatgcatccaatgccaggctcgcaacgaactcgattccctccctctggttgagccaaaccagcaaagcctttgacatgaactctgaattctcttcgactgcgataccctccattcttccaccagcagtaacaagctcatttcattctacttctatgagctacaagccttccattactgtttcacctgacaatccttcattgccctcttttactaccaacagctgtcggctgtgggaaaccggtacccccagaagcaacagtaacagcaatactgtaagcaatggcagtaccgagctgcaaagcaacagctccttctttgagaacgccatcttttcttggggactaggagagtgtggctcagcagaaaaagaggcacagaaccacttgatgggaagccagcacgaggacatcaagtggcctgaatatcttcaaaatccattgctcatggctgctgctttacaaaatcaaaatcagcaatcattgtacaatgagataaaatcagaaacgcaagtcgtaactgaaaattcaagtggtatgtggcctcataaccaccagcagcagcaacctttacaaaatcctgatatatgtcccagggatattcagagaattacagcatcatatggatatatt

SEQ ID NO: 1718 - protein, 464 aa, Populus trichocarpa
  POPTR_0014s10680.1
MGRHSCCYKQKLRKGLWSPEEDEKLLRHITKYGHGCWSSVPKQAGLQRCGKSCRLRWINYLRPDLKRGTFSQQEENLIIELHAVLGNRWSQIAAQLPGRTDNEIKNLWNSCLKKKLRQRGIDPVTHKPLSEVENGEDKNPPASGTQDKASAVSNTELNLLKADNSKSSGANLQEKRSSPISPNGYQLERESTSGSKVMNGNGNNTNDHVNNNLMTPTSNKDFFLDRFTASHHQGSTSNCQPSDFVGHFPLQQLNYASNARLATNSIPSLWLSQTSKAFDMNSEFSSTAIPSILPPAVTSSFHSTSMSYKPSITVSPDNPSLPSFTTNSCRLWETGTPRSNSNSNTVSNGSTELQSNSSFFENAIFSWGLGECGSAEKEAQNHLMGSQHEDIKWPEYLQNPLLMAAALQNQNQQSLYNEIKSETQVVTENSSGMWPHNHQQQQPLQNPDICPRDIQRITASYGYI

SEQ ID NO: 1719 - DNA, 1242 bp, Eucalyptus grandis
  Eucgr.A00996.1
atggggaggcattcttgctgttacaagcagaagctcagaaaaggcttatggtcacctgaagaggatgagaagcttctgaggcatatctctcagtatggccatggttgttggagctctgtcccaaagcaagccggtctacagagatgcggcaagagctgcagattgaggtggattaattacttgaggcccgatttgaaaagaggggcgttctcgcaagatgaagaggacctcattattgagctccacgctgctcttgggaacaagtggtcgcagattgcagcaaacttgcctggcagaactgacaatgagataaagaacctgtggaattcttgcctgaagaaaaagctcaggcagagaggcattgaccctgtgagccacaggcctctctctgaggttgagaatagtgacgacaaggacgcaacgtcagggcagacccaagataaggtctctcgtgggtcagttgaattgctgagccagctcaatccacaattctcaagctccacgacagcaaggagcagtaaaaacagcaatttgatggcaccaacattgagcaaggacacagttgcagatgggtttgtgagcaatcaccaagagaactcgatgatgaacagttgcatctcagactttgttgataatttctctctgcaacaattgaactactcatcaagtgattccagattttctaatctctgtttcacccaaacgggcagagcacatggaaacaccatcttttccgacttcaattcgaatgtaatatctgccatttctcctccctcatctaactctttattccctactgcttcaatgggcttcaacttcaagccatctaatgctgtcccctcggcgaattcgacttcaagcgctagcacaggaactgcagattttcacaacagtggctcctacttcgggaacagcttagtttcctggggattgttagcagattgtggctcgccagacaaggagggatcgacttcgatccatccattggaagttcaccaacccggagacttcaagtgggctgccgaatatctccagaaccctctgttcatggcggccgcgctgcagaaccaagcccaggaacagtccaatttgtacaatcagataaagccagagacccagtttcctccagaccattcaactacttccatgtgggatcatctacagggacatgaatccttggacaattctttgaatacgtgcggcaaggatatccagagattaacggcgctactcggacacaat

SEQ ID NO: 1720 - protein, 414 aa, Eucalyptus grandis
  Eucgr.A00996.1
MGRHSCCYKQKLRKGLWSPEEDEKLLRHISQYGHGCWSSVPKQAGLQRCGKSCRLRWINYLRPDLKRGAFSQDEEDLIIELHAALGNKWSQIAANLPGRTDNEIKNLWNSCLKKKLRQRGIDPVSHRPLSEVENSDDKDATSGQTQDKVSRGSVELLSQLNPQFSSSTTARSSKNSNLMAPTLSKDTVADGFVSNHQENSMMNSCISDFVDNFSLQQLNYSSSDSRFSNLCFTQTGRAHGNTIFSDFNSNVISAISPPSSNSLFPTASMGFNFKPSNAVPSANSTSSASTGTADFHNSGSYFGNSLVSWGLLADCGSPDKEGSTSIHPLEVHQPGDFKWAAEYLQNPLFMAAALQNQAQEQSNLYNQIKPETQFPPDHSTTSMWDHLQGHESLDNSLNTCGKDIQRLTALLGHN

SEQ ID NO: 1721 - DNA, 1134 bp, Glycine max
  Glyma02g00960.1
atgggaaggcactcttgttgttacaagcagaagcttaggaagggtctttggtctcctgaggaggatgaaaaacttctgaggcatattactaagtatggtcatggatgttggagttctgtgcctaagcaagcaggtctgcaaaggtgtggtaagagctgcaggcttaggtggatcaattatttaaggcctgatttaaaaagaggaacattctcacaagaagaagaaaaccttatcattgaacttcatgcagtattagggaacaggtggtctcaaattgcggcacagttgccggggagaacagacaatgaaataaagaatctgtggaactcttgcttgaagaagaaactgaggcaaaagggaatagaccctgtcacacataaaccactgtctgaggttgagaatggagagaaagcagcagaagtgtctaatgaactgaacctcctgaaatcagagagctccaaccgccaagagagttacaccactagttgccagccctcagatttgatggggaattttccaattcagatgagttatgcaaccaatgatcagtgtctccctaatgattcaaactctagtcattggttcagccaaactggaaggtcttttgatatgaacactgagtttcctttcaatgccgctgtcacttctatcaatcctacacctacaaccaacttgtttcttcctaataattctttttgctacaagccttcacttgctgttccctctgacaatgtttccataccctatggatcccattactgggaagccagtgcctccaacaacagcaatagtagcacagaattgagaagtagcagccccttgaacatcttttcttcttggggattggcagattgtggcacctctactactaaagaggcacaaattcatatgatggagaatcataatacagaagaagctaagtgggatgagtaccttcataaccctatctcaatgctggcttcttctgtacaaaaccaagctcctgagtctctatgcaatgatataaaaacatccatgcatttggtacctgatactttaggggctatgctacctcataaccataccaagcagcaagaacagtctcaaacttctagtttcttttccaaggacatccagaagctcagggcagccttt

SEQ ID NO: 1722 - protein, 379 aa, Glycine max
  Glyma02g00960.1
MGRHSCCYKQKLRKGLWSPEEDEKLLRHITKYGHGCWSSVPKQAGLQRCGKSCRLRWINYLRPDLKRGTFSQEEENLIIELHAVLGNRWSQIAAQLPGRTDNEIKNLWNSCLKKKLRQKGIDPVTHKPLSEVENGEKAAEVSNELNLLKSESSNRQESYTTSCQPSDLMGNFPIQMSYATNDQCLPNDSNSSHWFSQTGRSFDMNTEFPFNAAVTSINPTPTTNLFLPNNSFCYKPSLAVPSDNVSIPYGSHYWEASASNNSNSSTELRSSSPLNIFSSWGLADCGTSTTKEAQIHMMENHNTEEAKWDEYLHNPISMLASSVQNQAPESLCNDIKTSMHLVPDTLGAMLPHNHTKQQEQSQTSSFFSKDIQKLRAAFG

SEQ ID NO: 1723 - DNA, 1368 bp, Glycine max
  Glyma10g27940.1
atgggaaggcactcttgttgttacaagcagaagcttaggaagggtctttggtctcctgaggaggatgaaaaacttctgaggcatataacaaagtatggtcatggatgttggagttctgtgcctaagcaagcaggtttgcaaaggtgtggtaagagctgcaggcttaggtggatcaattacttaaggcctgatttaaagagaggaacattctcacaagaagaagaaaaccttatcattgaacttcatgcagtattagggaacaggtggtctcaaattgcagcacagttgccggggaggacagacaatgaaataaagaatctgtggaactcttgcttgaagaagaaactgaggcaaaagggaatagaccctgtcacacataaaccactttctgaagttgagaatggagaggacaatggtaggagccaagagaaagcaccagaagtgtctaacgaactgaacctcttgaaatcagagagctccaaatctgattcagcttcctatgagcagagaacatcaatttctccaaaagcctatgcacctgaggtggatggttcctgcagctccaagattgaaagcaattttgtaaccaacaacaactgttacagcaaagacttgttcctagacaggtttatgagttcgagtagtagccgccaagagagctacaccaatagttgccagcccttagatttgatggggaattttccaattcagatgagttatgcaaccaatgatcacagtctcccaaatgattcaaattctggtcattggttcagccaaactggaaggccttttgatatgaactctgatcagtttcctttcaatgctgttgccacttctattaatccaacacctacaagtacaaccaacttgtttcttcctaataattctttttgctacaagccttcttcacttgctgttccctctgacagtgtttccacaccctatggatcccattactgggaagccagtgcctccaacaacagcaatagcagcattaggagtaatagcagcacagaattgagaagtagcagccccttgaacaacatcttttcttcttggggattggcagattgtagcatctctactactactactaaagaggcacagattcatatgatggagaatcacaatacagaagaacctaagtgggatgagtaccttcataaccctatctcaatgctggcttcttctgtacaaaaccaagctcctgagtctttatgcaatgagataaaaacatccatgcatttggtacctgatactttaggggctatgttacctcatattcataccaagcagcacgaacagtctcaaacttctagtttcttttccaaggacatccagaagctcagggcagcctttggacacatg

SEQ ID NO: 1724 - protein, 456 aa, Glycine max
  Glyma10g27940.1
MGRHSCCYKQKLRKGLWSPEEDEKLLRHITKYGHGCWSSVPKQAGLQRCGKSCRLRWINYLRPDLKRGTFSQEEENLIIELHAVLGNRWSQIAAQLPGRTDNEIKNLWNSCLKKKLRQKGIDPVTHKPLSEVENGEDNGRSQEKAPEVSNELNLLKSESSKSDSASYEQRTSISPKAYAPEVDGSCSSKIESNFVTNNNCYSKDLFLDRFMSSSSSRQESYTNSCQPLDLMGNFPIQMSYATNDHSLPNDSNSGHWFSQTGRPFDMNSDQFPFNAVATSINPTPTSTTNLFLPNNSFCYKPSSLAVPSDSVSTPYGSHYWEASASNNSNSSIRSNSSTELRSSSPLNNIFSSWGLADCSISTTTTKEAQIHMMENHNTEEPKWDEYLHNPISMLASSVQNQAPESLCNEIKTSMHLVPDTLGAMLPHIHTKQHEQSQTSSFFSKDIQKLRAAFGHM

SEQ ID NO: 1725 - DNA, 1371 bp, Glycine max
  Glyma03g38410.1
atgaatatgccactccggctgacatttcacctacaagttctattcaataagccatcagttaattggagaggtagttcacccccttatttttggtggggaaaaaaaccacaatacaagatgggaaggcactcttgctgttacaaacagaaacttaggaagggtctttggtcaccagaagaagatgaaaaacttttgaggcatattactaagtacggtcatggatgttggagctcagttcctaagcaagcaggtttgcagaggtgcggcaaaagctgcaggcttaggtggatcaattatttaaggcctgatttgaagagaggtacattttcacaagaggaggaaaatctcatcattgaacttcatgcagtgctagggaacagatggtctcaaattgcagcacaattgccagggaggactgacaatgaaataaagaatctgtggaattcttgcttaaagaagaaactcaggcaaagaggaatagaccctgtgacacataagccactgtcagaggttgagaatggagaggagggcaaaacgaggagccaagaattatccaatgaactgaacctcctgaattcagagagcttcaagtcagatgaagggtcctatgagcagagagcatcatcaattgcccccaaagcctatgagatggaaggctcttgcagctccaagattaacaacaccaaaaacgacaccaacttgatgtccaattgttccaacaaagacatgttcctagacagctacaccactagttgccaaccctcagatttgatgggaaattaccctcttcatatcactgacactctcccaaccaattcaaactcttgccattggttcagccaaactgcaagaccctttgatataaactcaaactctgagtttacaattacttccaatgttatgtccattcttccacctacaacaacctcattcctcccaagtacttctttttgctacaagccatcacttggtgtcccttcagaagatatttcagcaccctcttttggattgaatggtcccagttactgggaagcaagtgcctccaacaacagcaatggaagcaacaacacgagtgatggcagcagagagttgacaactacaagtagcaagaacagtgtgctctcttcttgggaattgacagaagaagcaaagtggtctgagtacctccacaacccaatgttaatgctggcagctcctgaatcattgtgcaaccaaattaggccagccacacatttgatacctgataacactttaggggcaataatattgcctgattccaagaatcaacaacaacaacaacaacaacagtctcaaaattcttgcatcttctccaaggacgtgcagaagctaacagcagcatttggacatata

SEQ ID NO: 1726 - protein, 457 aa, Glycine max
  Glyma03g38410.1
MNMPLRLTFHLQVLFNKPSVNWRGSSPPYFWWGKKPQYKMGRHSCCYKQKLRKGLWSPEEDEKLLRHITKYGHGCWSSVPKQAGLQRCGKSCRLRWINYLRPDLKRGTFSQEEENLIIELHAVLGNRWSQIAAQLPGRTDNEIKNLWNSCLKKKLRQRGIDPVTHKPLSEVENGEEGKTRSQELSNELNLLNSESFKSDEGSYEQRASSIAPKAYEMEGSCSSKINNTKNDTNLMSNCSNKDMFLDSYTTSCQPSDLMGNYPLHITDTLPTNSNSCHWFSQTARPFDINSNSEFTITSNVMSILPPTTTSFLPSTSFCYKPSLGVPSEDISAPSFGLNGPSYWEASASNNSNGSNNTSDGSRELTTTSSKNSVLSSWELTEEAKWSEYLHNPMLMLAAPESLCNQIRPATHLIPDNTLGAIILPDSKNQQQQQQQQSQNSCIFSKDVQKLTAAFGHI

SEQ ID NO: 1727 - DNA, 1245 bp, Glycine max
  Glyma19g41010.1
atgggaaggcactcttgctgttacaaacagaaacttaggaagggtctttggtcaccagaagaagatgaaaaacttctgaggcatattacgaagtacggtcatggatgttggagctcagttcctaagcaagcaggtttgcagaggtgcggcaagagctgcaggcttaggtggatcaattacttaaggcctgatttgaagagaggtacattctcacaagaggaggaaactctcatcattgaacttcatgcagtgctagggaacagatggtctcaaattgcagctcaattgccagggaggaccgacaatgaaataaagaatctgtggaattcttgcctaaagaagaaactgaggcaaagaggaatagaccctgtgacacataagccactgtcagaggttgagaatggggaagaggacaaaacaagaagccaagagttatccaatgaattgaacctcctgaattcagagagcttcaagtcagatgaagggtcctatgagcagagagcatcatcatcaattgcccccaaagcctatgagatggaaggctcttgcagctccaagattaacaccaccaaaaatgacaccaacttgatgtccaattgttccaacaaagacatgttcttagacagctacaccactagttgccaaccctcagatttgatgggaaattaccctcttcaaatcactgacactctcccaaccaattcaaactcttgccattggttcagccaaactgcaagaccctttgatatgaactctgagtttacaatcacttccaatgttatgtccattcttccacctacaacaacctcatttctcccaagcacttctttttgctacaagccatcacttggtgtcccttcagaagatatttcaacagcatcttttgctttgaatggtcccaattactgggaagccagtgcctccaacaacagcaatggaagcaacaacacaagtgatggcagcagagagttgacaactacaagtagcaagaacagtgtactctcttcttggggattgacagaagaaacaaagtggtctgagtacctccaaaacccaatgctaatgctggcagctcctgaatcattgtgcaaccaaattaggccagccacacatttggtacctgataacactttagggtcaataatagtgcctgattccaaggaccaacaacaacaacaacaatctcaaaattctagcatcttctccaaggacacgcagaagctaacagcagcctttggacatata

SEQ ID NO: 1728 - protein, 415 aa, Glycine max
  Glyma19g41010.1
MGRHSCCYKQKLRKGLWSPEEDEKLLRHITKYGHGCWSSVPKQAGLQRCGKSCRLRWINYLRPDLKRGTFSQEEETLIIELHAVLGNRWSQIAAQLPGRTDNEIKNLWNSCLKKKLRQRGIDPVTHKPLSEVENGEEDKTRSQELSNELNLLNSESFKSDEGSYEQRASSSIAPKAYEMEGSCSSKINTTKNDTNLMSNCSNKDMFLDSYTTSCQPSDLMGNYPLQITDTLPTNSNSCHWFSQTARPFDMNSEFTITSNVMSILPPTTTSFLPSTSFCYKPSLGVPSEDISTASFALNGPNYWEASASNNSNGSNNTSDGSRELTTTSSKNSVLSSWGLTEETKWSEYLQNPMLMLAAPESLCNQIRPATHLVPDNTLGSIIVPDSKDQQQQQQSQNSSIFSKDTQKLTAAFGHI

SEQ ID NO: 1729 - DNA, 1254 bp, Glycine max
  Glyma03g38660.1
atggggagacactcttgctgctacaagcagaagcttcgtaaaggcctctggtctccggaggaagacgagaagcttttgaattacatcaccaaacatggccatggatgttggagctccgttccaaaactagctggtcttcagaggtgtggcaagagctgcagattaaggtggataaattatctcaggcctgatttgaagagaggagcattctcacagcaagaagagaattccattgttgaacttcatgcagtccttggcaacaggtggtcacagattgcagctcagttaccaggaagaactgataatgagataaagaatctatggaattcctgtctgaagaagaagcttaggcaaagaggcattgacccaaacacacaccaacccctctctgagattgagaatgacaaggacaagcctctcacagctgacaaaagcaaccagaaagcctccaatgaggtgatgagtcttgttgagccaccaaaaccaaagccaatagctactactgcaactacttctatgcctatggatagacatccccttgaagtttcttccacctccaagatcagcagtggcaacaacaacagcaccctagacaggtttgacagctccatcactagttctgatatgatgggaatgggatattttcctttccagcacctcaactatggaccaaacatgggactcactactactcccaacaacaccccactttgcttcataccaagttccacttcttctcaaatgatgtcagagctgaattccaccatgttccattctatgtttccaacacatgtaaaacccactgttagtcttcactctaacaacaacaacaacccttcttcaatatcctctgatggtgttcagaactgggaagtaggtaccatcagtaacaacaacaacaacaacaatgcaagcaaaagcaatgggagcagtagctgcagcatccaattacaaagcagcagcacaataacatgggggctgcagcaagcagaatctgccaccaaggcagaacaagaagacattaaatggtctgaatatctcaacaacacccctttctatctgggaaccacgccagtgcagcatcaaaccacaaactctctctacagtagtgatgaggtcaagccagaaacaacaggcttcatagcagacgaatcaagtaccatgagttggcaccacagccagcataattttcaaccttcggagatatataccaaagatctgcagagattttcagtggcttttggacaaaccctg

SEQ ID NO: 1730 - protein, 418 aa, Glycine max
  Glyma03g38660.1
MGRHSCCYKQKLRKGLWSPEEDEKLLNYITKHGHGCWSSVPKLAGLQRCGKSCRLRWINYLRPDLKRGAFSQQEENSIVELHAVLGNRWSQIAAQLPGRTDNEIKNLWNSCLKKKLRQRGIDPNTHQPLSEIENDKDKPLTADKSNQKASNEVMSLVEPPKPKPIATTATTSMPMDRHPLEVSSTSKISSGNNNSTLDRFDSSITSSDMMGMGYFPFQHLNYGPNMGLTTTPNNTPLCFIPSSTSSQMMSELNSTMFHSMFPTHVKPTVSLHSNNNNNPSSISSDGVQNWEVGTISNNNNNNNASKSNGSSSCSIQLQSSSTITWGLQQAESATKAEQEDIKWSEYLNNTPFYLGTTPVQHQTTNSLYSSDEVKPETTGFIADESSTMSWHHSQHNFQPSEIYTKDLQRFSVAFGQTL

SEQ ID NO: 1731 - DNA, 1302 bp, Glycine max
  Glyma19g41250.1
atggggagacactcttgctgctacaagcagaagcttcgtaaaggcctctggtctcctgaggaagacgagaagcttttgaattacatcaccaaacatggccatggatgttggagctccgttccaaaactagctggtcttcagaggtgtggcaagagctgcagattaagatggataaattatctcaggcctgatttgaagagaggagcattctcacagcaggaagagaactccatcattgaacttcatgcagtccttggcaacaggtggtcacagattgcagctcagttaccaggaagaactgataatgagataaagaatctatggaactcctgtctgaagaagaagcttaggcaaagaggcattgacccaaacacacaccagcccctctcagaggttgagaatgacaaggacaagcctcttacagctgacaaaagcaaccagaaagcctccaatgaggtgagtcttattgagccaccaaaaccaaagccaatatctactacttctatgcccatggatagatatccccttgaagtttcttcaactttcaagatcagcggtggcaacaacaacaataacaacagcaacagcaccctagacaggtttgacagctccatcactagttctgatatgatgggaatgggatatttcccttttcagcacttgaactatggatcaaacatgggactcactactacacccaacaacactccactttgcttcatgccaagttccacttcttctcaaatgatgtcagagctgaattccaccatgctccattctatgttcccaacacatgtaaaacccactgttagcctccactctaacaacaacaacaacccttcttccatatcctctgatggggttcagaactgggaaacaagtaccttcagtaataacaacaatgcaagcaaaagcaatgggagtagtagctgcagcatccaattacaaagcggcagcactaactttcttgatcatagcagcacaataacatgggggctgcaagcagaatctgccaccaaggcagataaagatgctcatgttgttgtacctttgcaatcatcggaacaagaagacattaaatggtctgaatatctcaacaacacccctttctctctgggaaccatgtcagtgcagcatcaaactacaaactctctctacagtagtgatgaggtgaagccagaaacaacaggcttcatagcagacgaatcaagtaccagttggcaccacagccagcattttcaaccttcggaaatatataccaaagatctgcagagattttcagtggcttttggacaaaccctg

SEQ ID NO: 1732 - protein, 434 aa, Glycine max
  Glyma19g41250.1
MGRHSCCYKQKLRKGLWSPEEDEKLLNYITKHGHGCWSSVPKLAGLQRCGKSCRLRWINYLRPDLKRGAFSQQEENSIIELHAVLGNRWSQIAAQLPGRTDNEIKNLWNSCLKKKLRQRGIDPNTHQPLSEVENDKDKPLTADKSNQKASNEVSLIEPPKPKPISTTSMPMDRYPLEVSSTFKISGGNNNNNNSNSTLDRFDSSITSSDMMGMGYFPFQHLNYGSNMGLTTTPNNTPLCFMPSSTSSQMMSELNSTMLHSMFPTHVKPTVSLHSNNNNNPSSISSDGVQNWETSTFSNNNNASKSNGSSSCSIQLQSGSTNFLDHSSTITWGLQAESATKADKDAHVVVPLQSSEQEDIKWSEYLNNTPFSLGTMSVQHQTTNSLYSSDEVKPETTGFIADESSTSWHHSQHFQPSEIYTKDLQRFSVAFGQTL

SEQ ID NO: 1733 - DNA, 1287 bp, Glycine max
  Glyma10g28250.1
atgggaagacactcttgttgctacaaacagaagttacggaaaggcctttggtctccagaggaagacgagaagcttctcaatcacatcaccaaacatggtcatggatgttggagctcggttcccaaactagctggtttgcagagatgtgggaagagctgcaggttgaggtggataaattatctaaggcctgatttgaagagaggagcattctcacagcaagaagagaacatgattgttgaacttcatgcagttcttggaaacaggtggtctcagattgcagcacagttaccaggaagaacagacaatgagattaagaacctatggaactcgtgcctgaagaagaagctgaggcaaagaggcattgacccaaccacacacaagccactctctgaggttgagaacgacaaggacatgaatatgatgccaccctcaaccgacaaaagcactcagaaagcctctgtgggatccaatgaagtagtgagtaatttggttgatcatcatcagccaccaaaaaccatgcctaattcttcatcagagagataccctcttgaagtttccactactagttccacccaggaactgttcctagataggtttggcaccaccaccaccacctgccacgaaaacaacaacaacacttctgatttggtaggatcatacttctccttccagcacttgaactatggaacaacaacaagcatggccctctcttcaaaccccaacacctctctttgtttcattctaccctccacttcttcagacattaataataacaactccatcataacctcctcctccatgctcccttcaattttcccaacacaacatgtgaagctccaatctaataacaacaacccttcttccatttcatctgatggggttcaaaactgggaaacaagtaacaacacaaacaaaaacaatgggaatatgcagttacaaagtagcacaaactaccttgacagcacgtggggggtggcagagtctatgaagattgttaacattaacaaagaggctcaagtagtgcctctacaagcagaacaagaagatctaaaatggtctgagtatcttaacaccccgtttattctgggaaacaacacaacgcagaatcatcaaattcaaacctctcaatctatctacactgaggttattaaaccagaaacaggtttcataatagacgagtcatgtactagtaattggcaccatcatcagccaccaccagcttttcaactttccgatatatatagcaaggatctgcagagattttcagtgactttcggacaaaccctg

SEQ ID NO: 1734 - protein, 429 aa, Glycine max
  Glyma10g28250.1
MGRHSCCYKQKLRKGLWSPEEDEKLLNHITKHGHGCWSSVPKLAGLQRCGKSCRLRWINYLRPDLKRGAFSQQEENMIVELHAVLGNRWSQIAAQLPGRTDNEIKNLWNSCLKKKLRQRGIDPTTHKPLSEVENDKDMNMMPPSTDKSTQKASVGSNEVVSNLVDHHQPPKTMPNSSSERYPLEVSTTSSTQELFLDRFGTTTTTCHENNNNTSDLVGSYFSFQHLNYGTTTSMALSSNPNTSLCFILPSTSSDINNNNSIITSSSMLPSIFPTQHVKLQSNNNNPSSISSDGVQNWETSNNTNKNNGNMQLQSSTNYLDSTWGVAESMKIVNINKEAQVVPLQAEQEDLKWSEYLNTPFILGNNTTQNHQIQTSQSIYTEVIKPETGFIIDESCTSNWHHHQPPPAFQLSDIYSKDLQRFSVTFGQTL

SEQ ID NO: 1735 - DNA, 1284 bp, Glycine max
  Glyma20g22230.1
atgggaagacactcttgttgctacaaacagaagttacggaaaggcctttggtctccagaggaagacgagaagctgctgaattacatcaccaaacatggtcatggatgttggagctcggttcccaaactagctggtttgcagagatgtggcaagagctgcaggttgaggtggataaattacctgaggcctgatttgaagagaggagcattctcacaacaggaagaaaacatgattgttgaacttcatgcagttcttggaaacaggtggtctcagattgcagcacagttaccaggaagaacagacaatgagattaagaacctatggaactcttgcctgaagaagaagctgaggcaaagaggcattgacccaaacacccacaagccactctctgaggttgagaacgaaaaggacatgatgccaccctcaaccgacaaaagcactcagaaagcgtctgtgggatccaatgaagtgagtctggttgatcatcaccagcaacaaccaaaaatcatgcctaattcatcatcagagagataccctcttgaagtttccacaactagttccacccaggaactgttcctagataggtttggtacccccaccacctgccaccaccaccacaacaacaacaacacttctgatgttgtaggatcatacttctccttccagcacttgaactatggaacaacaacaaacatgtccctctctgcaaaccccaacgcctctctttgttttgttccagcctccacttcttcagaccttaataacaattccaccataacctcctccatgctcccttcaattttcccaacacaacacgtgaagctccaatctaataacaacaacccttccatttcatctgatggggttcaaaactgggaaacaagtaacttaaataacagcaacagcacaaacaaaaacaatgggagtatgcagttacaaagctgcacaaacttcattgacaacacgtggggggtgggagagtctatgaaggttgttaacatcaacaaagatgctgatcaaatgcctctacaagcagaacaagaagatctgaaatggtctgagtatcttaataccccgtttattctgggaaacaacacagcgcagaatcatcaaattcatacctctcaatctatctatagtgaggttaaaccagaaacaggtttcataacagacgagtcatgtgctacatggcaccattatcagaatcagacaccagcttttcaactttccgatatatatagcaaggatctgcagagattttcagtgactttcggacaaaccctg

SEQ ID NO: 1736 - protein, 428 aa, Glycine max
  Glyma20g22230.1
MGRHSCCYKQKLRKGLWSPEEDEKLLNYITKHGHGCWSSVPKLAGLQRCGKSCRLRWINYLRPDLKRGAFSQQEENMIVELHAVLGNRWSQIAAQLPGRTDNEIKNLWNSCLKKKLRQRGIDPNTHKPLSEVENEKDMMPPSTDKSTQKASVGSNEVSLVDHHQQQPKIMPNSSSERYPLEVSTTSSTQELFLDRFGTPTTCHHHHNNNNTSDVVGSYFSFQHLNYGTTTNMSLSANPNASLCFVPASTSSDLNNNSTITSSMLPSIFPTQHVKLQSNNNNPSISSDGVQNWETSNLNNSNSTNKNNGSMQLQSCTNFIDNTWGVGESMKVVNINKDADQMPLQAEQEDLKWSEYLNTPFILGNNTAQNHQIHTSQSIYSEVKPETGFITDESCATWHHYQNQTPAFQLSDIYSKDLQRFSVTFGQTL

SEQ ID NO: 1737 - DNA, 1374 bp, Citrus clementina
  clementine0.9_009770m
atggggaggcattcttgttgttacaagcagaagctgaggaaaggcttgtggtctcctgaggaagatgagaagctcctgaattatatcactaagcacggccatggctgctggagttctgtccctaaattagccggtaaaatttatttagaaaataacaatcatgcttgctctgttattttaatgttcaatgcatttaacacaatgtttttacttgcaggccttcaaagatgtggcaaaagctgcagattaagatggattaattaccttaggcctgatttgaagagaggagcattttccgtacaggaagagagtttgattgttgagctccatgcagtgcttggcaacagatggtctcagattgcagctcagttaccgggaagaactgataatgagataaagaatctatggaattcaagcattaagaagaagctgaggcaaaggggcattgaccccaatactcacaagccgctttctgaggttgaaaacgataaagaacagcagctcacggtcatcaacaagaacagtgacaaagcctctgcagaatcatcaaaagacttggctgctgaaataatgcacccacttgaagtctcttcgagctctgagatcaacactaacaataataataatgccagcatgttaaatttggtagataagtttgctgcagctgcttctaacaacgaaagctcaaccacaagttgtaggcctgatttgatgggatattttccctttcagaagttgaattatggccccaatattggtctctcagttaacacaaacacttcttctctttttttcaatccgaattccacctcttctgagatgatttctgagtttaattccagcataatcccttctatttcggcatcagtcttccaaactccaattcgcgtaaagccttctattagtcttccttccgagaatccttctgtaggcactagtgacatcaatggaatacaaaactgggaacctagtagctttagcaacaattgcagcaccagcaatggaagcacaacaagtattgaactgcagagcagcagtagcttctttgaaggcaacgtcttctcttggggaataactgcagattgtggcaaatctaatgatcaagaagctcaaattcgcgcattagaaggcgatcaagaagatatcaaatggtctgagtacctcaacactccattctttcttggaagcacaatacaaaatcatcaaacctctcagtctatgtacagtgatgttaaaccagaagcacattttatatcagaaggctcaaacaccaccacttggattcaaaaccagcatcaacaagcttcacaaactacaccagcaatgtatacaaaggacttacaaagactttctgtggcttttggacaaaccctt

SEQ ID NO: 1738 - protein, 458 aa, Citrus clementina
  clementine0.9_009770m
MGRHSCCYKQKLRKGLWSPEEDEKLLNYITKHGHGCWSSVPKLAGKIYLENNNHACSVILMFNAFNTMFLLAGLQRCGKSCRLRWINYLRPDLKRGAFSVQEESLIVELHAVLGNRWSQIAAQLPGRTDNEIKNLWNSSIKKKLRQRGIDPNTHKPLSEVENDKEQQLTVINKNSDKASAESSKDLAAEIMHPLEVSSSSEINTNNNNNASMLNLVDKFAAAASNNESSTTSCRPDLMGYFPFQKLNYGPNIGLSVNTNTSSLFFNPNSTSSEMISEFNSSIIPSISASVFQTPIRVKPSISLPSENPSVGTSDINGIQNWEPSSFSNNCSTSNGSTTSIELQSSSSFFEGNVFSWGITADCGKSNDQEAQIRALEGDQEDIKWSEYLNTPFFLGSTIQNHQTSQSMYSDVKPEAHFISEGSNTTTWIQNQHQQASQTTPAMYTKDLQRLSVAFGQTL

SEQ ID NO: 1739 - DNA, 1323 bp, Populus trichocarpa
  POPTR_0005s00340.1
atggggaggcattcttgctgttacaagcagaagttaagaaaaggcctgtggtctcctgaggaagatgagaaacttctgaattatattactaagcatggacatggctgttggagctctgtccctaaacaagcagatttgcagaggtgtggaaagagctgcaggttaagatggattaactacttgaggcctgatttgaagagaggagcattttcacagcaggaagaaaacttgataattgaactccatgcagttcttggcaatagatggtctcagattgcagcacagttacctggaagaactgataatgagataaagaatttatggaactcctgcattaagaagaagctgaggcagagaggcattgaccccaacactcacaaacctctctctgaagttgagaattgtaaagagaagcagcagcctacagctgacaagagcaatgagaaagtttctaatgtatcaaatgaactgaacctcattgaggcagctactttacaaccacctgcaatttcttccagctcaaagatcaacaacagtaaggacaggaatagtagtagcagcaacatgacaaatacaccaccgacaaaggaattcttcctggataggtttggtacctcccatgaaagctcccctgccagttgcaggccttctgatttgatggggtattttcctttccagaagttggattacaaacctagtataggcctctcaatgaatccaaataccactctctgcttcaatccaaattcctcttctgagatgatttctcatgagttcaattcttgtatgacaccaccgactattctcccatctgtttcaacctctatgttccaaactccaatacgtgtaaagccttctgttagtcttccatctgatcataatccttctgtaggctcttgtgatgtcaatggggttcagaactgggaagcaagtagcttcagcaacaatggaagtggaagcaatggaagcagtagcagtattgaattgcaaagcaacaccaatttctacgagagcagcgctttctcatgggggttagctaattgtgggaaatccggcgaggaatctcaccttcggtcactcgaaaacgacacagctgaagacatcaaatggtctgaatatcttaacaccacattctttcttggaagcacaatacaaaaccaaacatctcaacatgtgtacagtgaagtgaaaccagaaacacacttcatagcagaagggtcaagtgctagttggataccgaaccagcatcaacaagcttcacagccagcagacatctataccaaggatctgcaaagacttgctgtggcttttggacaatccctt

SEQ ID NO: 1740 - protein, 441 aa, Populus trichocarpa
  POPTR_0005s00340.1
MGRHSCCYKQKLRKGLWSPEEDEKLLNYITKHGHGCWSSVPKQADLQRCGKSCRLRWINYLRPDLKRGAFSQQEENLIIELHAVLGNRWSQIAAQLPGRTDNEIKNLWNSCIKKKLRQRGIDPNTHKPLSEVENCKEKQQPTADKSNEKVSNVSNELNLIEAATLQPPAISSSSKINNSKDRNSSSSNMTNTPPTKEFFLDRFGTSHESSPASCRPSDLMGYFPFQKLDYKPSIGLSMNPNTTLCFNPNSSSEMISHEFNSCMTPPTILPSVSTSMFQTPIRVKPSVSLPSDHNPSVGSCDVNGVQNWEASSFSNNGSGSNGSSSSIELQSNTNFYESSAFSWGLANCGKSGEESHLRSLENDTAEDIKWSEYLNTTFFLGSTIQNQTSQHVYSEVKPETHFIAEGSSASWIPNQHQQASQPADIYTKDLQRLAVAFGQSL

SEQ ID NO: 1741 - DNA, 1338 bp, Populus trichocarpa
  POPTR_0013s00290.1
atggggcggcattcttgctgttacaagcagaagttaagaaaaggcctgtggtctcctgaggaagatgagaaacttcttaattatattactaagcatggacttggttgttggagctctgtccctaaactggcaggtttgcagagatgtggtaagagctgcaggttaaggtggattaactacttgaggcctgatttgaagagaggagcattttctcagcaggaagagaacttgattattgaactccatgcagttcttggcaatagatggtctcagattgcagcacagttacctggaagaactgataatgagataaagaatttatggaattcctgcattaagaagaaactgaggcagagaggcattgaccccaacactcacaaatcactttctgaagctgaggatggtaaagggaagcagcagctcacagctgacaaaagcaatgagaaagtttctattgtatcaaatgaactgaacctcattaagacagctactttaaaaccacctgcagtttcttccagaagctcaaacgtcatcaccaccaacaacaataaggacagaagtggtagtagcaacttgacaaatgttccaccgacacaggaattcttcctcgacaggtttggtacctcccatgaaagctccaccacggccagttgcatgccttctgatttgatggattatttccctttccagaaattggattacaaacctattatagacctctcaatgaatccaaactccactctctgctttaatccaaattcctcctcttctgagatgatttctcatgagttcaattctagtatgacacctccgactattctcccatccgtgtcaacctctatgttccagactccaatatgtgtaaaaccttctgttagtcttccatctgatcataatccttctgtaggctcttgtgatgtcaatggggttcagaactgggaagcaagtagcttcagcaacaacggaagtggaagcaatggaagcagtagcagtattgaattgcaaagcaacaccaatttctttgagagcagcgccttctcgtggggtttagctgattgtgggaaatccagcgacgaagctcaccttcgatctctcgcaaacgagacggttgaagacatcaaatggtctgaataccttagcaccccattctttcttggaagcacaatacaaaaccaaacatctcaacatgtgtacagtgaagtgaaacctgaaacacacttcatagcacaagggtcaagtactagttggctaaagaatcaacatcaacaagcttcacagccagcagacatctataccaaggatctgcaaagacttgctgtggcttttggtcaatccata

SEQ ID NO: 1742 - protein, 446 aa, Populus trichocarpa
  POPTR_0013s00290.1
MGRHSCCYKQKLRKGLWSPEEDEKLLNYITKHGLGCWSSVPKLAGLQRCGKSCRLRWINYLRPDLKRGAFSQQEENLIIELHAVLGNRWSQIAAQLPGRTDNEIKNLWNSCIKKKLRQRGIDPNTHKSLSEAEDGKGKQQLTADKSNEKVSIVSNELNLIKTATLKPPAVSSRSSNVITTNNNKDRSGSSNLTNVPPTQEFFLDRFGTSHESSTTASCMPSDLMDYFPFQKLDYKPIIDLSMNPNSTLCFNPNSSSSEMISHEFNSSMTPPTILPSVSTSMFQTPICVKPSVSLPSDHNPSVGSCDVNGVQNWEASSFSNNGSGSNGSSSSIELQSNTNFFESSAFSWGLADCGKSSDEAHLRSLANETVEDIKWSEYLSTPFFLGSTIQNQTSQHVYSEVKPETHFIAQGSSTSWLKNQHQQASQPADIYTKDLQRLAVAFGQSI

SEQ ID NO: 1743 - DNA, 1278 bp, Solanum lycopersicum
  Solyc01g102340.2.1
atggggaggcattcttgttgctacaaacagaagttaaggaaaggcctttggtctcctgaagaagatgagaaacttataaagcatattactaaatttggtcatggctgttggagctctgtccctaaactagcaggtctccagaggtgtggaaaaagttgtagactgaggtggattaactacttgaggcctgatttgaaaagaggaacattctcacaggatgaagaaaatttgatcattgaacttcatgcagttcttgggaacaagtggtcgcaaattgcagctagattacctggaagaacagataacgagataaagaatctgtggaactcttcaattaagaaaaagcttaggcaaagaggaattgatcctaatacacacaagccactttccgaactagagaacgaagagaaagcgtcggcaaacagtaacactaagaacaatgacaaagtttcagaaagttcaaataatgaattcaattttgttgagaatggattttcaacagaaaaaccaattaagccggccgtatcttcaatgataaatactttggagcgttatccacttattcatgagccaaataatattgccccaccaactcatgaatttttcaccaccaattgcaagtctcctgatttgtctaattatctctcttttcacaattattctcccaacacgaatattctcttcaataccaaaacctcttcttcatctgctgctgacaatattatatctgatcatcagttcaattgtagcactttgacaaatgctactttttctactatgtcgaattcgattctcagtactaccatatcgccgttggcgcgtaattttaatatcaacaagtttcagaattgggaagcgtgtacgatcagcagcaatggcagcaacaatagtaatggtactagtaacagtatcgaattacaaagtaactgttcattcttcgataacaatgctgcagccgctttcgcttggggatcagcgggcgcaactgcagcagcagactgtacgggaaaatcggagagggaagaaatcaaatggtctgaatatttacaaacaccgttttcactaggtgttaacaataacacaatcgacactcatcatcaacatcaaattccttcgcatcatgaattgtacgacggggaaacaaaatcaaagacacaatttatgacccaaggttcatggcttcagaatcaaacgccgcagacttcttctctacagactgcagaattatacagtaacaacaatttccaaaggcttccagccgtttacggacaattttct

SEQ ID NO: 1744 - protein, 426 aa, Solanum lycopersicum
  Solyc01g102340.2.1
MGRHSCCYKQKLRKGLWSPEEDEKLIKHITKFGHGCWSSVPKLAGLQRCGKSCRLRWINYLRPDLKRGTFSQDEENLIIELHAVLGNKWSQIAARLPGRTDNEIKNLWNSSIKKKLRQRGIDPNTHKPLSELENEEKASANSNTKNNDKVSESSNNEFNFVENGFSTEKPIKPAVSSMINTLERYPLIHEPNNIAPPTHEFFTTNCKSPDLSNYLSFHNYSPNTNILFNTKTSSSSAADNIISDHQFNCSTLTNATFSTMSNSILSTTISPLARNFNINKFQNWEACTISSNGSNNSNGTSNSIELQSNCSFFDNNAAAAFAWGSAGATAAADCTGKSEREEIKWSEYLQTPFSLGVNNNTIDTHHQHQIPSHHELYDGETKSKTQFMTQGSWLQNQTPQTSSLQTAELYSNNNFQRLPAVYGQFS

SEQ ID NO: 1745 - DNA, 1194 bp, Solanum lycopersicum
  Solyc10g044680.1.1
atggggaggccttgctgttacaaaaagaagctgaggaaaggcctttggtgccctgaggaagatgagaaacttataaatcatgtaactaaatatggtcatggttgttggagttcagtccctaaactagccgctcttcagaggtgtggaaagagctgcagacttaggtggattaactacttgagacctgacctcaaaagaggaacattctcacaacaagaagagaatttgatcattcaacttcattcacttttagggaacaagtggtctcagattgcttctagattacctggaagaaccgacaatgaaatcaagaacttatggaactcttctattaagaagaaactaaggcaaaaagggattgatccaaacactcataaacttctatccgtaattgagaatgaagagaaggtatcagcaatcagtatgaatattgagaaagtctctgaaggctcaagtgaactgaatattattgaggattccaactacagaattaaatcaaagtcatctttagtgacaatgactatggacaactatcctagtaatacgactacttctgcagcgccactaacacacaaattctttcttgaaaggtttgttaccacacacgaaacctccaccgctagctgcaataagcctcttgatcagttgacaagttacctctcctttgagaaattgaattatggttcaaacattggcttgtccataaattcaaacaccaacaatctccttttaaactccaagaattcagaaatgtttactcatcaggtcaattctagcatcacaaatgataatattctgacatctccaatagcagcaatagcaagtaatgattcaatgcgcaatggaagcagtactagtattgaattgcaaaggaactcttctttcttcgatagcaatgccttctcctggggaactgcagattatgataaatcagaaaaagaagtcaatattcatccctccgtacctgatcctgatgacatcaaatggtctgagtatctccatacacaacttttaccaggcaatgcaatcaccaatgatcaaataactcaagatttatacagtgcaaaatcaagcatacaattcacaacacaaggttcattgctacagaaccaacaacaacagccttctttacaaactgcaaacatctacaataagcactatcagagaatttcagattcctttggacagttttca

SEQ ID NO: 1746 - protein, 398 aa, Solanum lycopersicum
  Solyc10g044680.1.1
MGRPCCYKKKLRKGLWCPEEDEKLINHVTKYGHGCWSSVPKLAALQRCGKSCRLRWINYLRPDLKRGTFSQQEENLIIQLHSLLGNKWSQIASRLPGRTDNEIKNLWNSSIKKKLRQKGIDPNTHKLLSVIENEEKVSAISMNIEKVSEGSSELNIIEDSNYRIKSKSSLVTMTMDNYPSNTTTSAAPLTHKFFLERFVTTHETSTASCNKPLDQLTSYLSFEKLNYGSNIGLSINSNTNNLLLNSKNSEMFTHQVNSSITNDNILTSPIAAIASNDSMRNGSSTSIELQRNSSFFDSNAFSWGTADYDKSEKEVNIHPSVPDPDDIKWSEYLHTQLLPGNAITNDQITQDLYSAKSSIQFTTQGSLLQNQQQQPSLQTANIYNKHYQRISDSFGQFS

SEQ ID NO: 1747 - DNA, 1317 bp, Eucalyptus grandis
  Eucgr.H01337.1
atgggaagacactcttgctgttacaagcagaagcttaggaaaggcctgtggtcacctgaggaagatgagaagctcctcaactacatcaccacgtatggccatggttgttggagcgcagtccccaaactagcaggtttgcaaagatgtgggaagagctgcaggctgagatggatcaattacttaaggcctgacttgaagagaggtgcattttctcaccaagaagagaacctcatcattgagcttcacgctgttcttggtaacagatggtctcagattgcggctcgattaccgggaaggactgacaatgagataaagaatttttggaactcttccctcaagaagaagctgagacaaggagggattgaccccaccactcacaagcccctctccgaggttgctgatgagaacgatcataaagacaaagacaagcccatcattcccagtatcacccaacacaacaacaatgatcatcatcaccagaaatcgtctagcaccgctgcatcatgcaagaaagcaaccctctttgaaccagcattgaacactgataatctcaaagttcatcatcagcagcattcccttgaagttcctgctagctcagagatgaggccttattctgagatgttcatgaaagatttcactttccagcagctgagcatgaactatgggacaagccttgggcttccggctagtctgcatctaagcagcaacactctttgcttcgatccacggtcatcatctgagaatataatgtctcagttcagttcggacatgagcacaccgaacatcatctcacctaccatgtcgagctcaagcaccgctgtcccagtaacttcagctcgtgtaaagccttccattagccttcccgcagaagctgctttcatggtcaacaacggagtcccaagttgggaagcatcacccggtaacaataattgtagcagtggaagtactaatggcaatggattggtaagcaataatagcagcatcaacaacaccgcgttctttgagagcaacaattgtttctcgtgggggcttggtgaaggtactaatgccagcaagtttgaaaagcatgtcccctttcaccaccccataggaagcaatacaacggaagaaaacagcagcaaatggtctgaatatctccagctgccaatcttgttcggaagcttgacacagaataacgatgaagcctctcatcatcatcaaccggtctcacacttccatttgatggatgggctgaacaacattcctagttggcaacagaagcatcaccaacaagccaatccagacacttttgctgctcctgttcttggtcaaactctt

SEQ ID NO: 1748 - protein, 439 aa, Eucalyptus grandis
  Eucgr.H01337.1
MGRHSCCYKQKLRKGLWSPEEDEKLLNYITTYGHGCWSAVPKLAGLQRCGKSCRLRWINYLRPDLKRGAFSHQEENLIIELHAVLGNRWSQIAARLPGRTDNEIKNFWNSSLKKKLRQGGIDPTTHKPLSEVADENDHKDKDKPIIPSITQHNNNDHHHQKSSSTAASCKKATLFEPALNTDNLKVHHQQHSLEVPASSEMRPYSEMFMKDFTFQQLSMNYGTSLGLPASLHLSSNTLCFDPRSSSENIMSQFSSDMSTPNIISPTMSSSSTAVPVTSARVKPSISLPAEAAFMVNNGVPSWEASPGNNNCSSGSTNGNGLVSNNSSINNTAFFESNNCFSWGLGEGTNASKFEKHVPFHHPIGSNTTEENSSKWSEYLQLPILFGSLTQNNDEASHHHQPVSHFHLMDGLNNIPSWQQKHHQQANPDTFAAPVLGQTL

SEQ ID NO: 1749 - DNA, 1353 bp, Eucalyptus grandis
  Eucgr.B01827.1
atgcttcaagcatctgctgatataattagtttacgacactcacaattcatttctgcgacatctatcactgtctctacctacaatattcctttcacacattctccatttcatttgcctcacagattagagcgattcttccggaaatctaggcacttttgcatgggaagacactcttgctgtcacaaacagaagctgaggaaaggtctgtggtctcccgaggaagatgagaaacttttgaactacatcgccaaatttggactcgggtgttggagctcagtcccaaagcttgcaggcttgcaaagatgtgggaagagttgccggttaaggtggataaactatctaaggcccgacttgaagagaggtgcattctcccagcaggaagagagtttgataattgaactccatgcagttctaggcaacagatggtcacagattgcagcgcatttgcctggaaggaccgacaacgagataaagaacttgtggaactccggattaaagaagaagctcaggaaaaatgggattgaccccaatacccacaagcccctttccttgtttgaaaacagtgaccaacaaaagtttcatgcaatatatgaagcctctgttgcatccactaaaccgaacctttcccaggccagttccacaagtagcagccagaatctgagagtgactccatctcctgagctctcatttaagaggcccggtatagtcgatgatggaagcttcatcacctgttttccacctgctggtatggtgggcgagctatgctttcagcacttaaaatgttcaggtaccatgggtctattggcaagttcagatactgctctacatcacgattggaattggagctcctcagatatcagtccaacacaggtccattcagctccaaagccaaatagaccctctgacagctattattgcaatattgatggcggtaatagtagccactggagcggcattgctccattgcagaatgttcatacctttgaaaactccccaaattcatatatatcggctgactgcgggagagtcgacaaagaaactgagactcacccatcggtgtttgatgcagaagttgcgaaatggttcgaatatctccaccacactccatttgtgtttaacctctcaccaagtggagcttctcaactggagcacagtgacgtgacgccatcagcaggcacatgctcagtgactggtggtggcttggtcagcaattgcccacatgatcagattctgcaagcttcaccaggctctgacatgtatggcaagactcttcaagttattgccgtttcttcagggcaaaattctccgtcttctttggagcctgtgaagaacaagtttcaagacaagaaagta

SEQ ID NO: 1750 - protein, 451 aa, Eucalyptus grandis
  Eucgr.B01827.1
MLQASADIISLRHSQFISATSITVSTYNIPFTHSPFHLPHRLERFFRKSRHFCMGRHSCCHKQKLRKGLWSPEEDEKLLNYIAKFGLGCWSSVPKLAGLQRCGKSCRLRWINYLRPDLKRGAFSQQEESLIIELHAVLGNRWSQIAAHLPGRTDNEIKNLWNSGLKKKLRKNGIDPNTHKPLSLFENSDQQKFHAIYEASVASTKPNLSQASSTSSSQNLRVTPSPELSFKRPGIVDDGSFITCFPPAGMVGELCFQHLKCSGTMGLLASSDTALHHDWNWSSSDISPTQVHSAPKPNRPSDSYYCNIDGGNSSHWSGIAPLQNVHTFENSPNSYISADCGRVDKETETHPSVFDAEVAKWFEYLHHTPFVFNLSPSGASQLEHSDVTPSAGTCSVTGGGLVSNCPHDQILQASPGSDMYGKTLQVIAVSSGQNSPSSLEPVKNKFQDKKV

SEQ ID NO: 1751 - DNA, 993 bp, Zea mays
  GRMZM2G147698_T01
atggcgaagcagtcgtgctgccacaagaagaagcttaggagagggctctggtcccccgaggaggacgagaagctcatgaaccacattgccaagtacggccacggctgctggagctccgtacccaagcttgcaggcctcgacaggtgtggcaagagctgcaggctgaggtggataaactacctgaggccagacctcaagaggggcacattctcgcaagaggaggaggacctcatcatacacctccactccttgctgggaaacaagtggtctcagattgcggcccagctgcctggccggacggacaacgaggtcaagaacttctggaactcgtacatcaagaagaggctcagggagcgcggcatcgaccccgccacccaccagccgctcgccgagcctgccgccgcagccactgccaccaccaccaccacggtctcccgccgcgcggtgtttggggacgtcgacctcatcccgactactactactactacaatccaggtgccgccgccgtcgttcgagggcggcccaatgctggagagcgtgaagctagcggtggagctggactggcccgtcgctggcgacggggtaacgtcaaggccatgctacctgcaggggggctgcttcgacatggacgcgctgcagcagcactgcggctccatcccgccggtgccggtcgtcccgtcggcctccgccagctccagcacgctgacctcgatggcggaagcggaacactgcagcaccaacaacgtcgccgccggcggcaacctcccatggctggagctcggggcaaacgcggtggctgacgccggcggccacgtcgtcggcagctgctacgccggcgcgctggacgagctcaggtggtcggagtacttcgacagtgccttccaggccgccgagagccagcaaggcgccctgcagccggggcagtgtgtctacggcggcaaggatgacgtcccggtgcacttcgacgtccatggcgggctaagcaactggtgc

SEQ ID NO: 1752 - protein, 331 aa, Zea mays
  GRMZM2G147698_T01
MAKQSCCHKKKLRRGLWSPEEDEKLMNHIAKYGHGCWSSVPKLAGLDRCGKSCRLRWINYLRPDLKRGTFSQEEEDLIIHLHSLLGNKWSQIAAQLPGRTDNEVKNFWNSYIKKRLRERGIDPATHQPLAEPAAAATATTTTTVSRRAVFGDVDLIPTTTTTTIQVPPPSFEGGPMLESVKLAVELDWPVAGDGVTSRPCYLQGGCFDMDALQQHCGSIPPVPVVPSASASSSTLTSMAEAEHCSTNNVAAGGNLPWLELGANAVADAGGHVVGSCYAGALDELRWSEYFDSAFQAAESQQGALQPGQCVYGGKDDVPVHFDVHGGLSNWC

SEQ ID NO: 1753 - DNA, 1698 bp, Arabidopsis thaliana
  AT2G46510.1
atgaatatgagtgatttaggttgggatgatgaagataaatcggtggttagtgctgttttagggcatttagcttctgattttcttcgagcaaactctaattcgaatcagaatctctttcttgttatgggaactgatgatactctgaataagaagctctctagtctcgttgattggccaaactcggagaatttcagctggaactacgctattttctggcaacaaaccatgtctagatccggacaacaagtcttaggttggggagatgggtgttgtcgagagcctaatgaggaagaggaatcaaaagttgttaggtcttataattttaacaacatgggggcagaggaagagacatggcaagatatgaggaagagagtgttgcagaagcttcataggttgtttggtggatctgatgaagacaattatgctttgagcttagagaaagttactgctactgagattttcttcttagcttccatgtatttcttcttcaatcacggtgaaggcggtcctgggaggtgttattcttcagggaaacatgtgtggctctctgatgcagttaactctgagtctgactattgtttcaggtcttttatggcgaaatctgcgggaatcagaacgatcgttatggttcctactgatgctggtgttcttgagcttggttctgtttggtctttgcctgaaaacattggcttggttaagtctgttcaagctttgttcatgaggagagttacgcaaccagtaatggtgacttcaaacactaacatgactggagggattcacaagcttttcgggcaggatttgagtggagctcacgcgtatcctaagaagctcgaagtgagaagaaacttggatgagagattcactcctcaaagttgggaaggctataataacaataaaggtccaacatttggttacacacctcagagggatgatgtgaaagtgctagagaatgtgaatatggttgtagataataacaattacaagacgcagattgagtttgcgggatcatcagttgctgcttcttcgaatccatctacaaacactcagcaagaaaaatcagaatcttgtacagagaaaagaccagtgagcttgttagcaggagcaggaatagtttctgttgttgatgagaagagaccgagaaagagagggagaaagcctgcaaacggaagagaagagccattgaaccatgtggaagctgagaggcagagacgcgagaagcttaaccaaagattctacgctttacgatcagttgttccaaacatttctaaaatggacaaggcttctctacttggagacgcaatttcttacatcaaagagcttcaagagaaagtcaagataatggaagatgaaagagtaggaacagataagagcttatcagaatcaaacacaataacagtagaagaaagtccagaagttgacattcaagctatgaatgaagaggttgttgtaagagtaatctcgcctttggattcacatccagcttcaagaatcatacaagcaatgagaaactcaaatgttagtctaatggaggctaagttatcattagctgaagacacaatgtttcacacttttgtgataaagtctaacaacgggtcggatccattgacgaaagagaagcttatagcagcgttttaccccgagaccagctcgacgcaaccgccattgccttcttctagttcacaggtctctggtgatata

SEQ ID NO: 1754 - protein, 566 aa, Arabidopsis thaliana
  AT2G46510.1
MNMSDLGWDDEDKSVVSAVLGHLASDFLRANSNSNQNLFLVMGTDDTLNKKLSSLVDWPNSENFSWNYAIFWQQTMSRSGQQVLGWGDGCCREPNEEEESKVVRSYNFNNMGAEEETWQDMRKRVLQKLHRLFGGSDEDNYALSLEKVTATEIFFLASMYFFFNHGEGGPGRCYSSGKHVWLSDAVNSESDYCFRSFMAKSAGIRTIVMVPTDAGVLELGSVWSLPENIGLVKSVQALFMRRVTQPVMVTSNTNMTGGIHKLFGQDLSGAHAYPKKLEVRRNLDERFTPQSWEGYNNNKGPTFGYTPQRDDVKVLENVNMVVDNNNYKTQIEFAGSSVAASSNPSTNTQQEKSESCTEKRPVSLLAGAGIVSVVDEKRPRKRGRKPANGREEPLNHVEAERQRREKLNQRFYALRSVVPNISKMDKASLLGDAISYIKELQEKVKIMEDERVGTDKSLSESNTITVEESPEVDIQAMNEEVVVRVISPLDSHPASRIIQAMRNSNVSLMEAKLSLAEDTMFHTFVIKSNNGSDPLTKEKLIAAFYPETSSTQPPLPSSSSQVSGDI

SEQ ID NO: 1755 - DNA, 1770 bp, Arabidopsis thaliana
  AT1G01260.1
atgaatattggtcgcctagtgtggaacgaggacgataaagcgattgttgcgtcattactgggcaaacgagctctcgattacttgctttccaactctgtttccaatgctaatctcttgatgactctaggaagcgacgagaatctgcagaacaagctctcggatctcgtcgagagacccaacgcttctaatttctcttggaactacgccattttctggcagatttccaggtcaaaggccggagatttggttctctgttggggcgatggatattgcagagagcctaaagaaggagagaaatcagagatcgttaggattctaagtatgggaagagaagaagaaacgcatcagactatgagaaagagagtattgcaaaagcttcatgatttgtttggtggctcagaagaagagaactgtgctttaggactagatagagttactgacactgagatgtttcttctttcttctatgtatttctcattccctcgaggtgaaggtggtccaggcaagtgttttgcctctgctaaacctgtttggttatccgatgtcgtcaattcgggttctgattattgcgttagatcgtttcttgctaaatctgctggcattcagactgttgttttggttcctactgatcttggtgttgttgagttaggctcaacttcatgtttgcctgaaagtgaagactcaatcttgtctataagatcattgtttaccagtagtttgcctccggttagagctgttgctttacctgttactgtagctgaaaagattgatgataacagaacgaagatattcggcaaggatttgcacaattcagggtttcttcaacatcatcagcatcaccaacaacaacaacaacaaccaccgcaacagcaacagcatagacagtttagagagaaactcacggttagaaaaatggatgatagagctcccaagagattagatgcttatccgaataatgggaacaggtttatgttttcgaacccaggcaccaacaacaacactcttctgagtcctacttgggttcaacctgagaactacacgaggccaatcaacgtgaaggaagttccaagcacggatgagttcaagtttttacctttgcagcaatcatcgcagaggctgcttcctcctgctcaaatgcagatagatttctctgctgcgagttcaagggcttcagagaataattcagatggagaaggaggaggggaatgggcagatgcagtgggtgctgatgaatctggtaacaacagaccaagaaaacgcggaaggagacctgccaacggaagagcggaagctttgaaccatgtagaagcagagaggcagaggcgtgagaagcttaaccagaggttttacgctctgagatccgttgttcccaacatatccaagatggacaaagcgtccttgttgggagacgcggtttcttatataaacgagcttcacgcgaagctaaaggtcatggaagcagagagagagaggttagggtatagctcaaatccacctatcagcttggattcagatataaatgttcaaacctcaggtgaagatgtcacagtgaggataaactgtccgttggagtctcatccggcttccagaatcttccatgcgtttgaagagagtaaagtagaagtgataaactcgaacctggaagtttctcaggacacagtgttgcatacgtttgtagtcaaatctgaagaattaacgaaagagaagctgatatcggccttgtctagagagcaaacaaattcagttcagtcaagaacatcatcaggtaga

SEQ ID NO: 1756 - protein, 590 aa, Arabidopsis thaliana
  AT1G01260.1
MNIGRLVWNEDDKAIVASLLGKRALDYLLSNSVSNANLLMTLGSDENLQNKLSDLVERPNASNFSWNYAIFWQISRSKAGDLVLCWGDGYCREPKEGEKSEIVRILSMGREEETHQTMRKRVLQKLHDLFGGSEEENCALGLDRVTDTEMFLLSSMYFSFPRGEGGPGKCFASAKPVWLSDVVNSGSDYCVRSFLAKSAGIQTVVLVPTDLGVVELGSTSCLPESEDSILSIRSLFTSSLPPVRAVALPVTVAEKIDDNRTKIFGKDLHNSGFLQHHQHHQQQQQQPPQQQQHRQFREKLTVRKMDDRAPKRLDAYPNNGNRFMFSNPGTNNNTLLSPTWVQPENYTRPINVKEVPSTDEFKFLPLQQSSQRLLPPAQMQIDFSAASSRASENNSDGEGGGEWADAVGADESGNNRPRKRGRRPANGRAEALNHVEAERQRREKLNQRFYALRSVVPNISKMDKASLLGDAVSYINELHAKLKVMEAERERLGYSSNPPISLDSDINVQTSGEDVTVRINCPLESHPASRIFHAFEESKVEVINSNLEVSQDTVLHTFVVKSEELTKEKLISALSREQTNSVQSRTSSGR

SEQ ID NO: 1757 - DNA, 1410 bp, Brachypodium distachyon
  Bradi2g47730.1
atgtcgtggtctgacacggacgcggcgttgttcgccgccgtgctgggcaaggacgccgcgcaccacctggccaccacgccgccgcagctcgatgggccggcgtcggcttcagcgtcgtccgccgagctccaggcgcgcctgcaagacctcgtcgagctgggcggggcatggacgtacggcatctactggcaagagtcccacgacggagccggccgccccgtgctcggctggggcgacgggcactgccgcgagcatgacccggccgcgcccgaggacgaagaagccggcgccgcgaacacgagcctggcgcgcaagcgcgtgctgctgcggctgcacgcgctgcacggcggcggggaagaagacgaggagggcgccgactacgcgctccggctcgaccgcgtcaccggcgccgagatgtacttcctggcgtccatgtacttctccttccccgaggacgcaggcgggccgggccgcgcgcgggcctcgggccgccacgcgtgggtcgccgtggatgatccacgccggcccgggtggtgcgtccgcgcgtccctggcccagtccgcgggcctgcgcaccgtcgtcttcctcccgtgcaagggcggcgtgctcgagctcggctccgtcgcggccgtccgcgagaaccccgacgccctgcgcgctatccagtccgccttccgcgtcgatcctcccaccccaccgaacgattacatgaggatcttcgggaaggatctctcccgcggcgcgcaacaaacaggatgcgacgccacttgggcggcgccgctgcggctcggcgggcaagccatggccgcgacgcgcccggcgcccaagaaggaggttgtcaaagcgaaacctgcggagccgtctcctaaaagaagcataaatttcacccagcagccggacgcccagaagcaggcgggcggcggcggcgacgagcggaggccgcggaagcgggggcgcaagccggcgaacgggcgggaggagccgctgaaccacgtggaggcggagcggcagcggcgggagaagctgaaccagcgcttctacgcgctgcgcgcggtcgtgcccaagatctccaagatggacaaggcgtctctgctcagcgacgccatcgcctacatccaggagctggaggcgcgtctcaggacgccgacgtccccgtccgtggaggtgaaggcaatgcaggacgaggtggtgctgcgcgtgaccaccccgctagacgcgcaccccgtctccggggccttgagcgccatcagggactcgcacctcagcgtcgtggcgtcggacatggcgatggcgggcgacgccgtcacgcacacgctcgtggtgcggtcggccggaccggatcggctcacggccgagacggtgctcgccgccatgtctcgggggatgatgatgagcaacaccccctccccg

SEQ ID NO: 1758 - protein, 470 aa, Brachypodium distachyon
  Bradi2g47730.1
MSWSDTDAALFAAVLGKDAAHHLATTPPQLDGPASASASSAELQARLQDLVELGGAWTYGIYWQESHDGAGRPVLGWGDGHCREHDPAAPEDEEAGAANTSLARKRVLLRLHALHGGGEEDEEGADYALRLDRVTGAEMYFLASMYFSFPEDAGGPGRARASGRHAWVAVDDPRRPGWCVRASLAQSAGLRTVVFLPCKGGVLELGSVAAVRENPDALRAIQSAFRVDPPTPPNDYMRIFGKDLSRGAQQTGCDATWAAPLRLGGQAMAATRPAPKKEVVKAKPAEPSPKRSINFTQQPDAQKQAGGGGDERRPRKRGRKPANGREEPLNHVEAERQRREKLNQRFYALRAVVPKISKMDKASLLSDAIAYIQELEARLRTPTSPSVEVKAMQDEVVLRVTTPLDAHPVSGALSAIRDSHLSVVASDMAMAGDAVTHTLVVRSAGPDRLTAETVLAAMSRGMMMSNTPSP

SEQ ID NO: 1759 - DNA, 1419 bp, Oryza sativa
  LOC_Os01g50940.1
atgtcgtggtccgagacggacgccgcgctgttcgcggcggtgctggggcacgacgcggcgcatcacctggccaccacgccgccgcacctcgacgcgccggaggggtcgccgtcgtcggccgagctgcaggcgagcctgcacgacctcgtcgagcggcagggaggggcctggacgtacggcatcttctggcaggagtcccgcggcgccggtgccgccagcggccgcgctgcccgcgccgtgctcggctggggcgacggccactgccgcgacggtgccggacacggggaggtcggcgccgcggagaggagcgtggcgcggaagcgcgtgctgctgcggctgcacgcgctgtacggaggcggggatgaggatggcgccgactacgcgctccggctggaccgggtcaccggcgccgagatgtacttcctggcgtccatgtacttctccttcccggagggctcgggcggaccgggccgcgctctggcctccggccgccacgcctgggcggacgtagacccccacccttccggctccggtagcgcgccagggtggtacgttcgctcgtctctcgcccagtccgcggggttacgcaccgtcgtcttcctcccgtgcaagggcggcgttctcgagctcggttccgtcgtagccatccgcgagacccccgaggtcttgcgcgccatccaatctgccatgcgcgccgtgccagctccgccggaagatttcatgagaatcttcggcaaggatctctcacccggccgaccgtcccagcccatgggatgcgacgccccatggacgccgcggctcgttgtccaaaccacgccggtgcgcccagccaagaaggaggtggtcaaggcgaaaccagccgagccccccaagagcttggacttctccaaggcgaacgtgcaggaacaggccggcggccaggagcggcggccgcggaagcgtgggcgcaagccggcgaacgggcgggaggagccgctgaaccacgtggaggcggagcggcagcggcgggagaagctgaaccagaggttctacgcgctgcgcgcggtggtgcccaagatctccaagatggacaaggcgtccctgctcagcgacgccatcgcgtacatccaggagctggaggcccggctcaggggcgacgcgcccgtgcccgcgcgggcggatgggccggccgtggaggtgaaggcaatgcaggacgaggtggtgctgcgcgtgaccacgcccctggacgagcaccccatctccagggtgttccacgccatgagggaatcccagatcagcgtcgtggcgtcggacgtggcggtgtcggacgacgccgtcacgcacacgctcatggtgcggtcggccgggccggagcggctcacggcggagacggtgctcgcggcgatgtcgcggggggtgagcgtcaccactccctccccg

SEQ ID NO: 1760 - protein, 473 aa, Oryza sativa
  LOC_Os01g50940.1
MSWSETDAALFAAVLGHDAAHHLATTPPHLDAPEGSPSSAELQASLHDLVERQGGAWTYGIFWQESRGAGAASGRAARAVLGWGDGHCRDGAGHGEVGAAERSVARKRVLLRLHALYGGGDEDGADYALRLDRVTGAEMYFLASMYFSFPEGSGGPGRALASGRHAWADVDPHPSGSGSAPGWYVRSSLAQSAGLRTVVFLPCKGGVLELGSVVAIRETPEVLRAIQSAMRAVPAPPEDFMRIFGKDLSPGRPSQPMGCDAPWTPRLVVQTTPVRPAKKEVVKAKPAEPPKSLDFSKANVQEQAGGQERRPRKRGRKPANGREEPLNHVEAERQRREKLNQRFYALRAVVPKISKMDKASLLSDAIAYIQELEARLRGDAPVPARADGPAVEVKAMQDEVVLRVTTPLDEHPISRVFHAMRESQISVVASDVAVSDDAVTHTLMVRSAGPERLTAETVLAAMSRGVSVTTPSP

SEQ ID NO: 1761 - DNA, 1401 bp, Zea mays
  GRMZM2G159937_T01
atggcgtggtcggagacggacgccgcgctgttcgcggcggtgctggggcgggacgcggcgcaccacctgagcaccacgccgccgcaccaggacgcgcccgcggcgtcggcccccgagctccaggcgcgcctgcaggacctcgtggagcggggcggggcgtggacgtacggcatcttctggcaggagtcctgcgccggcggccgcgccgtgctcggctggggcgacggccactgccgcgacggcggcgccccgcaccacgacgacgcggaccggagcgtggcgcggaagcgcgcgctgctgcggctgcacgcgctctacggcggcggggacgacgagggggccgactacgcgctccgcctcgaccgggtcaccgccgccgagatgtactttctggcgtccatgtacttctccttcccggagggcgcgggcgggccgggccacgcgctcgccacggcccgccacgcctgggccaccgtcgaccccgcgcccgggtggtacgtccgggcgtccctcgcccagtccgcggggctccgcaccgtcgtcttcctcccgtgcaagggcggcgtcctcgagctcggctccgccgtgcccgtccgcgagactcccgagaccctgcgcgcgctccagaccgcgctcgctgtcgcgcggcccccggcacgcgaggaatgcatgaggatcttcggccaggacctctcccccggcgggagcgcccgagccccgcgcagcgtcgacaattgggctccacatccacacctcgccgcccaagccaccgccgcgtccgcactagccagcaaggaagccgccgcgggacacaaggctccggagccgcccaggagcatagacttcagcaagccagggaagcctgggcacgggcaggccggcggcgaggagcggaggccgcggaagcgcgggcggaagccggcgaacgggcgggaggagccactgaaccacgtggaggcggagcggcagcggcgggagaagctgaaccagcggttctacgccctgcgcgccgtcgtccccaagatttccaagatggacaaggcgtcgttgctcagcgacgccatcgcgtacatccaggagctggaggaccggctccgcggcggcggcggcggcggcggcggctgctcggcggcgcgcccggacagcccggacgtggaggtgaaggcaatgcaggacgaggtggtgctgcgcgtgaccacgcccctgtacgcgcaccccgtctccagggtgttccacgccatcagggacgccgagctgatcgtggcggcgtcggacgtggcggtggcggacgaagccgtcacgcacacgctcgtgctgcggtcgcccggccccgagcagctcaccgcggagacggtactcgccgccatgtcacgggggatgaccagcgccaccccctccccg

SEQ ID NO: 1762 - protein, 467 aa, Zea mays
  GRMZM2G159937_T01
MAWSETDAALFAAVLGRDAAHHLSTTPPHQDAPAASAPELQARLQDLVERGGAWTYGIFWQESCAGGRAVLGWGDGHCRDGGAPHHDDADRSVARKRALLRLHALYGGGDDEGADYALRLDRVTAAEMYFLASMYFSFPEGAGGPGHALATARHAWATVDPAPGWYVRASLAQSAGLRTVVFLPCKGGVLELGSAVPVRETPETLRALQTALAVARPPAREECMRIFGQDLSPGGSARAPRSVDNWAPHPHLAAQATAASALASKEAAAGHKAPEPPRSIDFSKPGKPGHGQAGGEERRPRKRGRKPANGREEPLNHVEAERQRREKLNQRFYALRAVVPKISKMDKASLLSDAIAYIQELEDRLRGGGGGGGGCSAARPDSPDVEVKAMQDEVVLRVTTPLYAHPVSRVFHAIRDAELIVAASDVAVADEAVTHTLVLRSPGPEQLTAETVLAAMSRGMTSATPSP

SEQ ID NO: 1763 - DNA, 1278 bp, Setaria italica
  Si004795m
atggcgtggtcggagacggacgccgcgctgttcgcggcggtgctggggcgggacgcggcgcaccacctggccaccacgccaccgcacctggacggacccccggcgtcggcggcgcccgagctccaggcgcgcctgcaggacctcgtcgagaggggcggcggcgtgtggacgtacggcatcttctggcaggagtcccgcggcgcccgcggccgcgtcgtgctcggctggggcgacggccactgccgcgacggcggcgccccgcacgacgccgccgccggcgccgactacgcgctccgcctcgaccgggtcaccggcgccgagatgtacttcctggcgtccatgtacttctccttcccggagggcgcgggagggccgggtcacgcgctggcctccggccgccacgcctgggccgccgtcgacccccacccgcgcggagccggcgccgcgcccgggtggtacgtccgcgcgtccctcgcccagaccgcggggctccgcaccgtcgtcttcctcccgtgcaagggcggcgtcctcgagctcggctccgacgtggccgtccgcgagacccccgaggccctgcgcgccatccagtccgccctcgccgttgcgcccgcaccaccgtcaccggcgacaaattgggctccacagcccggcggccacgccacggcgtccacacccccagacaagacggaagccgcgaagcccaaacctccggagccacccaagagcatagacttcagcaaggcgggaaagccggggcaggccggtggcgaggagcgtaggccgcggaagcgcgggcggaagccggcgaacgggcgggaggagccgctgaaccacgtggaggcggagcggcagcggcgcgagaagctgaaccagcggttctacgccctgcgcgcggtggtccccaagatctccaagatggacaaggcgtccctgctcagcgacgccatcgcctacatccaggagctggaggaccggctccgcggcggcggcggcggcgtcgctccggcggcgcgcgcggagagcccggccgtggaggtgaaggcaatgcaggacgaggtggtgctgcgcgtgacgacgcccctgtacgcgcaccccgtctcccgggtgttccacgctatcagggacgcccagctgagcgtggcggcgtcggacgtggcggtggcggacgacgccgtgacgcacacgctggtgctgcggtcggccgggccagagcagctgaccgcggagacggtgctcgccgccatgtcacgggggatgaccagcgccaccccgtccccg

SEQ ID NO: 1764 - protein, 426 aa, Setaria italica
  Si004795m
MAWSETDAALFAAVLGRDAAHHLATTPPHLDGPPASAAPELQARLQDLVERGGGVWTYGIFWQESRGARGRVVLGWGDGHCRDGGAPHDAAAGADYALRLDRVTGAEMYFLASMYFSFPEGAGGPGHALASGRHAWAAVDPHPRGAGAAPGWYVRASLAQTAGLRTVVFLPCKGGVLELGSDVAVRETPEALRAIQSALAVAPAPPSPATNWAPQPGGHATASTPPDKTEAAKPKPPEPPKSIDFSKAGKPGQAGGEERRPRKRGRKPANGREEPLNHVEAERQRREKLNQRFYALRAVVPKISKMDKASLLSDAIAYIQELEDRLRGGGGGVAPAARAESPAVEVKAMQDEVVLRVTTPLYAHPVSRVFHAIRDAQLSVAASDVAVADDAVTHTLVLRSAGPEQLTAETVLAAMSRGMTSATPSP

SEQ ID NO: 1765 - DNA, 1146 bp, Glycine max
  Glyma03g41900.1
atgtattttatttctgttgaggagatgaaggttgacgcggggttagggcgcgtggtgtgggacgatgaggacaaggccatgcttggggctgttctgggtggtcgagctttggagttcctaatgacgaactccgtgccgaatgagagtgttttaatggcggttgggagcgacgagggacttcagaagaagctgtcggatctggtggagcgtccccacgtgtccaatttcagttggaactacgccattttctggcagctctcgcagtccaaatccggtgactgggttctgggttggggagacgggtgctgcagggaacccaacgaggaagaagaagagggtgctgtgactgtgagaagacgaacactgcgcgtggacgaggaggagatgcagcagaggatgcggaagctggtgctgcagaagctgcacaccacgttcgggggcgaggatgatgacaattacgcttttggcctcgaccacgtcaccgacaccgagatgttctttctggcttccatgtacttctcattccctcgcggccatggtgccccaggtaagtgcttcgcctccgggaaccatttctggctcaaatctgtctctgtgtctgatcactgcgtgcgttcttccttggctaactctgcgggaattcagactattgttttggtacctactgatttgggagtcgtggagttgggttctgtcagaatgttacccgagagttttgaactcttgcaggctgttaaatctgtgttctccacgccgattcccaaggttttggtgaacacaattcgcaatcagacacattttagagagaaacttgctgttagaaaaatggaggataataggccttggaacaacaacaacgttagttttccgaatgtgcggagcaatggccttcatgtttcaagttgttggccagtgaattcggctatgaacctcaaagacaggtgcaaatgcaaattgactttagcggaggcactagcaggccttctgatgtggaggcctcttgcaaggaggagcaaccaagtgttgccgatgaaaggaagcccaggaagcggggaaggaagcccgccaatggaagggaagagcccctcaatcatgtggaggccgagaggcaaaggcgcgagaagctcaaccagcgcttctatgcgt

SEQ ID NO: 1766 - protein, 382 aa, Glycine max
  Glyma03g41900.1
MYFISVEEMKVDAGLGRVVWDDEDKAMLGAVLGGRALEFLMTNSVPNESVLMAVGSDEGLQKKLSDLVERPHVSNFSWNYAIFWQLSQSKSGDWVLGWGDGCCREPNEEEEEGAVTVRRRTLRVDEEEMQQRMRKLVLQKLHTTFGGEDDDNYAFGLDHVTDTEMFFLASMYFSFPRGHGAPGKCFASGNHFWLKSVSVSDHCVRSSLANSAGIQTIVLVPTDLGVVELGSVRMLPESFELLQAVKSVFSTPIPKVLVNTIRNQTHFREKLAVRKMEDNRPWNNNNVSFPNVRSNGLHVSSCWPVNSAMNLKDRCKCKLTLAEALAGLLMWRPLARRSNQVLPMKGSPGSGEGSPPMEGKSPSIMWRPRGKGARSSTSASMR

SEQ ID NO: 1767 - DNA, 1740 bp, Glycine max
  Glyma19g44570.1
atgaagcttgacgcgggcgtggtgtgggacgatgaggacaaggccatgcttggggctgttctgggtggtcgagctttggagtttctaatggcaaactggttgtcgaatgagagtgttttaatggcggttgggagtgaggaggggctgcagaacaagctctcggatctggtggagcgtcccaatgtctccaatttcagttggaactactccattttctggcagctctcgcattccaaatccggtgactgggttctgggttggggagacgggtgctgcagggaacccagcgaggaagaagagggttctttgggaagaggaacactgaggcttcttcgcgtggacgaggagatgcagcagaggatgcggaagagggtgctgcagaagctgcacaccacgttcgggggcgaggatgaggacaattacgcttttggcctcgaccacgtcaccgacaccgagatgttctttcttgcttccatgtacttttctttccctcgcggccatggtggcccaggtaagtgcttcgcgtccgggaagcatttgtggctcaaatctgtgtctgattactgcgtgcgttcttccttggctagctctgcgggaattcagactattgttttggtccctactgatatgggagtggtggagttgggttctgtcagaatgttacccgagagttttgaactcttgcaggctgttaaatctgtgttctccacgcagtctccttcataccaaggggtgagtgtgagcaccggtgggaatgctgttttccctggtttggcaattggggatgctaataaggtagatggaggagtttcgattcccaaggtttttgtcaacacaattggaaatcggacgcatttcagagagaaacttgcagccatggccaccccgaccccaatgggaacaatctccacaacaacgttagttttccgaatgtgcggggtaatagtcttcatgtttcgagttgggcaggcccccacgagtagtgtcctcgcagagctggctaatgtgcaaatgcaaattgactttaccggagccacttccaggccttcttcagcgagaccggtcgtcggtgaattggagctttctgatgttgaggcctcttgcagggaggagcaacaacccagttttgccgatgaaaggaagcccaggaagcggggaaggaagcctgccaatggaagggaagcgcccctcaatcatgtggaggcggagaggcaaagacgcgagaagctcaaccaacgcttctatgcgttgagatctgtggtgcctaacatctccaagatggataaggcttcattgctgggagatgccattgcttatatcaacgagcttcaggctaaagtcaggatcatggaagctgaaaaagagagatttggaagcacttcaaatgatggatcagtcttggaagctaagttgagattggaaaatcaggagaaaaaagctcctgatgtggatattcaagcttttcaagatgaggtcattgtaaaggtgagctgccctcttgacagtcaccctgtttcaaaagtaatccaaacatttaacgaagcacagatcagtgttgtagagtctaaacttgctgctgcaaatgataccatttttcacacatttgtaattaagtcccaaggacctgaacagctcacaaaggacaagttgattgctgttttttctccaacagaatccaactcattgcagccattgtcacagttggatagcaagggaattgcagtcagcatagtccatacg

SEQ ID NO: 1768 - protein, 580 aa, Glycine max
  Glyma19g44570.1
MKLDAGVVWDDEDKAMLGAVLGGRALEFLMANWLSNESVLMAVGSEEGLQNKLSDLVERPNVSNFSWNYSIFWQLSHSKSGDWVLGWGDGCCREPSEEEEGSLGRGTLRLLRVDEEMQQRMRKRVLQKLHTTFGGEDEDNYAFGLDHVTDTEMFFLASMYFSFPRGHGGPGKCFASGKHLWLKSVSDYCVRSSLASSAGIQTIVLVPTDMGVVELGSVRMLPESFELLQAVKSVFSTQSPSYQGVSVSTGGNAVFPGLAIGDANKVDGGVSIPKVFVNTIGNRTHFREKLAAMATPTPMGTISTTTLVFRMCGVIVFMFRVGQAPTSSVLAELANVQMQIDFTGATSRPSSARPVVGELELSDVEASCREEQQPSFADERKPRKRGRKPANGREAPLNHVEAERQRREKLNQRFYALRSVVPNISKMDKASLLGDAIAYINELQAKVRIMEAEKERFGSTSNDGSVLEAKLRLENQEKKAPDVDIQAFQDEVIVKVSCPLDSHPVSKVIQTFNEAQISVVESKLAAANDTIFHTFVIKSQGPEQLTKDKLIAVFSPTESNSLQPLSQLDSKGIAVSIVHT

SEQ ID NO: 1769 - DNA, 1878 bp, Glycine max
  Glyma07g06090.1
atgaagattgaggtggggttgggaggggtgtgggatgaggaagagaaagcgacggtgatggaggttctgggacgtggagcgttcgattacttggtggcgaattcggtttcgaacgagaatctgttaatggcgttcgggtgtggcgagaatatgcagaacaagctctcggatctcgtggagcgacccaactcgtcgaacttcagttggaactacgcgatcttctggcaaatttcgcagtccaagtatggggattgggttttggggtggggagatgggtgttgtagggagccaagagagggagaagagggtggtggagaagtgagaagggttagggttgtttttgatgatgatgatgagaaggtgcagaggatgaggaagggggtgttgcagaagctgcacatgacttttgggggttctgatgaggacaattatgcttttgggttggaccgcgtgaccgacacagagatgttctttcttgcttccatgtacttctcttttccccgggggcttgggggtccaggtaagtgttttgcttctgggaagcatttgtgggtttcggatgtgttgaaatctagttttgattactgtgtgaggtctttcttggccaaatctgctgggattcagactgttgttttagtgcctactgattttggggtggtggagatggggtctgtgaggatggttggtgagagttttgagttgttgcaggctgtgaaatctgtgttttctgcacaggcatcatcattattagtcccccacatggttaagccaattgcaccgttggatttggtgagggaaaagagagatgggagtgagagtgcaaatgctcttttatctggtttggcaattggggataagaataagaatattaataacaatagtagagtagagggaattggagttccgaagatttttgggcaggatttgaattgtgtgactcaatttagggagaaacttgctgtgaggaaaatggaggagaggccgaggccatggggaggccatccccccaatgtgaatagtattggctttccgaacggtgttcagggttctagttggggggctggtcaagttgtgaggcatcttggtcctcctgaaatgcttgctcctaggttggccagctccggcacattgccaaagctggccaatggtgcgaggcatgactttgtgcataacaactttgagcagcaacggccggtacagatgcaaattgatttctcaggagccacttcgagggcagcttctgggagatcaataattgccgagtctgagatttctgatgttgaggcgacgtgcaaggaggagagagttagtgttgccgatgacaggaggccgaggaagcgggggaggaagccggctaatggaagggaggaacccctcaatcatgtggaggcagagaggcaaaggcgggagaagctgaaccagcggttctatgcattgcgagctgttgttccaaatatctctaagatggacaaggcatcactgttgggagatgctattgcttacatcaatgaacttcaagcaaaactcaagaccatagaatctgagagagagaggtttggaagcacctctatggatggaccagaattggaggccaatgcaagagtagaaaatcatcataatggaactcctgatgtggatgttcaagttgcacaagatggggtcattgtaaaggtgagctgtcctattgatgttcacccagtttcaaaagtcattcaaacctttaaagatgcagaaattggtgttgttgaatcaaaagttactgctacaaatgtttctgttttccatacatttgtagttaaatcccaaggacctgatcagctgacaaaggataagttgattgcgttgttttccaaagaatccagcaccataaagacatta

SEQ ID NO: 1770 - protein, 626 aa, Glycine max
  Glyma07g06090.1
MKIEVGLGGVWDEEEKATVMEVLGRGAFDYLVANSVSNENLLMAFGCGENMQNKLSDLVERPNSSNFSWNYAIFWQISQSKYGDWVLGWGDGCCREPREGEEGGGEVRRVRVVFDDDDEKVQRMRKGVLQKLHMTFGGSDEDNYAFGLDRVTDTEMFFLASMYFSFPRGLGGPGKCFASGKHLWVSDVLKSSFDYCVRSFLAKSAGIQTVVLVPTDFGVVEMGSVRMVGESFELLQAVKSVFSAQASSLLVPHMVKPIAPLDLVREKRDGSESANALLSGLAIGDKNKNINNNSRVEGIGVPKIFGQDLNCVTQFREKLAVRKMEERPRPWGGHPPNVNSIGFPNGVQGSSWGAGQVVRHLGPPEMLAPRLASSGTLPKLANGARHDFVHNNFEQQRPVQMQIDFSGATSRAASGRSIIAESEISDVEATCKEERVSVADDRRPRKRGRKPANGREEPLNHVEAERQRREKLNQRFYALRAVVPNISKMDKASLLGDAIAYINELQAKLKTIESERERFGSTSMDGPELEANARVENHHNGTPDVDVQVAQDGVIVKVSCPIDVHPVSKVIQTFKDAEIGVVESKVTATNVSVFHTFVVKSQGPDQLTKDKLIALFSKESSTIKTL

SEQ ID NO: 1771 - DNA, 1854 bp, Glycine max
  Glyma16g02690.1
atgaagattgaggtggggttgggaggggtgtggaatgaggatgagaaagcgacagtggtggaggttctgggtcgagaggcgttcgattacttggtggcgaattcggtttcgaacgagaatctgttaatggcgtttgggagcggggagaatctgcagaacaagctgtcgggtctcgttgagcgcccgaacgcgtcgaacttcagttggaactacgccatctactggcaaatttcgcagtcaaagtatggcgattggattttggggtggggagatgggtgttgtagggagccaagggatggagaagagggtggagaagtgagaattgttgatgatgaaaaggtgcagaggatgaggaagagggtgttgcagaagctgcacatgacttttgggggttctgatgaggatatttatgcttttgggttggaccgtgttaccgacacggaaatgttctttcttgtttccatgtatttctcttttccccgggggcttgggggtccaggtaagtgttttgcttctgggaaacatttgtggatttcggatatgttcaaatctggttttgattactgtgtgaggtctttcttggccaaatctgctgggattcagactgttgttttggtgcctactgatttgggggtggtggagatggggtctgtgaggacggtagatgagagctttgagttgttgcaggctgtcaaatctgtgttttctgcacctttggtcctccccaaggttaagccaactgcaccattggatttggtgagtgaaaagagagatgggaatgagagtgcaaatgctcttttttgtggtttggcaattgtggataagaataagaataacaacagccacagtaataacagggtagagggagttggtgttccaaagatttttgggcaggatttgaattgttccactcaatttagagaaaaactggctgtgaggaaaatggaggagaggccatggccgtggggaggtcatccccccaacggaaatagtattggctttcctaatggtgttcatggttctagttggggggctggtgaagttgtgaggcagcttggtcatcctgaaattcttgctcctaggttggccagctctggagctttgccggatgttgccaatagtgcgaagaatgattttgtgcataacaactttcagcagcaacagctgcctgtacagatgcaatttgatttctcaagagccacttcaagggcttctgagagatcaatcattgcggagtctgagatttctgatattaaggcgtcgtgcaaggaggagagaatgagtattgccgatgacaggaggccgaggaagcgggggaggaagccggctaatggaagggaggaacccctcaatcatgtggaggctgagaggcaaaggcgggagaagctgaaccagcgattctatgcactgcgagccgttgttccaaacatctctaagatggataaggcatcgctgttgggagatgctattgcttacatcaaccagcttcaagcaaaactcaagaccatggagtttgagagagagaggtttggaagcacttgtgtggatggaccagtattggatgtcaatgcagaagtagaaaaaaatcatcacaacggagctcctgatatggacgtgcaagctgcacaggatggggtcattgtaaaggtgagctgtcctatcgatgttcatcctgtttcaaaagtcattcaaaccttcaaagaggcagaaattggtgttgttgaatcaagacttactgttgcaaacgatactgttttccatacatttgtagttaaatccgaaggacctgatcaagtaacaaaggataagttgattgcattgttttccaaagaatccaacttcatacaaacacta

SEQ ID NO: 1772 - protein, 618 aa, Glycine max
  Glyma16g02690.1
MKIEVGLGGVWNEDEKATVVEVLGREAFDYLVANSVSNENLLMAFGSGENLQNKLSGLVERPNASNFSWNYAIYWQISQSKYGDWILGWGDGCCREPRDGEEGGEVRIVDDEKVQRMRKRVLQKLHMTFGGSDEDIYAFGLDRVTDTEMFFLVSMYFSFPRGLGGPGKCFASGKHLWISDMFKSGFDYCVRSFLAKSAGIQTVVLVPTDLGVVEMGSVRTVDESFELLQAVKSVFSAPLVLPKVKPTAPLDLVSEKRDGNESANALFCGLAIVDKNKNNNSHSNNRVEGVGVPKIFGQDLNCSTQFREKLAVRKMEERPWPWGGHPPNGNSIGFPNGVHGSSWGAGEVVRQLGHPEILAPRLASSGALPDVANSAKNDFVHNNFQQQQLPVQMQFDFSRATSRASERSIIAESEISDIKASCKEERMSIADDRRPRKRGRKPANGREEPLNHVEAERQRREKLNQRFYALRAVVPNISKMDKASLLGDAIAYINQLQAKLKTMEFERERFGSTCVDGPVLDVNAEVEKNHHNGAPDMDVQAAQDGVIVKVSCPIDVHPVSKVIQTFKEAEIGVVESRLTVANDTVFHTFVVKSEGPDQVTKDKLIALFSKESNFIQTL

SEQ ID NO: 1773 - DNA, 1839 bp, Citrus clementina
  clementine0.9_005258m
atgaaaatagagtttaatatgggaggtaatttgtggaatgatgaggataaggctatgggagcagctgttttgggaacaagagcttttgattacttactgacgagctcaatttcgaatgagaaccttttaatggctgttggcagtgatgaagatttacaaaataagctttctgatctcgtggacaggcctaacgcgtcaaattttagctggaattatgctatcttttggcaaatttcgcggtctaagtcaggtgattgggttttaggatggggagatgggtcttgtagagagcctaaagaaggtgaagaatcagaagctacgagaattcctaatatcaggcttgaagatgaaactcaacagaggatgagaaaaagggttttgcagaaactgcatactttatttggtggatcagatgaggataattatgctttgggattggatagggttactgatactgagatgttctttttggcatctatgtatttctcctttcctcgtggagaaggtggcccaggcaagtgttttgcctctgggaagcatgtgtggttattggatgccttgaagttgagttctgattactgcgtgaggtcttttcttgcaaagtctgccagaattcagaccatcgttttgatctcgactgatgctggggttgttgaattgggctctgtcagatcagtaccagaaagcttggaattggtgcactcaattagggctaccttttcttcaaactcttctttagccagggttaagccaatggctgttgcattaccagttacaagtgagaagaaagatgagaatggtctgtttcctaatttgggcattttggacagagttgaaggagttccaaagatttttggtcaggaattgaacaactcgggccatgttcatacccattttagtagggagaaacttgctgttagaaagatggaagaaaggccttcatgggaagcttacacaaatggaaataggactgcatttccgggtattcgaaatggtgttcatggttttagttggggaaatgttcaaggagtgaaacaagggatcgcaactgaaatctttggttcgcaaactaacaatttgcaagagctggttaatggggttagggaagattttcggattaaccactatcagtcacaaaagccaatgcaaatgcagattgatttctctggggctacttcgaggcctaatgtgatcgccagaccactgaatgctgattctgagcattctgacgtggaagcttcttgcagggatgagcgtacaggcacagttgaggagagaaggcctcggaaaagaggtagaaagcccgcaaatggaagagaagagcctctcaaccacgtggaggcggagaggcaacggcgtgagaagctaaaccaacggttctatgcattacgagctgtggtacctaacatatccaagatggataaagcatcgttgctgggagatgccattgcttacatcaatgagcttcaagcaaagctaaaggtcatggaagcagagagggagaacctaagtggcaactccagagacttgtctgcctttgagtcgaatcctaatgtggaaagtcagaaccgagcccctgatgttgatattcaagctgcccatgatgaggtggttgtaagagtgagctgtcctcttgattcacatcctgcatcaagagtcatccaagcttttaaagacgcacaaatcacagttgtggagtcaaaactttctactggaaatgatatggtatttcacacatttgtaatcaaatctcagggatcggagcagttgacaaaagagaagttgattgcagcattttcctgcgaatcaagctcaatacagccattatcatcagttggg

SEQ ID NO: 1774 - protein, 613 aa, Citrus clementina
  clementine0.9_005258m
MKIEFNMGGNLWNDEDKAMGAAVLGTRAFDYLLTSSISNENLLMAVGSDEDLQNKLSDLVDRPNASNFSWNYAIFWQISRSKSGDWVLGWGDGSCREPKEGEESEATRIPNIRLEDETQQRMRKRVLQKLHTLFGGSDEDNYALGLDRVTDTEMFFLASMYFSFPRGEGGPGKCFASGKHVWLLDALKLSSDYCVRSFLAKSARIQTIVLISTDAGVVELGSVRSVPESLELVHSIRATFSSNSSLARVKPMAVALPVTSEKKDENGLFPNLGILDRVEGVPKIFGQELNNSGHVHTHFSREKLAVRKMEERPSWEAYTNGNRTAFPGIRNGVHGFSWGNVQGVKQGIATEIFGSQTNNLQELVNGVREDFRINHYQSQKPMQMQIDFSGATSRPNVIARPLNADSEHSDVEASCRDERTGTVEERRPRKRGRKPANGREEPLNHVEAERQRREKLNQRFYALRAVVPNISKMDKASLLGDAIAYINELQAKLKVMEAERENLSGNSRDLSAFESNPNVESQNRAPDVDIQAAHDEVVVRVSCPLDSHPASRVIQAFKDAQITVVESKLSTGNDMVFHTFVIKSQGSEQLTKEKLIAAFSCESSSIQPLSSVG

SEQ ID NO: 1775 - DNA, 1860 bp, Eucalyptus grandis
  Eucgr.E00047.1
atggttgggggtgggatagagatgaagatagagctaggtgctgggtatggcccgtggaatgatgaagagaaagccatggtggctgctgtcttgggaacccgggcattcgattatttagtgtcgagatcagtttccaatgaaaatctcttgatgtccattgggagcgacgagaatatgcaggacaagctctcgaatctcgtggaccaccccaactcttccaacttcagctggaactatgccatcttctggcagatttccaggtccaagtcgggggattggctattgggttggggggatgggtcctgtagggagccgaaagatggagaagaatccgaagcgactcgaatccttaatttgagactcgaggacgagggccagcagaggatgaggaaacgggtgctggacaagttgcacaccgtctttggtgggtcggatgaggacaattatgctctcggcttggaccgggtgacggacatggagatgttctttctggcgtccatgtacttcttgtttccctcgggagaagggggtccaggcaaatgttttgcctcggagaagcatgtatggctgacagatgcactcaagtcgtcttctgattattgcgttcggtcatttcttgcaaagtctgcagggattcggacaatagttttggttccgactgacgttggggttgtagagttgggttcggttagatctgtcccggaaagctcggagctggtgcagaccataagattgtctttctcgacgaattcatttatgtcggttaagccaatagctgccttacccatgacgaatgaaaagaaggacgaaaacgcacccttctctaatttggcgttggcaggtaagggtgaggcaatctccaagatatttggtaaggagttaaccgcagttaacagtcctggccattatagggagaaacttgccgttagaaagatggactccaggcaatcgtgggaacctcaccataacggaagtaaactcccattttcaactcctagaaatggcacccaagacacgagttgggctcatcatgctcatggcgtaaagcagttgagtcctgtggaattttatggctctcaaacctcagccagtaaattagaggagcggatgaacagcggtaggaatgattttggattgaaccgctacccaacaccaaagcaggtgcaaatgcaaatcgactttacaggtgccacttcaaggccttctgtgataacccgaccattcactgccgactctgagcattctgatgttgaagcttcatgcaaggaagagcagggtggtgcagcaaacgagaagagaccaagaaaaagaggcaggaagcctgcgaatggaagagaagaacctctcaatcatgtggaggcagaacggcagcgacgtgagaagctgaaccagaggttctatgcccttcgtgcagtggtgcctaatatatccaagatggataaagcttcattattaggagatgccattgcttatataaatgagcttcaagcgaagctcaaaatcatggaagcagatcgggagaggtttggaagcacttcaagagatgcatcagacgtcgaggttaatgccaccgcagagcaatcaaaccaatctccagatgttgatatccaagctactgctgctgatgaggtcgtcgtgagggtcagctgtcctttgaattctcaccctgcatcaagagttatccaggctttccaagaggcgcaggtcaccgttcttgactcgaagctttcgacagccaatgatactgtgttccatacattcctgataaagtcgcaagggtctgaacagatgacaaaggagaagttaactgcagcattttcccgtgaatccaactccttagagccattgtcgtctgttggc

SEQ ID NO: 1776 - protein, 620 aa, Eucalyptus grandis
  Eucgr.E00047.1
MVGGGIEMKIELGAGYGPWNDEEKAMVAAVLGTRAFDYLVSRSVSNENLLMSIGSDENMQDKLSNLVDHPNSSNFSWNYAIFWQISRSKSGDWLLGWGDGSCREPKDGEESEATRILNLRLEDEGQQRMRKRVLDKLHTVFGGSDEDNYALGLDRVTDMEMFFLASMYFLFPSGEGGPGKCFASEKHVWLTDALKSSSDYCVRSFLAKSAGIRTIVLVPTDVGVVELGSVRSVPESSELVQTIRLSFSTNSFMSVKPIAALPMTNEKKDENAPFSNLALAGKGEAISKIFGKELTAVNSPGHYREKLAVRKMDSRQSWEPHHNGSKLPFSTPRNGTQDTSWAHHAHGVKQLSPVEFYGSQTSASKLEERMNSGRNDFGLNRYPTPKQVQMQIDFTGATSRPSVITRPFTADSEHSDVEASCKEEQGGAANEKRPRKRGRKPANGREEPLNHVEAERQRREKLNQRFYALRAVVPNISKMDKASLLGDAIAYINELQAKLKIMEADRERFGSTSRDASDVEVNATAEQSNQSPDVDIQATAADEVVVRVSCPLNSHPASRVIQAFQEAQVTVLDSKLSTANDTVFHTFLIKSQGSEQMTKEKLTAAFSRESNSLEPLSSVG

SEQ ID NO: 1777 - DNA, 1665 bp, Populus trichocarpa
  POPTR_0002s17310.1
atgaagattgaggtgggtatgggaggtggggcatggaatgatgaagataagactatggttgctgctgttttaggctcaaaagcttttaattacttgctatcaaattcagtagctaatcaaaatttattaatggttatgtgtggcgatgagaatttgcaaaataagctctctgatcttgtggactgccccaactcctcgaattttagctggaactatgccatattttggcagatttcatgttctaagtctggtgattgggttcttggttggggagatgggtcttgtagggagcctaaagaaggtgaagaatctgaattcactagaattcttaatatacgccttgaggatgagactcaacagaggatgagaaagagagttattcagaagctgcagactttgtttggcgaatcagatgaggataattatgccttgggattggaccgggtcactgatactgagatgttctttttggcatctatgtatttctcctttcctcggggagaaggtggtccgggaaattgttatgcctccgggaagcatgtctggatctctgatgcattgaaatcagggcctgattattgtgtgagatcatttcttgcaaggtctgcaggatttcagacaattgtgttggtggctactgatgttggtgttgttgaattaggttctgtgagatctgttcctgaaagtatcgagatggttcaatcaataaggtcatggttttccactcggagttcaaagttgaaggagctccgaagatttttgaatggtagtaggcttgcatttcctggtactcgaaatcgcctgcatggttctagctgggcacaaagttttggtttgaaacaagggacaccaggtgaggtttatggctcacaagccacagcaaataatctaaaagagctggttaatggggttagggaggagtttaggcataatcactaccaaggtcaaaagcaggtgcaagtgcaaattgatttttcaggagccacttcagggccttctgggattggcagaccacttggtgcagaatctgagcattcagatgttgaagcttcgtgcaaggaagaaaggccaggtgcagcagatgacagaaggcctcgcaaacggggcaggaagccagcgaatggaagagaagaaccccttaatcatgttgaggcagagaggcagcggcgagagaagctcaaccagcgattctatgcactacgagctgttgtgcccaatatttccaagatggacaaggcttcattgttaggagatgctatttcttacatcaatgagcttcaagcgaagctcaagaaaatggaagctgaaaggggaaaattggagggcgtcgtgagagattcatcgacattggatgttaacacaaatggagaaagtcataatcaagctcgagacgttgatatccaagcttcccatgatgaggtgatggtaagagtgagttgtccgatggattcgcatcctgcatcaagagtgattcaagcattgaaagaagcacaggtcactgtcattgagtcgaaactttccgctgcaaatgacactgtgttccatacatttgtgatcaagtctgaaggatccgagcagctaacaaaggaaaagctgatggcggcaatttcgtttgtgtggtcgtgtcgtggaaaggtccgctggttgtcatcaacaattcccgac

SEQ ID NO: 1778 - protein, 555 aa, Populus trichocarpa
  POPTR_0002s17310.1
MKIEVGMGGGAWNDEDKTMVAAVLGSKAFNYLLSNSVANQNLLMVMCGDENLQNKLSDLVDCPNSSNFSWNYAIFWQISCSKSGDWVLGWGDGSCREPKEGEESEFTRILNIRLEDETQQRMRKRVIQKLQTLFGESDEDNYALGLDRVTDTEMFFLASMYFSFPRGEGGPGNCYASGKHVWISDALKSGPDYCVRSFLARSAGFQTIVLVATDVGVVELGSVRSVPESIEMVQSIRSWFSTRSSKLKELRRFLNGSRLAFPGTRNRLHGSSWAQSFGLKQGTPGEVYGSQATANNLKELVNGVREEFRHNHYQGQKQVQVQIDFSGATSGPSGIGRPLGAESEHSDVEASCKEERPGAADDRRPRKRGRKPANGREEPLNHVEAERQRREKLNQRFYALRAVVPNISKMDKASLLGDAISYINELQAKLKKMEAERGKLEGVVRDSSTLDVNTNGESHNQARDVDIQASHDEVMVRVSCPMDSHPASRVIQALKEAQVTVIESKLSAANDTVFHTFVIKSEGSEQLTKEKLMAAISFVWSCRGKVRWLSSTIPD

SEQ ID NO: 1779 - DNA, 1857 bp, Populus trichocarpa
  POPTR_0014s09520.1
atgaagattgagctgggtgtgggaggtggggcatggaacgatgaagataagaccatggttgctgctgttttaggcactaaagcttttaattacttgctatcaaattctgtagctaatcagaatctgttaatggctatgtgtggtgatgagagtttgcaaaataagctctctgatcttgtggaccgccccaacgcctccaatttcagctggaactatgccattttttggcagatttcatgttccaagtctggtgactgggttcttggttggggagatgggtcttgcagggagcctaaagaaggtgaagaatctgaggtcactagaattctcaatatacgccatgaggatgagactcagcagaggatgagaaagagagttattcagaagctgcagacgttgtttggagaatcagacgaggataattatgccttgggattggaccaggttactgatactgagatgttctttttggcctccatgtatttctcctttccccatggagaaggtggtccaggaaagtgttatgcctccgggaagcatatgtggatctctgatgctttgaaaccagggcctgattattgtgtgaggtcatttcttgcaaagtctgcggggtttcagacaattgtgttggtggctactgatgttggcgttgttgaattagggtcagtgagatctgttcctgaaagtatagaaatggttcaatcaataaggtcatggttttccactcggaattcaagtatcagagccaagccaatggctgcagcagcagcagcagcagcagccatgcctgctgtgagtgaaaagaaagatgagaattccccattttcaaattttgggattgtggagagagttggagttccgaagatttttggtcaggatttgaactcaaatcatggtcatggtcatggatttagggagaaacttgtcgtcagaaaaatggaagagagaccatcgtggaatgcttaccagaatggtactaggcttgcattacctggtgctcaaaatggccttcatggttctggttgggcacagagttttggtatgaaacaagggaccccaagtgatgtttatggttcacaagccacagcaaataatctacaagagctggttaatggggttagggaggagtttaggcttaaccattaccaacctcaaaagcaggtgcaaatgcaaattgatttttcaggagcctcttcggggccttctgtgattggcaaaccacttagtgcagaatctgagcattctgatgttgaagcttcatgcaaggaagaacggccaggcacggcagatgatcggaagcctcgtaaacgaggcaggaagccagcaaatggaagagaagaacccctcaatcatgttgaggcagagaggcagcggcgagagaagcttaaccagcggttctatgcattacgagctgttgtgcccaatatttccaagatggacaaggcttcattgttgggagatgctatttcttacatcaatgagcttcaagcaaagctcaaggtaatggaagctgaaagggaaaagtcggggagcatttcgagagatgcatcagctttggatgctaacacaaatggagaaagtcacaatcaagctccagatgtcgacattcaagcttcccatgatgagttgatggtaagagtgagttgtccgttggattcacatcctgcatcaagagtgattcaagcattcaaagaagcacaaatcactgttgttgagtcaaaactttctgctgcaaatgacactgtatttcatacatttgtgatcaagtctcaaggatccgagcagctaacaaaggaaaagctgatggcagcattttcccgcgaatccagctcattacactcattatcatcaactggg

SEQ ID NO: 1780 - protein, 619 aa, Populus trichocarpa
  POPTR_0014s09520.1
MKIELGVGGGAWNDEDKTMVAAVLGTKAFNYLLSNSVANQNLLMAMCGDESLQNKLSDLVDRPNASNFSWNYAIFWQISCSKSGDWVLGWGDGSCREPKEGEESEVTRILNIRHEDETQQRMRKRVIQKLQTLFGESDEDNYALGLDQVTDTEMFFLASMYFSFPHGEGGPGKCYASGKHMWISDALKPGPDYCVRSFLAKSAGFQTIVLVATDVGVVELGSVRSVPESIEMVQSIRSWFSTRNSSIRAKPMAAAAAAAAAMPAVSEKKDENSPFSNFGIVERVGVPKIFGQDLNSNHGHGHGFREKLVVRKMEERPSWNAYQNGTRLALPGAQNGLHGSGWAQSFGMKQGTPSDVYGSQATANNLQELVNGVREEFRLNHYQPQKQVQMQIDFSGASSGPSVIGKPLSAESEHSDVEASCKEERPGTADDRKPRKRGRKPANGREEPLNHVEAERQRREKLNQRFYALRAVVPNISKMDKASLLGDAISYINELQAKLKVMEAEREKSGSISRDASALDANTNGESHNQAPDVDIQASHDELMVRVSCPLDSHPASRVIQAFKEAQITVVESKLSAANDTVFHTFVIKSQGSEQLTKEKLMAAFSRESSSLHSLSSTG

SEQ ID NO: 1781 - DNA, 756 bp, Vitis vinifera
  GSVIVT01027162001
atgaaaactgaaatgggtatgggaggaggggcttggacggaggaggataaagcgatggtggcggctgttttgggcactcgagcatttgattacttgatgaccagctccgttgtgagtgagaatctgttaatggcagtggggagtgatgaaaatttgcagacaaagctttcggatctcgtagaccgaccaaatgcatccaatttcagttggaattatgcaattttctggcaaatttcacagtccaagtctggggattgggtgcttggatggggagatgggtcttgtagggagcccagggaaggggaggaatccgaagtgacccgaattttaaatattcggctcgaggatgaaacccagcagaggatgaggaaaagggtgcttcagaagctgcatacattgtttggaggctcggatgaggacagttatgcttttggattggaccgagtcactgatactgaaatgttttttctcgcttccatgtacttctcatttaccagaggagaaggtggcccagggaaatcttttggatctgggaagcatttgtggctgtctgatgcattgaaatctccatcagattattgtgttcgatcattccttgccaaatctgctggaattcagaccattgtgttaatcccaactgatgttggggttgtagagctgggttctgtgaggtcattacctgaaagcttagagattcatccaaacattcaaggaggcacagatcacagtgatcgagtcgaaacttgctgcagccaa

SEQ ID NO: 1782 - protein, 252 aa, Vitis vinifera
  GSVIVT01027162001
MKTEMGMGGGAWTEEDKAMVAAVLGTRAFDYLMTSSVVSENLLMAVGSDENLQTKLSDLVDRPNASNFSWNYAIFWQISQSKSGDWVLGWGDGSCREPREGEESEVTRILNIRLEDETQQRMRKRVLQKLHTLFGGSDEDSYAFGLDRVTDTEMFFLASMYFSFTRGEGGPGKSFGSGKHLWLSDALKSPSDYCVRSFLAKSAGIQTIVLIPTDVGVVELGSVRSLPESLEIHPNIQGGTDHSDRVETCCSQ

SEQ ID NO: 1783 - DNA, 1815 bp, Solanum lycopersicum
  Solyc01g096050.2.1
atggttactgggaatatgttgtggagtggtgaggataaggctatggtggcgtctgttttaggaaaggaagcttttgaatatttgatgtctggctctgtttcagcagaatgttctttaatggcaatagggaatgatcagaatttgcagaataagctttcagatctcgtggaacgcccaaacgccgctaattttagctggaattatgccatcttttggcaaatttcgcggtctaagtcaggggaattggtgctagggtggggggatgggtgttgcagagagcctaaggaagcagaggagcgtgaagttaaaaagattctcaatctacgcctcgatgatgagggtcaacaaaggatgaggaagagggtacttcagaagctgcatatgttatttggtggaacagatgaagataactatgcttttggattagatagagttactgatactgaaatgttcttccttgcctcgatgtatttttcgttccctcgaggagagggaggtcccgggaagtgttttggatcaggtaagtatttgtggttatcagatgcattgacatctaatctagattattgtgctagatctttcttagctaagtctgctggtatgcaaactattgctttgattccaactgatgtaggagttgtggaattggggtcagtgagatcgataccggagagtttagagctattacagaatataaaatcttgcttctcgtcgtttttatcacttgttagggataagcaagcagcaggtatagcagctgtacctgagaaaaacgagggaaacaatccccgcctttccaactctggcgctgttactgaacgaacagatggaaatcctaagatatttgggcatgatttgaattctggtactcactttagggaaaaacttgctgttaggaaagcggaggagaggccatgggacatgtaccaaaatggtaacaggatgccatttgtgaacgcacggaatggtttaaatcctgcttcttgggctcaattcagtaatgtgaagctgggaaagcctgtggagctctatgctcctccaaccccaggacacaacctgatgaatggtgggagggaagaattccgcttgaacaactttcaacatcaaaaaccagctgctagaatgcaaattgatttcaccggagcaacctcgagaaccattgtttccccagcacacaatgttgagtctgaacattcagatgttgaagcttcgtgcaaggaagaccgtgcaggcccagtggatgaaaagaggcctcgaaaacgtggaagaaagccagccaatggaagggaagagcctctcaatcatgtagaggcagagagacagcggagggaaaagttgaaccagcggttctatgccttacgagctgttgttccaaatatctccaagatggacaaagcttccctcttaggagatgccattgcttacataactgagctgcagaaaaaactaagagatatggaatctgagagggagctgagattaggaagcacttcaagggacgcaatcacttcagaagacagccctagttctgagattcaaatccgaggacccgacatcaacatagaagctgccaatgatgaagtcattgtaagggtgagctgctcactggaaacccatccactatctcgaatcatccaaatattcaaagaggcacaaataaacgttgttgaatcaaaactttccgcggggaatggtactgtatatcacacatttgtcatcaagtctagtggatccgaacagctgaccaaggaaaagctgctggcagcattttccagcgaatcaaactcgttaaggcaactttcaccggtagggcaa

SEQ ID NO: 1784 - protein, 605 aa, Solanum lycopersicum
  Solyc01g096050.2.1
MVTGNMLWSGEDKAMVASVLGKEAFEYLMSGSVSAECSLMAIGNDQNLQNKLSDLVERPNAANFSWNYAIFWQISRSKSGELVLGWGDGCCREPKEAEEREVKKILNLRLDDEGQQRMRKRVLQKLHMLFGGTDEDNYAFGLDRVTDTEMFFLASMYFSFPRGEGGPGKCFGSGKYLWLSDALTSNLDYCARSFLAKSAGMQTIALIPTDVGVVELGSVRSIPESLELLQNIKSCFSSFLSLVRDKQAAGIAAVPEKNEGNNPRLSNSGAVTERTDGNPKIFGHDLNSGTHFREKLAVRKAEERPWDMYQNGNRMPFVNARNGLNPASWAQFSNVKLGKPVELYAPPTPGHNLMNGGREEFRLNNFQHQKPAARMQIDFTGATSRTIVSPAHNVESEHSDVEASCKEDRAGPVDEKRPRKRGRKPANGREEPLNHVEAERQRREKLNQRFYALRAVVPNISKMDKASLLGDAIAYITELQKKLRDMESERELRLGSTSRDAITSEDSPSSEIQIRGPDINIEAANDEVIVRVSCSLETHPLSRIIQIFKEAQINVVESKLSAGNGTVYHTFVIKSSGSEQLTKEKLLAAFSSESNSLRQLSPVGQ

SEQ ID NO: 1785 - DNA, 1737 bp, Solanum lycopersicum
  Solyc05g050560.1.1
atgactatgttgtggagtgatgaggataagactatggtggcagcggtattaggaacaaaagcttttgattacttgatgtctagtttagtttctgctgaatgttctttaatggcaatggggagtgatgagaatttgcagaatatgctatcagatcttgtggaacgtccgaatgcaagtaattttagttggaattatgcaattttttggcagatttcgcggtctaagttgggggagttggtgttaggatggggagatggttgttgtagggaagctagggaaggagaggaatctgaacttactaggattctcaatatacgcctcgcggatgaggctcaacaaaggatgaggaagagggttcttcagaagttgcatatgttttttggtggaacagatgaagataactatgtgtctggattggataaagtcactgatactgaaatgttctttcttgcttcaatgtacttttcgtttcctcgagggcaaggtggtccggggaaatgttttactgctggtaaacatgtgtggttatcggatgttatgaggtcgtctgtagattattgttctaggtcttttctgatgaagtctgctggtatgcaaacagttgttttgatcccaactgatataggggttatggaattgggatctgtacgaactataccagaaagcttggagcttgtacattcaataaaatcttgcttctcgtcgtttttggctcaagttagggctaagcaagcggcacctttagcagcagttgtagctgagaaaaagaatggaaacaattctgtgtttcccagctcttttccttttgatcagtcaaaggaaaatccgaagatctttgggcagaatttagaatctggttctaccgagtttagggaaaaacttgctctcaggaaaccggtggatgggccactggaaatgtatagaaatggaaacagggctcccatcataaatacacaaaatggtgtacgccccgtatcatgggcttcatttggtaatgtaaagccagggaactcggtggatctctatagtcctcaggcaccaccaaacaacttacgagagtttgtcaatggtggaagagaagagctccggttaaatagcctccagcatcaaaagcctggtggaatgcaaatagatttcaccaactcaagacccgttgtttctccagtgcccactgttgaatcggagcattcagatgttgaagtttcatgcaaggaaaaacatgcaggaccagctgatgaaaggaggcctcgaaagcgtggaagaaaaccagccaatggaagggaagagcccctcaatcatgtagaagctgagaggcaacggagggagaagctgaaccagcggttttatgcattacgagctgttgttccaaatatttccaaaatggacaaagcttccctcttaggagatgccattgctcacatcactgacatgcagaagaggatcagggacgcggaatataagctggaaaagcgaggaagcacctctgtggatgcagctgatatcaacattgaagccgccagtgatgaagtcatcgtaagagctagatgcccactgggaacccatcctgtagcaaaagtcgttgaagcgttcaaagagacacaggtcagcgttgttgagtcaaaacttgccgtgggaaatgatacagtatatcatacatttgtggtcaagtccagtggacccgaacagctaacgaaggaaaagctaatggctgcatttgctggtgaatcaaactctctc

SEQ ID NO: 1786 - protein, 579 aa, Solanum lycopersicum
  Solyc05g050560.1.1
MTMLWSDEDKTMVAAVLGTKAFDYLMSSLVSAECSLMAMGSDENLQNMLSDLVERPNASNFSWNYAIFWQISRSKLGELVLGWGDGCCREAREGEESELTRILNIRLADEAQQRMRKRVLQKLHMFFGGTDEDNYVSGLDKVTDTEMFFLASMYFSFPRGQGGPGKCFTAGKHVWLSDVMRSSVDYCSRSFLMKSAGMQTVVLIPTDIGVMELGSVRTIPESLELVHSIKSCFSSFLAQVRAKQAAPLAAVVAEKKNGNNSVFPSSFPFDQSKENPKIFGQNLESGSTEFREKLALRKPVDGPLEMYRNGNRAPIINTQNGVRPVSWASFGNVKPGNSVDLYSPQAPPNNLREFVNGGREELRLNSLQHQKPGGMQIDFTNSRPVVSPVPTVESEHSDVEVSCKEKHAGPADERRPRKRGRKPANGREEPLNHVEAERQRREKLNQRFYALRAVVPNISKMDKASLLGDAIAHITDMQKRIRDAEYKLEKRGSTSVDAADINIEAASDEVIVRARCPLGTHPVAKVVEAFKETQVSVVESKLAVGNDTVYHTFVVKSSGPEQLTKEKLMAAFAGESNSL

SEQ ID NO: 1787 - DNA, 1161 bp, Arabidopsis thaliana
  AT5G54900.1
atgcagcaaccaccgtcaaacgccgccggagctggacagataccatcaggacaacagcatttgtggatgatgatgcaacagcagcagcagcagcagcagatgcagttgtctgcggcgccactaggtcaacatcagtacggtattggatctcagaatccaggatccgctagcgatgttaagtcgttgtggatcggagacttgcagcaatggatggacgagaactacatcatgagcgtctttgctcagtctggcgaggctacatcagctaaagtcattcgtaataagctgacgggacaatctgaaggttatggattcattgagttcgtcagccactctgtagcagagcgggttttgcagacttacaatggtgctcccatgccgagcactgaacagacgtttaggctcaactgggctcaggctggggctggagagaaacgattccagactgaagggcctgaccataccattttcgtaggtgacttggcacctgaggtgactgactatatgctctcggacacattcaagaatgtgtatgggtctgtcaaaggggctaaagttgtgcttgacaggaccactggaaggtccaaggggtatgggtttgttaggtttgcggatgaaaatgagcagatgcgtgccatgactgaaatgaatggtcaatactgctcgacaaggcctatgcgtattggtccggctgccaataagaatgctcttccgatgcaaccagctatgtatcaaaacactcaaggagcaaatgctggagataatgatcctaataacacaacaatttttgttggaggtctggatgctaatgttacagacgatgaattaaagtcaatttttggtcaatttggtgaacttcttcatgtgaaaatacctccaggaaaacgttgtggattcgttcaatatgccaacaaggcgtctgcagagcatgcactttcggtgctgaatggaacacaattaggtggacaaagcatccgtctttcgtggggacgtagtccaaacaagcagtctgatcaagcgcaatggaacggtggtggatactatggataccctccacagccacagggcggctatggttatgcagctcaaccaccaactcaagaccctaatgcgtactatggtggttacactggctatggcaactatcagcagcaacgtcag

SEQ ID NO: 1788 - protein, 387 aa, Arabidopsis thaliana
  AT5G54900.1
MQQPPSNAAGAGQIPSGQQHLWMMMQQQQQQQQMQLSAAPLGQHQYGIGSQNPGSASDVKSLWIGDLQQWMDENYIMSVFAQSGEATSAKVIRNKLTGQSEGYGFIEFVSHSVAERVLQTYNGAPMPSTEQTFRLNWAQAGAGEKRFQTEGPDHTIFVGDLAPEVTDYMLSDTFKNVYGSVKGAKVVLDRTTGRSKGYGFVRFADENEQMRAMTEMNGQYCSTRPMRIGPAANKNALPMQPAMYQNTQGANAGDNDPNNTTIFVGGLDANVTDDELKSIFGQFGELLHVKIPPGKRCGFVQYANKASAEHALSVLNGTQLGGQSIRLSWGRSPNKQSDQAQWNGGGYYGYPPQPQGGYGYAAQPPTQDPNAYYGGYTGYGNYQQQRQ

SEQ ID NO: 1789 - DNA, 1245 bp, Arabidopsis thaliana
  AT4G27000.1
atgatgcagcagccacctccagcttccaacggtgctgcaacagggccagggcagattccttccgaccaacaagcttacctccagcagcagcagtcgtggatgatgcagcaccagcagcaacaacaaggtcagccgcctgcaggatggaatcagcagtctgcaccgtcttctggtcaaccacagcagcagcagtatggtggtggtggatctcagaatccaggatcagctggtgagatccggtccctgtggatcggtgacttgcagccatggatggatgagaactatctcatgaacgtctttggtcttactggcgaggctacagcagctaaagttattcgcaataaacagaacggatattcagaaggttatggctttattgagtttgtgaaccatgctacagctgagaggaatttacagacttacaatggtgctccgatgccgagcagtgagcaggccttcaggttgaactgggctcagcttggagctggagagagacgccaggctgaagggcctgagcacacagtttttgttggagacttggcacctgatgttaccgaccacatgcttactgaaacgtttaaagctgtgtattcctctgtcaagggagctaaagttgtgaatgataggactactggacggtccaagggttatggatttgtcaggtttgcggatgaaagtgagcagattcgtgccatgactgaaatgaatggtcaatactgctcatcaaggcctatgcgtactggtcctgctgccaacaagaagcctcttacaatgcaaccagcttcatatcagaacactcaaggaaattcaggagaaagtgatccaactaacacaacaatttttgttggagctgtggatcaaagtgtaacagaagatgatttgaagtcagtttttggtcaatttggtgaactagttcatgtgaaaatacccgcaggaaaacgttgcggatttgttcaatacgccaatagggcatgtgctgagcaagcactttctgtgttgaacggaacacaacttgggggacaaagcattcgtctttcatggggtcgcagtccttccaacaaacagactcaacctgatcaagcccagtatggtggtggtggaggatactatgggtatcctcctcaaggatatgaagcatacggatatgcacctcctcctcaggaccctaacgcctactacggtggttatgctgggggcggctatggaaactaccagcagcctggtggataccagcagcaacagcag

SEQ ID NO: 1790 - protein, 415 aa, Arabidopsis thaliana
  AT4G27000.1
MMQQPPPASNGAATGPGQIPSDQQAYLQQQQSWMMQHQQQQQGQPPAGWNQQSAPSSGQPQQQQYGGGGSQNPGSAGEIRSLWIGDLQPWMDENYLMNVFGLTGEATAAKVIRNKQNGYSEGYGFIEFVNHATAERNLQTYNGAPMPSSEQAFRLNWAQLGAGERRQAEGPEHTVFVGDLAPDVTDHMLTETFKAVYSSVKGAKVVNDRTTGRSKGYGFVRFADESEQIRAMTEMNGQYCSSRPMRTGPAANKKPLTMQPASYQNTQGNSGESDPTNTTIFVGAVDQSVTEDDLKSVFGQFGELVHVKIPAGKRCGFVQYANRACAEQALSVLNGTQLGGQSIRLSWGRSPSNKQTQPDQAQYGGGGGYYGYPPQGYEAYGYAPPPQDPNAYYGGYAGGGYGNYQQPGGYQQQQQ

SEQ ID NO: 1791 - DNA, 1215 bp, Arabidopsis thaliana
  AT1G11650.2
atgatgcagcagccaccacccggaggtatccttccacatcacgctcctcctccttctgcgcaacaacagtacggttaccaacaaccttacgggattgctggagctgctccaccaccaccacagatgtggaatcctcaagcggcggcgccgccatcagttcagcctacgaccgctgacgagatccggactctttggatcggggacttacagtattggatggatgagaatttcctctacggttgctttgctcataccggagagatggtttctgctaaagtgattcgtaacaagcaaaccggtcaagttgaaggatacggtttcattgaattcgcatctcatgctgctgctgaaagagttctacaaacattcaacaacgctcctatcccgagctttcctgatcagctctttagactgaactgggcatcattgagttcaggagataaacgagacgattcaccggactacacgatatttgtcggtgatctggctgctgatgttacggattatatcttacttgagacgttcagagcctcttatccgtcagtgaagggtgcaaaggttgttattgacagagtcactggacgtacaaaaggatatgggtttgttaggttttctgatgaaagtgaacagatccgtgctatgacggagatgaatggcgttccttgttctactagacctatgagaattggtcccgctgctagcaagaaaggtgtaactggtcaaagagattcataccagagctctgctgcaggggtaacaactgataatgatccaaataacacaactgtttttgttggtggattagatgcatctgtcacggatgatcatctgaagaatgtctttagccaatatggtgagattgtgcatgtgaaaatacccgctggaaagcgctgtggattcgttcagttttccgagaagagctgtgcagaggaagctcttagaatgctgaatggagtgcaattaggcggaacaaccgtcaggctctcatggggccgaagtccttcgaacaaacagtcgggggatccgagccagttttactacggtgggtatggacaaggacaggagcagtatgggtacacgatgcctcaagaccctaatgcatattacggaggctactctggtggaggatacagcggtggttaccagcagacaccacaggcaggacagcaaccaccacaacagccaccacagcagcaacaagtcgggtttagctac

SEQ ID NO: 1792 - protein, 405 aa, Arabidopsis thaliana
  AT1G11650.2
MMQQPPPGGILPHHAPPPSAQQQYGYQQPYGIAGAAPPPPQMWNPQAAAPPSVQPTTADEIRTLWIGDLQYWMDENFLYGCFAHTGEMVSAKVIRNKQTGQVEGYGFIEFASHAAAERVLQTFNNAPIPSFPDQLFRLNWASLSSGDKRDDSPDYTIFVGDLAADVTDYILLETFRASYPSVKGAKVVIDRVTGRTKGYGFVRFSDESEQIRAMTEMNGVPCSTRPMRIGPAASKKGVTGQRDSYQSSAAGVTTDNDPNNTTVFVGGLDASVTDDHLKNVFSQYGEIVHVKIPAGKRCGFVQFSEKSCAEEALRMLNGVQLGGTTVRLSWGRSPSNKQSGDPSQFYYGGYGQGQEQYGYTMPQDPNAYYGGYSGGGYSGGYQQTPQAGQQPPQQPPQQQQVGFSY

SEQ ID NO: 1793 - DNA, 1425 bp, Brachypodium distachyon
  Bradi5g22410.1
atgatgcagcagcctccgccgtcgcagccacagcccggcatgggggcgcccatgcctccgcaaggcgcggccgggcagcctcctcagtggggcacgatcccgccgccgatgccgcatcagtacgcgcaaccgccgccgcagcagccgcaggcgatgtggggccagccgccgccacaggcggcctatgggcaaccgcctgctccgcagcagtactacgctgctcctcaggcgccgtccgctcccgcggcggcggacgaggtgaggacgctctggatcggagatctccagtactggatggacgagacttacatccacggctgcttcgcgtccaccggggagcttcaatccgtgaagcttatccgtgacaagcaaactggacaacttcagggttatggctttgttgagtttacgagccatgcagccgctgagcgagttcttcaagggtacaatggacatgcaatgccaaatgttgacctagcatacagactgaattgggccagtgctggtgaaaagcgtgatgataccccagattatacaatttttgttggggatttggcagcagatgttacagattacatattacaagagacattcagggtccattacccttcagtgaagggcgcaaaagttgtcactgataagatgacaatgcgttcaaagggttatggatttgtaaaattcggtgatcctacagagcaagctcgtgccatgacagaaatgaatgggatgccttgttcttccagacctatgcgcattggtccagcagcaaatagaaaaacaacaggggttcaggagagagtaccaaatacaaatactcaaggagctcagtctgacaatgatcctaacaataccaccatatttgttggtggccttgaccccaatgtcactgaagacgccttgaaacaagtgtttgctccttatggagaagttatccatgttaagatccctgttgggaaaagatgtggttttgttcagtttgtaaacaggccttctgctgagcaagctctgcaaatgctgcaagggaccccaattggtgggcagaatgttaggctttcatggggacgtagcccttcgaacaagcaggctcagcctcagcaggaatccagccagtggggtgctaatgctggtgctggttactatggtggctatggacaaggttatgatgcttatggcgggtatgcacaacctcaagatcctaacatgtatggttatggagcttatgctggttatcccaattaccaacaacaagcagtagcacagcagccgccacaacaacaggtgaatgagtcgaggcacgtcagaacccatttgaaggaactgtcaagccatgttcgagtacttgtcaatagagagagagagagagggacggtttatagactccagattttgattgcctctggcaaggtctatttatgcactgtatta

SEQ ID NO: 1794 - protein, 475 aa, Brachypodium distachyon
  Bradi5g22410.1
MMQQPPPSQPQPGMGAPMPPQGAAGQPPQWGTIPPPMPHQYAQPPPQQPQAMWGQPPPQAAYGQPPAPQQYYAAPQAPSAPAAADEVRTLWIGDLQYWMDETYIHGCFASTGELQSVKLIRDKQTGQLQGYGFVEFTSHAAAERVLQGYNGHAMPNVDLAYRLNWASAGEKRDDTPDYTIFVGDLAADVTDYILQETFRVHYPSVKGAKVVTDKMTMRSKGYGFVKFGDPTEQARAMTEMNGMPCSSRPMRIGPAANRKTTGVQERVPNTNTQGAQSDNDPNNTTIFVGGLDPNVTEDALKQVFAPYGEVIHVKIPVGKRCGFVQFVNRPSAEQALQMLQGTPIGGQNVRLSWGRSPSNKQAQPQQESSQWGANAGAGYYGGYGQGYDAYGGYAQPQDPNMYGYGAYAGYPNYQQQAVAQQPPQQQVNESRHVRTHLKELSSHVRVLVNRERERGTVYRLQILIASGKVYLCTVL

SEQ ID NO: 1795 - DNA, 1278 bp, Brachypodium distachyon
  Bradi5g22410.3
atgatgcagcagcctccgccgtcgcagccacagcccggcatgggggcgcccatgcctccgcaaggcgcggccgggcagcctcctcagtggggcacgatcccgccgccgatgccgcatcagtacgcgcaaccgccgccgcagcagccgcaggcgatgtggggccagccgccgccacaggcggcctatgggcaaccgcctgctccgcagcagtactacgctgctcctcaggcgccgtccgctcccgcggcggcggacgaggtgaggacgctctggatcggagatctccagtactggatggacgagacttacatccacggctgcttcgcgtccaccggggagcttcaatccgtgaagcttatccgtgacaagcaaactggacaacttcagggttatggctttgttgagtttacgagccatgcagccgctgagcgagttcttcaagggtacaatggacatgcaatgccaaatgttgacctagcatacagactgaattgggccagtgctggtgaaaagcgtgatgataccccagattatacaatttttgttggggatttggcagcagatgttacagattacatattacaagagacattcagggtccattacccttcagtgaagggcgcaaaagttgtcactgataagatgacaatgcgttcaaagggttatggatttgtaaaattcggtgatcctacagagcaagctcgtgccatgacagaaatgaatgggatgccttgttcttccagacctatgcgcattggtccagcagcaaatagaaaaacaacaggggttcaggagagagtaccaaatacaaatactcaaggagctcagtctgacaatgatcctaacaataccaccatatttgttggtggccttgaccccaatgtcactgaagacgccttgaaacaagtgtttgctccttatggagaagttatccatgttaagatccctgttgggaaaagatgtggttttgttcagtttgtaaacaggccttctgctgagcaagctctgcaaatgctgcaagggaccccaattggtgggcagaatgttaggctttcatggggacgtagcccttcgaacaagcaggctcagcctcagcaggaatccagccagtggggtgctaatgctggtgctggttactatggtggctatggacaaggttatgatgcttatggcgggtatgcacaacctcaagatcctaacatgtatggttatggagcttatgctggttatcccaattaccaacaacaagcagtagcacagcagccgccacaacaacag

SEQ ID NO: 1796 - protein, 426 aa, Brachypodium distachyon
  Bradi5g22410.3
MMQQPPPSQPQPGMGAPMPPQGAAGQPPQWGTIPPPMPHQYAQPPPQQPQAMWGQPPPQAAYGQPPAPQQYYAAPQAPSAPAAADEVRTLWIGDLQYWMDETYIHGCFASTGELQSVKLIRDKQTGQLQGYGFVEFTSHAAAERVLQGYNGHAMPNVDLAYRLNWASAGEKRDDTPDYTIFVGDLAADVTDYILQETFRVHYPSVKGAKVVTDKMTMRSKGYGFVKFGDPTEQARAMTEMNGMPCSSRPMRIGPAANRKTTGVQERVPNTNTQGAQSDNDPNNTTIFVGGLDPNVTEDALKQVFAPYGEVIHVKIPVGKRCGFVQFVNRPSAEQALQMLQGTPIGGQNVRLSWGRSPSNKQAQPQQESSQWGANAGAGYYGGYGQGYDAYGGYAQPQDPNMYGYGAYAGYPNYQQQAVAQQPPQQQ

SEQ ID NO: 1797 - DNA, 1269 bp, Brachypodium distachyon
  Bradi5g22410.2
atgatgcagcagcctccgccgtcgcagccacagcccggcatgggggcgcccatgcctccgcaaggcgcggccgggcagcctcctcagtggggcacgatcccgccgccgatgccgcatcagtacgcgcaaccgccgccgcagcagccgcaggcgatgtggggccagccgccgccacaggcggcctatgggcaaccgcctgctccgcagcagtactacgctgctcctcaggcgccgtccgctcccgcggcggcggacgaggtgaggacgctctggatcggagatctccagtactggatggacgagacttacatccacggctgcttcgcgtccaccggggagcttcaatccgtgaagcttatccgtgacaagcaaactggacaacttcagggttatggctttgttgagtttacgagccatgcagccgctgagcgagttcttcaagggtacaatggacatgcaatgccaaatgttgacctagcatacagactgaattgggccagtgctggtgaaaagcgtgatgataccccagattatacaatttttgttggggatttggcagcagatgttacagattacatattacaagagacattcagggtccattacccttcagtgaagggcgcaaaagttgtcactgataagatgacaatgcgttcaaagggttatggatttgtaaaattcggtgatcctacagagcaagctcgtgccatgacagaaatgaatgggatgccttgttcttccagacctatgcgcattggtccagcagcaaatagaaaaacaacaggggttcaggagagagtaccaaatacaaatactcaaggagctcagtctgacaatgatcctaacaataccaccatatttgttggtggccttgaccccaatgtcactgaagacgccttgaaacaagtgtttgctccttatggagaagttatccatgttaagatccctgttgggaaaagatgtggttttgttcagtttgtaaacaggccttctgctgagcaagctctgcaaatgctgcaagggaccccaattggtgggcagaatgttaggctttcatggggacgtagcccttcgaacaagcaggctcaggaatccagccagtggggtgctaatgctggtgctggttactatggtggctatggacaaggttatgatgcttatggcgggtatgcacaacctcaagatcctaacatgtatggttatggagcttatgctggttatcccaattaccaacaacaagcagtagcacagcagccgccacaacaacag

SEQ ID NO: 1798 - protein, 423 aa, Brachypodium distachyon
  Bradi5g22410.2
MMQQPPPSQPQPGMGAPMPPQGAAGQPPQWGTIPPPMPHQYAQPPPQQPQAMWGQPPPQAAYGQPPAPQQYYAAPQAPSAPAAADEVRTLWIGDLQYWMDETYIHGCFASTGELQSVKLIRDKQTGQLQGYGFVEFTSHAAAERVLQGYNGHAMPNVDLAYRLNWASAGEKRDDTPDYTIFVGDLAADVTDYILQETFRVHYPSVKGAKVVTDKMTMRSKGYGFVKFGDPTEQARAMTEMNGMPCSSRPMRIGPAANRKTTGVQERVPNTNTQGAQSDNDPNNTTIFVGGLDPNVTEDALKQVFAPYGEVIHVKIPVGKRCGFVQFVNRPSAEQALQMLQGTPIGGQNVRLSWGRSPSNKQAQESSQWGANAGAGYYGGYGQGYDAYGGYAQPQDPNMYGYGAYAGYPNYQQQAVAQQPPQQQ

SEQ ID NO: 1799 - DNA, 1380 bp, Oryza sativa
  LOC_Os04g53440.1
atgcagcagccgccgtcgcagccgcagcccggcatgggcggcccgcctccgccgccacagggcgcggcggggcagccgccgcagtggggcgcgatcccgccgccgatgccgccgcaccagtacggcgcgccgccgccccagcagccgccggcgatgtggggccagcccccgccgcaggcgcactacgggcaggtgcccccgccccagccgtactacgccgcgccaccgccgcaggcgatgcccgcccccgcggccgcggacgaggtgaagacgctctggatcggcgacctgcagccctggatggacgagagctacatctacaactgcttcgcggccaccggggaggttcaatctgtgaagcttatccgggacaaacaaagtggacagcttcagggttatggctttgttgagtttacaagtcgtgcagctgctgatcgaattcttcagacttataatggacagatgatgccgaatgttgagatggtcttccgattgaattgggccagtgctggcgagaagcgtgatgatacccctgactacaccatttttgtcggggatttggctgcagatgttacagactacctactacaagagacattcagggtccattacccttcggttaagggtgcaaaagttgtaactgacaaaatgacaatgcgttcaaagggttatgggtttgtgaaatttggtgatcctacagagcaagctcgtgcaatgactgaaatgaatggaatgctttgctcttccagaccgatgcgtattggtccagcggcaaataagaaaacaacaggggttcaggagagagtaccaaatgctcaaggagctcagtctgagaatgatcctaacaataccaccatattcgttggtggtcttgaccccaacgtcactgaagatgtcttgaaacaagttttcgctccttatggagaagttgtccatgttaagattcctgttgggaaaagatgtggttttgttcaatatgttaacaggttgactctttgttcgtttgttctatttccacagatgtcttactgccttgtattttttttttttgatgaggtacttgcaaattactcttgtcattgcatattcaggccttctgctgagcaagcactggcagtgctacaagggaccttgattggtgggcagaatgttagactttcgtggggtcgaagcctttcaaacaaacagcctcagcacgactcgaatcagtggggtgctggtgctggtgctggtggttactatggtggctatggacaaggttatgaggcttatggtgggtatgcacaacctcaggatcctaacatgtatggttatggagcctatgctggttatcccaattaccaacagcaacaagtagcacagcagcagccgccgcagcag

SEQ ID NO: 1800 - protein, 460 aa, Oryza sativa
  LOC_Os04g53440.1
MQQPPSQPQPGMGGPPPPPQGAAGQPPQWGAIPPPMPPHQYGAPPPQQPPAMWGQPPPQAHYGQVPPPQPYYAAPPPQAMPAPAAADEVKTLWIGDLQPWMDESYIYNCFAATGEVQSVKLIRDKQSGQLQGYGFVEFTSRAAADRILQTYNGQMMPNVEMVFRLNWASAGEKRDDTPDYTIFVGDLAADVTDYLLQETFRVHYPSVKGAKVVTDKMTMRSKGYGFVKFGDPTEQARAMTEMNGMLCSSRPMRIGPAANKKTTGVQERVPNAQGAQSENDPNNTTIFVGGLDPNVTEDVLKQVFAPYGEVVHVKIPVGKRCGFVQYVNRLTLCSFVLFPQMSYCLVFFFFDEVLANYSCHCIFRPSAEQALAVLQGTLIGGQNVRLSWGRSLSNKQPQHDSNQWGAGAGAGGYYGGYGQGYEAYGGYAQPQDPNMYGYGAYAGYPNYQQQQVAQQQPPQQ

SEQ ID NO: 1801 - DNA, 1275 bp, Oryza sativa
  LOC_Os04g53440.2
atgcagcagccgccgtcgcagccgcagcccggcatgggcggcccgcctccgccgccacagggcgcggcggggcagccgccgcagtggggcgcgatcccgccgccgatgccgccgcaccagtacggcgcgccgccgccccagcagccgccggcgatgtggggccagcccccgccgcaggcgcactacgggcaggtgcccccgccccagccgtactacgccgcgccaccgccgcaggcgatgcccgcccccgcggccgcggacgaggtgaagacgctctggatcggcgacctgcagccctggatggacgagagctacatctacaactgcttcgcggccaccggggaggttcaatctgtgaagcttatccgggacaaacaaagtggacagcttcagggttatggctttgttgagtttacaagtcgtgcagctgctgatcgaattcttcagacttataatggacagatgatgccgaatgttgagatggtcttccgattgaattgggccagtgctggcgagaagcgtgatgatacccctgactacaccatttttgtcggggatttggctgcagatgttacagactacctactacaagagacattcagggtccattacccttcggttaagggtgcaaaagttgtaactgacaaaatgacaatgcgttcaaagggttatgggtttgtgaaatttggtgatcctacagagcaagctcgtgcaatgactgaaatgaatggaatgctttgctcttccagaccgatgcgtattggtccagcggcaaataagaaaacaacaggggttcaggagagagtaccaaatgctcaaggagctcagtctgagaatgatcctaacaataccaccatattcgttggtggtcttgaccccaacgtcactgaagatgtcttgaaacaagttttcgctccttatggagaagttgtccatgttaagattcctgttgggaaaagatgtggttttgttcaatatgttaacaggccttctgctgagcaagcactggcagtgctacaagggaccttgattggtgggcagaatgttagactttcgtggggtcgaagcctttcaaacaaacagcctcagcacgactcgaatcagtggggtgctggtgctggtgctggtggttactatggtggctatggacaaggttatgaggcttatggtgggtatgcacaacctcaggatcctaacatgtatggttatggagcctatgctggttatcccaattaccaacagcaacaagtagcacagcagcagccgccgcagcag

SEQ ID NO: 1802 - protein, 425 aa, Oryza sativa
  LOC_Os04g53440.2
MQQPPSQPQPGMGGPPPPPQGAAGQPPQWGAIPPPMPPHQYGAPPPQQPPAMWGQPPPQAHYGQVPPPQPYYAAPPPQAMPAPAAADEVKTLWIGDLQPWMDESYIYNCFAATGEVQSVKLIRDKQSGQLQGYGFVEFTSRAAADRILQTYNGQMMPNVEMVFRLNWASAGEKRDDTPDYTIFVGDLAADVTDYLLQETFRVHYPSVKGAKVVTDKMTMRSKGYGFVKFGDPTEQARAMTEMNGMLCSSRPMRIGPAANKKTTGVQERVPNAQGAQSENDPNNTTIFVGGLDPNVTEDVLKQVFAPYGEVVHVKIPVGKRCGFVQYVNRPSAEQALAVLQGTLIGGQNVRLSWGRSLSNKQPQHDSNQWGAGAGAGGYYGGYGQGYEAYGGYAQPQDPNMYGYGAYAGYPNYQQQQVAQQQPPQQ

SEQ ID NO: 1803 - DNA, 1296 bp, Zea mays
  GRMZM2G012628_T01
atgatgcagcagcccccgccgcagcagccgcagccgggcatggcgccgcctccgcctccgcaggctgctggcgggcagccaccgcagtggggtgggatcccgccgccgatggcgcagcagtacggcgcaccgcctccgcagcagcctccggcgatgtggggccagcctccgccgcaggcgcactacgggcaggcaccaacccctcagcagtactacgccgcgccgccggtgccggtgcaggcgccagccgcccccgctgcggcggacgaggtcaggacgctctggatcggggacctgcaatactggatggacgagaactacgtcttcgggtgcttttcgaacactggggaggttcaaaatgtgaagctcatccgtgacaagaattcagggcagcttcagggttatggttttgttgagtttacaagccgtgcagctgcagaacgagttcttcagacatacaatggacaaatgatgccaaatgttgacttgacatttcggctgaattgggccagtgctggtgaaaagcgcgatgatactcctgaatatactatttttgttggggatttggctgcagatgttacagattacttgttacaagagacattcagggttcattatccctctgtcaagggtgcaaaagttgtgactgataaattgacaatgcgcacaaagggttatggatttgtgaaatttggtgatcctacagagcaagctcgtgcaatgactgaaatgaatggaatgccttgttcttccaggcctatgcgtattggtcctgcagcaagtaggaaaaatacaggaggtgttgttcaagagagagtaccaaattctcaaggagctcagtctgagaatgatcctaacaataccactatatttgttggtgggcttgaccccaatgtcactgaagataccctaaaacaagttttttctccttacggtgaagtcgtccatgttaagatccctgttgggaagagatgtggttttgttcagttcgttaccagaccttctgctgaacaagcgctgctaatgctgcaaggggccttgattggtgcacagaatgttcgactttcatggggtagaagcctgtcgaacaagcaggctcagcctcagcaggaatccaatcaatggggtgcggctgctggtgctggtggctactatgggggctatggacaaggttatgaggcttatggcagtgggtatgcacaaccccaggatcctaacatgtatggttatggcgcttatggcggttatcccaattaccaacagcaaccagctgcacagcagcaacagcaacaacag

SEQ ID NO: 1804 - protein, 432 aa, Zea mays
  GRMZM2G012628_T01
MMQQPPPQQPQPGMAPPPPPQAAGGQPPQWGGIPPPMAQQYGAPPPQQPPAMWGQPPPQAHYGQAPTPQQYYAAPPVPVQAPAAPAAADEVRTLWIGDLQYWMDENYVFGCFSNTGEVQNVKLIRDKNSGQLQGYGFVEFTSRAAAERVLQTYNGQMMPNVDLTFRLNWASAGEKRDDTPEYTIFVGDLAADVTDYLLQETFRVHYPSVKGAKVVTDKLTMRTKGYGFVKFGDPTEQARAMTEMNGMPCSSRPMRIGPAASRKNTGGVVQERVPNSQGAQSENDPNNTTIFVGGLDPNVTEDTLKQVFSPYGEVVHVKIPVGKRCGFVQFVTRPSAEQALLMLQGALIGAQNVRLSWGRSLSNKQAQPQQESNQWGAAAGAGGYYGGYGQGYEAYGSGYAQPQDPNMYGYGAYGGYPNYQQQPAAQQQQQQQ

SEQ ID NO: 1805 - DNA, 987 bp, Zea mays
  GRMZM2G058098_T01
atgatgcagcagcccccgcagccgcagccgggtatggcgctacctcctccccctcagaccggtggcgggcagccaccgcagtggggcgcgatcccgccgccgatgacgcagcagtacggcgcaccacctccgcagcagcctccagcgatgtggggccagcctccgtcgcaggcgcactacgggcaggcgccgccccctcagccgtattatgccgcgccgccggtgccggccgcccccgctgcggcggacgaggtcaggacgctctggatcggggacctgcagtactggatggacgataactatgtcttcgggtgcttttcgaacaccggcgaggttcaaaatgtgaagctcatccgcgacaagaattcaggacagcttcagggctatggttttgttgaatttacaagccgtgcagctgcagagcgagttcttcagacatataatggacaaatgatgccaaatgttgacttgacatttcggctgaactgggccagtgctggtgaaaagcgtgatgatactcctgactatactattttcgttggtgatttggctgcagatgttacagattacttgttacaagagacattcagggttcattatccctcggtgaagggtgcaaaagttgtgactgataaattgacaatgcgtaccaagggttatggatttgtgaaatttggcgatcctacagagcaagctcgtgcaatgactgaaatgaatggaatgccttgttcttccaggcctatgcgtattggtcctgcagcaagtagaaaaaatgcaggtggtgttgttcaagagagagtaccaaattctcaaggagctcagtctgagaatgatcctaacaataccactatatttgttggtgggcttgaccccaatgtcactgaagatgtcctaaaacaagcattttctccttatggcgaagtcatccatgttaagatccctgttgggaagagatgtggttttgttcagtttgttaccaggcgctgc

SEQ ID NO: 1806 - protein, 329 aa, Zea mays
  GRMZM2G058098_T01
MMQQPPQPQPGMALPPPPQTGGGQPPQWGAIPPPMTQQYGAPPPQQPPAMWGQPPSQAHYGQAPPPQPYYAAPPVPAAPAAADEVRTLWIGDLQYWMDDNYVFGCFSNTGEVQNVKLIRDKNSGQLQGYGFVEFTSRAAAERVLQTYNGQMMPNVDLTFRLNWASAGEKRDDTPDYTIFVGDLAADVTDYLLQETFRVHYPSVKGAKVVTDKLTMRTKGYGFVKFGDPTEQARAMTEMNGMPCSSRPMRIGPAASRKNAGGVVQERVPNSQGAQSENDPNNTTIFVGGLDPNVTEDVLKQAFSPYGEVIHVKIPVGKRCGFVQFVTRRC

SEQ ID NO: 1807 - DNA, 1281 bp, Zea mays
  GRMZM2G058098_T02
atgatgcagcagcccccgcagccgcagccgggtatggcgctacctcctccccctcagaccggtggcgggcagccaccgcagtggggcgcgatcccgccgccgatgacgcagcagtacggcgcaccacctccgcagcagcctccagcgatgtggggccagcctccgtcgcaggcgcactacgggcaggcgccgccccctcagccgtattatgccgcgccgccggtgccggccgcccccgctgcggcggacgaggtcaggacgctctggatcggggacctgcagtactggatggacgataactatgtcttcgggtgcttttcgaacaccggcgaggttcaaaatgtgaagctcatccgcgacaagaattcaggacagcttcagggctatggttttgttgaatttacaagccgtgcagctgcagagcgagttcttcagacatataatggacaaatgatgccaaatgttgacttgacatttcggctgaactgggccagtgctggtgaaaagcgtgatgatactcctgactatactattttcgttggtgatttggctgcagatgttacagattacttgttacaagagacattcagggttcattatccctcggtgaagggtgcaaaagttgtgactgataaattgacaatgcgtaccaagggttatggatttgtgaaatttggcgatcctacagagcaagctcgtgcaatgactgaaatgaatggaatgccttgttcttccaggcctatgcgtattggtcctgcagcaagtagaaaaaatgcaggtggtgttgttcaagagagagtaccaaattctcaaggagctcagtctgagaatgatcctaacaataccactatatttgttggtgggcttgaccccaatgtcactgaagatgtcctaaaacaagcattttctccttatggcgaagtcatccatgttaagatccctgttgggaagagatgtggttttgttcagtttgttaccagaccttctgctgagcaggcgctgctaatgttgcaaggggccttgattggtgcacagaatgttcggctttcgtggggtagaagcctgtcgaacaagcagactcagcctcagcaggaatccatgcaatggggtgcgggtgcgcctgctggtgttggtgattactatggtggctatggacaaggttatgaggcttatggcagtgggtatgcacaaccccaggaccctaacatgtatggttatggcgcttatgttggttatcccaattaccaacagcaaccagctgcacagcagccacagcaacaa

SEQ ID NO: 1808 - protein, 428 aa, Zea mays
  GRMZM2G058098_T02
MMQQPPQPQPGMALPPPPQTGGGQPPQWGAIPPPMTQQYGAPPPQQPPAMWGQPPSQAHYGQAPPPQPYYAAPPVPAAPAAADEVRTLWIGDLQYWMDDNYVFGCFSNTGEVQNVKLIRDKNSGQLQGYGFVEFTSRAAAERVLQTYNGQMMPNVDLTFRLNWASAGEKRDDTPDYTIFVGDLAADVTDYLLQETFRVHYPSVKGAKVVTDKLTMRTKGYGFVKFGDPTEQARAMTEMNGMPCSSRPMRIGPAASRKNAGGVVQERVPNSQGAQSENDPNNTTIFVGGLDPNVTEDVLKQAFSPYGEVIHVKIPVGKRCGFVQFVTRPSAEQALLMLQGALIGAQNVRLSWGRSLSNKQTQPQQESMQWGAGAPAGVGDYYGGYGQGYEAYGSGYAQPQDPNMYGYGAYVGYPNYQQQPAAQQPQQQQ

SEQ ID NO: 1809 - DNA, 1302 bp, Zea mays
  GRMZM2G058098_T03
atgatgcagcagcccccgcagccgcagccgggtatggcgctacctcctccccctcagaccggtggcgggcagccaccgcagtggggcgcgatcccgccgccgatgacgcagcagtacggcgcaccacctccgcagcagcctccagcgatgtggggccagcctccgtcgcaggcgcactacgggcaggcgccgccccctcagccgtattatgccgcgccgccggtgccggccgcccccgctgcggcggacgaggtcaggacgctctggatcggggacctgcagtactggatggacgataactatgtcttcgggtgcttttcgaacaccggcgaggttcaaaatgtgaagctcatccgcgacaagaattcaggacagcttcagggctatggttttgttgaatttacaagccgtgcagctgcagagcgagttcttcagacatataatggacaaatgatgccaaatgttgacttgacatttcggctgaactgggccagtgctggtgaaaagcgtgatgatactcctgactatactattttcgttggtgatttggctgcagatgttacagattacttgttacaagagacattcagggttcattatccctcggtgaagggtgcaaaagttgtgactgataaattgacaatgcgtaccaagggttatggatttgtgaaatttggcgatcctacagagcaagctcgtgcaatgactgaaatgaatggaatgccttgttcttccaggcctatgcgtattggtcctgcagcaagtagaaaaaatgcaggtggtgttgttcaagagagagtaccaaattctcaaggagctcagtctgagaatgatcctaacaataccactatatttgttggtgggcttgaccccaatgtcactgaagatgtcctaaaacaagcattttctccttatggcgaagtcatccatgttaagatccctgttgggaagagatgtggttttgttcagtttgttaccagaccttctgctgagcaggcgctgctaatgttgcaaggggccttgattggtgcacagaatgttcggctttcgtggggtagaagcctgtcgaacaagcagactcagcctcagcaggaatccatgcaatggggtgcgggtgcgcctgctggtgttggtgattactatggtggctatggacaaggttatgaggcttatggcagtgggtatgcacaaccccaggaccctaacatgtatggttatggcgcttatgttggttatcccaattaccaacagcaaccagctgcacagcagccacagcaacaacaggtgaagctcctagctaat

SEQ ID NO: 1810 - protein, 434 aa, Zea mays
  GRMZM2G058098_T03
MMQQPPQPQPGMALPPPPQTGGGQPPQWGAIPPPMTQQYGAPPPQQPPAMWGQPPSQAHYGQAPPPQPYYAAPPVPAAPAAADEVRTLWIGDLQYWMDDNYVFGCFSNTGEVQNVKLIRDKNSGQLQGYGFVEFTSRAAAERVLQTYNGQMMPNVDLTFRLNWASAGEKRDDTPDYTIFVGDLAADVTDYLLQETFRVHYPSVKGAKVVTDKLTMRTKGYGFVKFGDPTEQARAMTEMNGMPCSSRPMRIGPAASRKNAGGVVQERVPNSQGAQSENDPNNTTIFVGGLDPNVTEDVLKQAFSPYGEVIHVKIPVGKRCGFVQFVTRPSAEQALLMLQGALIGAQNVRLSWGRSLSNKQTQPQQESMQWGAGAPAGVGDYYGGYGQGYEAYGSGYAQPQDPNMYGYGAYVGYPNYQQQPAAQQPQQQQVKLLAN

SEQ ID NO: 1811 - DNA, 1284 bp, Setaria italica
  Si010174m
atgatgcagcagcccccaccgcagcagccgcagcccggcatggcgccgccgccgcctccgcaggccgcgggcgggcagccgcctcagtggggcgggatcccgccgccgatgacgcagcagtacggcgcgccgccgccgcagcagccgccggcgatgtggggacagcctccgccgcaggggcactacgggcaggcgccgcccccgcagccgtactacgctgcgccgccggcacaagctccggctgcccccgcggcggcggatgaggtgaggacgctctggatcggggacctgcagtactggatggacgagaactacatctacggatgcttcgccaacaccggggaggttcaatctgttaaactcatccgtgacaagaattcagggcagctccagggttatggctttgttgaatttacaagccgtgcagctgcagagcgagttcttcaaacatacaatggtcaaatgatgcccaatgttgagttgacattccggctgaactgggccagtgctggtgaaaagcgtgatgatacccctgactatactatttttgtgggggatttggctgcagatgttacagattacttattacaagagacattcagggttcattatccatcggtgaagggtgcaaaggttgtgactgataagttgacaatgcgttcgaagggttatgggtttgtgaaatttggtgatccaactgagcaagctcgtgcaatgactgaaatgaatggaatgccttgttcgtccaggcctatgcgtattggtcctgcagcaagtaggaagacaacaggagttcaagaaagagtaccaaattctcaaggagctcagtctgagaatgatcctaacaataccactatatttgttggtggccttgaccccaacgttactgaagatgtcctgaaacaagtttttgctccttatggggaagttgtccatgttaagatacctgttgggaaaagatgtggttttgttcagttcgttaccagaccttctgccgagcaagcgctgctgatgctgcaagggaccttaattggtgggcaaaatgttaggctttcatggggtcgaagcctgtccaacaagcctcagcaggattccaaccaatggggtggggctgctgcttctgctgctgccggtggttactatggtggctatggacaaggctatgaggcttatggtggtgggtatgcacaacctcaggatcctaacatgtatggttatggtgcttatgctggttatcccaattaccaacagcaaccagctgcacagcagccacagcaacaacag

SEQ ID NO: 1812 - protein, 428 aa, Setaria italica
  Si010174m
MMQQPPPQQPQPGMAPPPPPQAAGGQPPQWGGIPPPMTQQYGAPPPQQPPAMWGQPPPQGHYGQAPPPQPYYAAPPAQAPAAPAAADEVRTLWIGDLQYWMDENYIYGCFANTGEVQSVKLIRDKNSGQLQGYGFVEFTSRAAAERVLQTYNGQMMPNVELTFRLNWASAGEKRDDTPDYTIFVGDLAADVTDYLLQETFRVHYPSVKGAKVVTDKLTMRSKGYGFVKFGDPTEQARAMTEMNGMPCSSRPMRIGPAASRKTTGVQERVPNSQGAQSENDPNNTTIFVGGLDPNVTEDVLKQVFAPYGEVVHVKIPVGKRCGFVQFVTRPSAEQALLMLQGTLIGGQNVRLSWGRSLSNKPQQDSNQWGGAAASAAAGGYYGGYGQGYEAYGGGYAQPQDPNMYGYGAYAGYPNYQQQPAAQQPQQQQ

SEQ ID NO: 1813 - DNA, 1305 bp, Brachypodium distachyon
  Bradi3g15180.1
atgatgccgcagccgcagcccggggtcgccccgctgccgcacccgcagcaggcgccgaccggcgcgccgccgcagtggggcaccatcccgccgcccatgccgccgcagcagcactacgcgccgccgcccccacagcagcaccacgcgcctcccccgccgcagatgtggggccaggtgcccccgccccagcaggccgccccgtacggccaggccccgccgccgccccagcatgccgcctactacggcgcgccggcggcacccgcgcaggcccctgcgggccccaacgaggtcaggacgctctggatcggggacctacagtactggatggacgagaactacgtctacgggtgcttcgcgcacaccggcgaggtacaatctgtgaagttgattcgtgacaagcaaactggacaacttcagggttacggttttgttgaattcacaacccgtgctggtgctgaaagagttcttcaaacatacaatggggcaacaatgccaaatgttgagatgccatacagattgaattgggcctctgctggtgaaaaacgtgatgatggccctgattacacaatatttgttggtgatttggctgctgatgttacagactacatattacaagagacatttagggtacattacccgtctgtgaagggtgcaaaggttgtcacagataaactgactatgcgctcgaagggctatggctttgtgaaattcagtgatcctaccgagcaaactcgtgcgatgactgaaatgaacgggatggtatgttcctcaaggcccatgcgtattggtccagctgcaaataagcagaaagtatctggagctcaagagaaagtaccaagtgctcaaggagttcagtctgacagtgatcctagcaataccactatatttgtcggtggacttgacccaaatgtcactgaagatatgttaaaacaagttttcgctccttatggtgaagtggtccatgttaagatccctgttggcaaaagatgtggttttgttcaatatgctagcaggtcctcttctgaggaggcattgctgatgctgcaaggtactgtgattggagggcagaatgtgaggctttcatggggtcggagcccttcaaacaaacaagttcagactcctcaagactcgaatcagtggggtggtgctactgctaatgctggctactatggctatggacaaggttatgaggcgtatggatatgctgctcaacctcaggacccaaatatgtatgggtatggagcatatgctgggtatccaaattatccacagcaacaagcagcacagcagccacagcagcaacag

SEQ ID NO: 1814 - protein, 435 aa, Brachypodium distachyon
  Bradi3g15180.1
MMPQPQPGVAPLPHPQQAPTGAPPQWGTIPPPMPPQQHYAPPPPQQHHAPPPPQMWGQVPPPQQAAPYGQAPPPPQHAAYYGAPAAPAQAPAGPNEVRTLWIGDLQYWMDENYVYGCFAHTGEVQSVKLIRDKQTGQLQGYGFVEFTTRAGAERVLQTYNGATMPNVEMPYRLNWASAGEKRDDGPDYTIFVGDLAADVTDYILQETFRVHYPSVKGAKVVTDKLTMRSKGYGFVKFSDPTEQTRAMTEMNGMVCSSRPMRIGPAANKQKVSGAQEKVPSAQGVQSDSDPSNTTIFVGGLDPNVTEDMLKQVFAPYGEVVHVKIPVGKRCGFVQYASRSSSEEALLMLQGTVIGGQNVRLSWGRSPSNKQVQTPQDSNQWGGATANAGYYGYGQGYEAYGYAAQPQDPNMYGYGAYAGYPNYPQQQAAQQPQQQQ

SEQ ID NO: 1815 - DNA, 1410 bp, Brachypodium distachyon
  Bradi3g15180.3
atgatgccgcagccgcagcccggggtcgccccgctgccgcacccgcagcaggcgccgaccggcgcgccgccgcagtggggcaccatcccgccgcccatgccgccgcagcagcactacgcgccgccgcccccacagcagcaccacgcgcctcccccgccgcagatgtggggccaggtgcccccgccccagcaggccgccccgtacggccaggccccgccgccgccccagcatgccgcctactacggcgcgccggcggcacccgcgcaggcccctgcgggccccaacgaggtcaggacgctctggatcggggacctacagtactggatggacgagaactacgtctacgggtgcttcgcgcacaccggcgaggtacaatctgtgaagttgattcgtgacaagcaaactggacaacttcagggttacggttttgttgaattcacaacccgtgctggtgctgaaagagttcttcaaacatacaatggggcaacaatgccaaatgttgagatgccatacagattgaattgggcctctgctggtgaaaaacgtgatgatggccctgattacacaatatttgttggtgatttggctgctgatgttacagactacatattacaagagacatttagggtacattacccgtctgtgaagggtgcaaaggttgtcacagataaactgactatgcgctcgaagggctatggctttgtgaaattcagtgatcctaccgagcaaactcgtgcgatgactgaaatgaacgggatggtatgttcctcaaggcccatgcgtattggtccagctgcaaataagcagaaagtatctggagctcaagagaaagtaccaagtgctcaaggagttcagtctgacagtgatcctagcaataccactatatttgtcggtggacttgacccaaatgtcactgaagatatgttaaaacaagttttcgctccttatggtgaagtggtccatgttaagatccctgttggcaaaagatgtggttttgttcaatatgctagcaggtcctcttctgaggaggcattgctgatgctgcaaggtactgtgattggagggcagaatgtgaggctttcatggggtcggagcccttcaaacaaacaagttcagactcctcaagactcgaatcagtggggtggtgctactgctaatgctggctactatggctatggacaaggttatgaggcgtatggatatgctgctcaacctcaggacccaaatatgtatgggtatggagcatatgctgggtatccaaattatccacagcaacaagcagcacagcagccacagcagcaacaggtgaaatcttgcttaactgtcaatgctatccgatttggtggaaactcttatatcagcataagcaacatgaattgtgcagttgttgtagcgcatgtgatacatgca

SEQ ID NO: 1816 - protein, 470 aa, Brachypodium distachyon
  Bradi3g15180.3
MMPQPQPGVAPLPHPQQAPTGAPPQWGTIPPPMPPQQHYAPPPPQQHHAPPPPQMWGQVPPPQQAAPYGQAPPPPQHAAYYGAPAAPAQAPAGPNEVRTLWIGDLQYWMDENYVYGCFAHTGEVQSVKLIRDKQTGQLQGYGFVEFTTRAGAERVLQTYNGATMPNVEMPYRLNWASAGEKRDDGPDYTIFVGDLAADVTDYILQETFRVHYPSVKGAKVVTDKLTMRSKGYGFVKFSDPTEQTRAMTEMNGMVCSSRPMRIGPAANKQKVSGAQEKVPSAQGVQSDSDPSNTTIFVGGLDPNVTEDMLKQVFAPYGEVVHVKIPVGKRCGFVQYASRSSSEEALLMLQGTVIGGQNVRLSWGRSPSNKQVQTPQDSNQWGGATANAGYYGYGQGYEAYGYAAQPQDPNMYGYGAYAGYPNYPQQQAAQQPQQQQVKSCLTVNAIRFGGNSYISISNMNCAVVVAHVIHA

SEQ ID NO: 1817 - DNA, 1302 bp, Oryza sativa
  LOC_Os08g09100.1
atggccccgccgccgccgcccccgcaggcgggggtcgccgggggcggcggcgcgccgccgcagtggggcgccatccctcccccggtgccgcaccaacagcagcagtacgcgccgccgccgccgcagatgtggggccaggctcccccgccgccgccgcagatgtggggccaggctcccccgccgccgcagcccgcgtacggccagccgccgccggcccaggcggggtactacggggcgccgccgcaggcggccccggccgtccccgcggggcccaacgaggtcaggacgctctggatcggggatctccagtactggatggatgagaactacatctccgcctgctttgcgcccaccggcgagctacaatctgtgaagctaattcgtgacaagcagactggacaacttcagggttatggctttattgaattcacatcccatgctggtgctgaaagagttcttcaaacatacaatggggcaatgatgccaaatgttgagcagacataccggttgaattgggcctctgctggtgaaaaacgtgatgatacccctgattacacaatttttgttggtgatttggctgctgatgttacagactacatattgcaagagacgttcagggtacattacccatctgtgaagggtgcaaaggttgtgacagataaaatgacaatgcgttcaaagggctatggcttcgtcaaatttggtgatccttccgagcaagcccgtgcaatgacagaaatgaatgggatggtttgttcttcaagacctatgcgtatcggcccagctgcaaataagaaagcaactggagttcaagagaaagtaccgagtgctcaaggagttcagtctgacagtgatcctagcaataccactatatttgttggtggccttgatcccagtgtcactgacgatatgttgaaacaagttttcactccctatggagatgtggtccatgttaagatcccagttggaaaaagatgtggttttgttcaatttgctaacagagcttctgcagatgaagctttggtacttctacaaggtaccttgattggaggacagaatgtgaggctttcatggggccgcagcccttcaaatagacaagctcagcctcaacaggattccaaccagtggggtggtgctaatgctggatactacggttatgggcaaggatatgagggttatgggtatgctcaacctcaggaccctaatatgtacgggtatggagcttatgctggttatcccaactaccaacaacccctagctcagcagccgcagcagcaacaggtgagagctgtgctttttaac

SEQ ID NO: 1818 - protein, 434 aa, Oryza sativa
  LOC_Os08g09100.1
MAPPPPPPQAGVAGGGGAPPQWGAIPPPVPHQQQQYAPPPPQMWGQAPPPPPQMWGQAPPPPQPAYGQPPPAQAGYYGAPPQAAPAVPAGPNEVRTLWIGDLQYWMDENYISACFAPTGELQSVKLIRDKQTGQLQGYGFIEFTSHAGAERVLQTYNGAMMPNVEQTYRLNWASAGEKRDDTPDYTIFVGDLAADVTDYILQETFRVHYPSVKGAKVVTDKMTMRSKGYGFVKFGDPSEQARAMTEMNGMVCSSRPMRIGPAANKKATGVQEKVPSAQGVQSDSDPSNTTIFVGGLDPSVTDDMLKQVFTPYGDVVHVKIPVGKRCGFVQFANRASADEALVLLQGTLIGGQNVRLSWGRSPSNRQAQPQQDSNQWGGANAGYYGYGQGYEGYGYAQPQDPNMYGYGAYAGYPNYQQPLAQQPQQQQVRAVLFN

SEQ ID NO: 1819 - DNA, 1359 bp, Zea mays
  GRMZM2G426591_T01
atgatgccgcagcagcagcagcccggcatggcccctcctcctccacaggccgcccccggagcgccgccacactggggcggcatcccgccgcctatggcccctcagcatcagtacgcgccaccaccgacccatcaggccccgcccccgccgcagatgtggggccaggcgcccccgcccccgcccccgcctcaggccgcgtacggtcaggcgcccccgccgccccaggccgcgtatggccaggcgctcccaccaccccaggccgcgtacggccaggcgcctcccccgccacaggccgcctactacggggcggtacccgcgcccgcggcggtggccgcggcacctgtcgggcccagcgaggtcaggacgctctggatcggggatctgcagtactggatggacgataactacatctacgggtgcttcgcatccacgggggaggtgcaaaatgtgaagctaattcgtgacaagcatactggacaacttcagggctatggttttattgaattcataagccgcgctgctgctgaaagagttcttcagacttacaacgggacaatgatgccaaatgttgagttgccattccggttgaattgggctagtgctggtgaaaaacgtgatgacacccccgactatacaatatttgttggtgatttggctgctgatgttacagactatgtattacaagagacatttagggcacattacccttctgtgaagggtgcaaaagttgtaacagacaagctgacaatgcgcacaaagggttatggttttgtgaagtttggtgatcctaatgagcaagctcgtgcaatgactgagatgaatggcatgctatgttcttctaggcctatgcgtattgggcctgctgcaaacaagaaagctactgttgttcaggagaaagtaccaagtgctcagggagttcagtctgacaatgatcctaacaatacaaccatttttgttggtggtcttgaccccaatgtcactgaagatatgttgaaacaagttttcaccccttatggggacgtagtccatgttaagattcctgttggcaaaagatgtggttttgttcaatatgctaacagatcttcggcagaggaggcattggtaattctgcaaggcaccttggttggagggcagaatgtgaggctttcatggggtcgcagcccttcaaacaaacaagttcaggactccaaccagtgggccggggctaatgctggatattatggctacggtcaaggctatgaggcctatgggtacccccagtctcaggaccctaatatgtataattatggagctggagcttatgctggctatccaaattaccaacaacaaccagtagcacagcaaccgccgcagcaacag

SEQ ID NO: 1820 - protein, 453 aa, Zea mays
  GRMZM2G426591_T01
MMPQQQQPGMAPPPPQAAPGAPPHWGGIPPPMAPQHQYAPPPTHQAPPPPQMWGQAPPPPPPPQAAYGQAPPPPQAAYGQALPPPQAAYGQAPPPPQAAYYGAVPAPAAVAAAPVGPSEVRTLWIGDLQYWMDDNYIYGCFASTGEVQNVKLIRDKHTGQLQGYGFIEFISRAAAERVLQTYNGTMMPNVELPFRLNWASAGEKRDDTPDYTIFVGDLAADVTDYVLQETFRAHYPSVKGAKVVTDKLTMRTKGYGFVKFGDPNEQARAMTEMNGMLCSSRPMRIGPAANKKATVVQEKVPSAQGVQSDNDPNNTTIFVGGLDPNVTEDMLKQVFTPYGDVVHVKIPVGKRCGFVQYANRSSAEEALVILQGTLVGGQNVRLSWGRSPSNKQVQDSNQWAGANAGYYGYGQGYEAYGYPQSQDPNMYNYGAGAYAGYPNYQQQPVAQQPPQQQ

SEQ ID NO: 1821 - DNA, 1368 bp, Zea mays
  GRMZM2G426591_T03
atgatgccgcagcagcagcagcccggcatggcccctcctcctccacaggccgcccccggagcgccgccacactggggcggcatcccgccgcctatggcccctcagcatcagtacgcgccaccaccgacccatcaggccccgcccccgccgcagatgtggggccaggcgcccccgcccccgcccccgcctcaggccgcgtacggtcaggcgcccccgccgccccaggccgcgtatggccaggcgctcccaccaccccaggccgcgtacggccaggcgcctcccccgccacaggccgcctactacggggcggtacccgcgcccgcggcggtggccgcggcacctgtcgggcccagcgaggtcaggacgctctggatcggggatctgcagtactggatggacgataactacatctacgggtgcttcgcatccacgggggaggtgcaaaatgtgaagctaattcgtgacaagcatactggacaacttcagggctatggttttattgaattcataagccgcgctgctgctgaaagagttcttcagacttacaacgggacaatgatgccaaatgttgagttgccattccggttgaattgggctagtgctggtgaaaaacgtgatgacacccccgactatacaatatttgttggtgatttggctgctgatgttacagactatgtattacaagagacatttagggcacattacccttctgtgaagggtgcaaaagttgtaacagacaagctgacaatgcgcacaaagggttatggttttgtgaagtttggtgatcctaatgagcaagctcgtgcaatgactgagatgaatggcatgctatgttcttctaggcctatgcgtattgggcctgctgcaaacaagaaagctactgttgttcaggagaaagtaccaagtgctcagggagttcagtctgacaatgatcctaacaatacaaccatttttgttggtggtcttgaccccaatgtcactgaagatatgttgaaacaagttttcaccccttatggggacgtagtccatgttaagattcctgttggcaaaagatgtggttttgttcaatatgctaacagatcttcggcagaggaggcattggtaattctgcaaggcaccttggttggagggcagaatgtgaggctttcatggggtcgcagcccttcaaacaaacaagttcagcctcaacaggactccaaccagtgggccggggctaatgctggatattatggctacggtcaaggctatgaggcctatgggtacccccagtctcaggaccctaatatgtataattatggagctggagcttatgctggctatccaaattaccaacaacaaccagtagcacagcaaccgccgcagcaacag

SEQ ID NO: 1822 - protein, 456 aa, Zea mays
  GRMZM2G426591_T03
MMPQQQQPGMAPPPPQAAPGAPPHWGGIPPPMAPQHQYAPPPTHQAPPPPQMWGQAPPPPPPPQAAYGQAPPPPQAAYGQALPPPQAAYGQAPPPPQAAYYGAVPAPAAVAAAPVGPSEVRTLWIGDLQYWMDDNYIYGCFASTGEVQNVKLIRDKHTGQLQGYGFIEFISRAAAERVLQTYNGTMMPNVELPFRLNWASAGEKRDDTPDYTIFVGDLAADVTDYVLQETFRAHYPSVKGAKVVTDKLTMRTKGYGFVKFGDPNEQARAMTEMNGMLCSSRPMRIGPAANKKATVVQEKVPSAQGVQSDNDPNNTTIFVGGLDPNVTEDMLKQVFTPYGDVVHVKIPVGKRCGFVQYANRSSAEEALVILQGTLVGGQNVRLSWGRSPSNKQVQPQQDSNQWAGANAGYYGYGQGYEAYGYPQSQDPNMYNYGAGAYAGYPNYQQQPVAQQPPQQQ

SEQ ID NO: 1823 - DNA, 1359 bp, Zea mays
  GRMZM2G426591_T04
atgatgccgcagcagcagcagcccggcatggcccctcctcctccacaggccgcccccggagcgccgccacactggggcggcatcccgccgcctatggcccctcagcatcagtacgcgccgcagatgtggggccaggcgcccccgcccccgcccccgcctcaggccgcgtacggtcaggcgcccccgccgccccaggccgcgtatggccaggcgctcccaccaccccaggccgcgtacggccaggcgcctcccccgccacaggccgcctactacggggcggtacccgcgcccgcggcggtggccgcggcacctgtcgggcccagcgaggtcaggacgctctggatcggggatctgcagtactggatggacgataactacatctacgggtgcttcgcatccacgggggaggtgcaaaatgtgaagctaattcgtgacaagcatactggacaacttcagggctatggttttattgaattcataagccgcgctgctgctgaaagagttcttcagacttacaacgggacaatgatgccaaatgttgagttgccattccggttgaattgggctagtgctggtgaaaaacgtgatgacacccccgactatacaatatttgttggtgatttggctgctgatgttacagactatgtattacaagagacatttagggcacattacccttctgtgaagggtgcaaaagttgtaacagacaagctgacaatgcgcacaaagggttatggttttgtgaagtttggtgatcctaatgagcaagctcgtgcaatgactgagatgaatggcatgctatgttcttctaggcctatgcgtattgggcctgctgcaaacaagaaagctactgttgttcaggagaaagtaccaagtgctcagggagttcagtctgacaatgatcctaacaatacaaccatttttgttggtggtcttgaccccaatgtcactgaagatatgttgaaacaagttttcaccccttatggggacgtagtccatgttaagattcctgttggcaaaagatgtggttttgttcaatatgctaacagatcttcggcagaggaggcattggtaattctgcaaggcaccttggttggagggcagaatgtgaggctttcatggggtcgcagcccttcaaacaaacaagttcagcctcaacaggactccaaccagtgggccggggctaatgctggatattatggctacggtcaaggctatgaggcctatgggtacccccagtctcaggaccctaatatgtataattatggagctggagcttatgctggctatccaaattaccaacaacaaccagtagcacagcaaccgccgcagcaacaggtgagttttttttttggtact

SEQ ID NO: 1824 - protein, 453 aa, Zea mays
  GRMZM2G426591_T04
MMPQQQQPGMAPPPPQAAPGAPPHWGGIPPPMAPQHQYAPQMWGQAPPPPPPPQAAYGQAPPPPQAAYGQALPPPQAAYGQAPPPPQAAYYGAVPAPAAVAAAPVGPSEVRTLWIGDLQYWMDDNYIYGCFASTGEVQNVKLIRDKHTGQLQGYGFIEFISRAAAERVLQTYNGTMMPNVELPFRLNWASAGEKRDDTPDYTIFVGDLAADVTDYVLQETFRAHYPSVKGAKVVTDKLTMRTKGYGFVKFGDPNEQARAMTEMNGMLCSSRPMRIGPAANKKATVVQEKVPSAQGVQSDNDPNNTTIFVGGLDPNVTEDMLKQVFTPYGDVVHVKIPVGKRCGFVQYANRSSAEEALVILQGTLVGGQNVRLSWGRSPSNKQVQPQQDSNQWAGANAGYYGYGQGYEAYGYPQSQDPNMYNYGAGAYAGYPNYQQQPVAQQPPQQQVSFFFGT

SEQ ID NO: 1825 - DNA, 966 bp, Zea mays
  GRMZM2G426591_T02
atgatgccgcagcagcagcagcccggcatggcccctcctcctccacaggccgcccccggagcgccgccacactggggcggcatcccgccgcctatggcccctcagcatcagtacgcgccaccaccgacccatcaggccccgcccccgccgcagatgtggggccaggcgcccccgcccccgcccccgcctcaggccgcgtacggtcaggcgcccccgccgccccaggccgcgtatggccaggcgctcccaccaccccaggccgcgtacggccaggcgcctcccccgccacaggccgcctactacggggcggtacccgcgcccgcggcggtggccgcggcacctgtcgggcccagcgaggtcaggacgctctggatcggggatctgcagtactggatggacgataactacatctacgggtgcttcgcatccacgggggaggtgcaaaatgtgaagctaattcgtgacaagcatactggacaacttcagggctatggttttattgaattcataagccgcgctgctgctgaaagagttcttcagacttacaacgggacaatgatgccaaatgttgagttgccattccggttgaattgggctagtgctggtgaaaaacgtgatgacacccccgactatacaatatttgttggtgatttggctgctgatgttacagactatgtattacaagagacatttagggcacattacccttctgtgaagggtgcaaaagttgtaacagacaagctgacaatgcgcacaaagggttatggttttgtgaagtttggtgatcctaatgagcaagctcgtgcaatgactgagatgaatggcatgctatgttcttctaggcctatgcgtattgggcctgctgcaaacaagaaagctactgttgttcaggagaaaggataccaacaggctcttcatataggacttgagctgcgatgcgtgtcttgtgtaatgcatgacctctgt

SEQ ID NO: 1826 - protein, 322 aa, Zea mays
  GRMZM2G426591_T02
MMPQQQQPGMAPPPPQAAPGAPPHWGGIPPPMAPQHQYAPPPTHQAPPPPQMWGQAPPPPPPPQAAYGQAPPPPQAAYGQALPPPQAAYGQAPPPPQAAYYGAVPAPAAVAAAPVGPSEVRTLWIGDLQYWMDDNYIYGCFASTGEVQNVKLIRDKHTGQLQGYGFIEFISRAAAERVLQTYNGTMMPNVELPFRLNWASAGEKRDDTPDYTIFVGDLAADVTDYVLQETFRAHYPSVKGAKVVTDKLTMRTKGYGFVKFGDPNEQARAMTEMNGMLCSSRPMRIGPAANKKATVVQEKGYQQALHIGLELRCVSCVMHDLC

SEQ ID NO: 1827 - DNA, 1338 bp, Setaria italica
  Si013736m
atgatgccgcagcagcagcccggcgtcgcccctcctcccccgcagtccgccccgggcgcgccgccgcactggggcggcatcccgccgccgatgcccccgcagcaccagtacgcgccgccgccgccgccgcagcaggccccgcccccgccgcagatgtggggccaggcgcccccgccgccgcatcaggcaccgtacggccaggcgcctcccccgccgcaccaggccgcgtacggccaggcgcctcccccgccgcaggccggctactacggggcgccacccgcgccggcccccgtggcggccgcggccgccgggcccaacgaggtcaggacgctctggatcggggacctgcagtactggatggacgagaactacatctacgggtgcttcgcggccacgggggaggtacaatctgtgaagcttatccgtgacaagcatactggacagcttcagggctatggttttgttgaattcatgacccgtgccaccgctgaaaaagttcttcagacttacaatgggacaatgatgcccaatgttgagttgccattccgattgaattgggccagtgctggtgaaaaacgtgatgactcccctgattacacaatttttgttggtgacttggctgctgatgttacggattacatattacaagagacattcagggtgcattatccttcggtcaagggtgcaaaggttgtcacggacaaactaactatgcgtccaaagggttatggctttgtgaaattcggtgatcctaatgagcaagctcgtgcaatgactgaaatgaatgggatgctctgttcttcaagacccatgcgtattggaccagctgctaataagaaagccacaggagttcaagaaaaagtaccaagcgcccagggagttcagtctgacagtgatcctaacaataccactatttttgttggtggccttgaccccaatgtcactgaagatgtgttgaaacaagttttcgccccttatggggaagtggtccatgtcaagatccctgttggcaaaagatgtggttttgttcaatatgctaacagatcttctgccgaggaggcattggtaattctgcaaggtaccttgattggagggcagaatgtgaggctctcttggggtcgcagcccttcaaacaaacaagttcagcctcaacaggatcccaaccagtgggctgctggggctaatgcagcaggatactatggttatgggcaaggctacgaggcctatgggtatcctcaatctcaggaccctaatgcgtttggttatggagctggagcatatgctggctatccaaattaccaacagcaaccagtggcgcagcagccacagcagcaacag

SEQ ID NO: 1828 - protein, 446 aa, Setaria italica
  Si013736m
MMPQQQPGVAPPPPQSAPGAPPHWGGIPPPMPPQHQYAPPPPPQQAPPPPQMWGQAPPPPHQAPYGQAPPPPHQAAYGQAPPPPQAGYYGAPPAPAPVAAAAAGPNEVRTLWIGDLQYWMDENYIYGCFAATGEVQSVKLIRDKHTGQLQGYGFVEFMTRATAEKVLQTYNGTMMPNVELPFRLNWASAGEKRDDSPDYTIFVGDLAADVTDYILQETFRVHYPSVKGAKVVTDKLTMRPKGYGFVKFGDPNEQARAMTEMNGMLCSSRPMRIGPAANKKATGVQEKVPSAQGVQSDSDPNNTTIFVGGLDPNVTEDVLKQVFAPYGEVVHVKIPVGKRCGFVQYANRSSAEEALVILQGTLIGGQNVRLSWGRSPSNKQVQPQQDPNQWAAGANAAGYYGYGQGYEAYGYPQSQDPNAFGYGAGAYAGYPNYQQQPVAQQPQQQQ

SEQ ID NO: 1829 - DNA, 1401 bp, Brachypodium distachyon
  Bradi1g26210.1
atgcagccgccgtaccagccgccgatgaacgggcagcacgcgcccccgcaggctccgccgcagtcctctggtcctccgcctccgcctccgcagcagcaggtccccccgccgcagcagtactaccaggcgccaccgcagtactaccagccgggacctccgccgccgatgtggggccatccgcagcagcatatgcctccgcagtacgcccccccaccgcagcagtacgcgcctccgccccctcaccagtacgggccaccaccgcagcagtacgcgcagccgccgccgcagcagtacggagcgcagatggcgggcgggcccgcgcccggaggcgaggatatcaggtccctgtggattggagatctccagtactggatggatgaggcctacctccataacgcttttgcgcccatggggccgcagcaggttgcctcagtgaaaattatccgcaacaagcaaactggacagccagagggttatggttttattgaatttcactctcgagctgctgcagaatatgccctggcgtcctttaatgggcatgcgatgcctaatgttgatctgccttttaaactaaactgggcttctgctagcgctggtgataggcgtggggatgatggttctgatcacacaatatttgttggtgatttggcttctgatgttactgactccatgctgcaagaaatattcaaagccagctacccttcagttagaggagctaacgttgttaccgacagggcaacaggacgctccaaaggatacggttttgtacgttttggggatgtaaatgagcagacacgtgctatgactgagatgaatggtgtgacattgtcttcaaggcaattgaggattgggcctgcggccaacaagaagaatatgggtactcagcagacatattcgactaatgggtaccagtcccagagctctcaaggaaatgatgttcagaatgatcccaataatactacaatctttgtgggcgggttagattccaatatagatgagaactatctaaggcaagtttttactccatatggcgaagttggttatgtgaagattcctgtaggcaagcgttgtggatttgtccaatttaccagcaggtcatgcgctgaggaagccatcaatgcgctgaacgggaccccgattggcgggaataatgttcgtctttcatggggccgtagtacccaaaacaaacaggctccccagcaggatgcaaaccagggtaatggcagcaattactatggataccaacagggtaatgatgcttactatggtgcacccaatgcgcaagatcctagcatgcaaaactatggatattctggttatggcaattacgagcagcagcagccagcacagcagcagcaaccaccgccttctcagcagcagcagcagcagcccccacagcag

SEQ ID NO: 1830 - protein, 467 aa, Brachypodium distachyon
  Bradi1g26210.1
MQPPYQPPMNGQHAPPQAPPQSSGPPPPPPQQQVPPPQQYYQAPPQYYQPGPPPPMWGHPQQHMPPQYAPPPQQYAPPPPHQYGPPPQQYAQPPPQQYGAQMAGGPAPGGEDIRSLWIGDLQYWMDEAYLHNAFAPMGPQQVASVKIIRNKQTGQPEGYGFIEFHSRAAAEYALASFNGHAMPNVDLPFKLNWASASAGDRRGDDGSDHTIFVGDLASDVTDSMLQEIFKASYPSVRGANVVTDRATGRSKGYGFVRFGDVNEQTRAMTEMNGVTLSSRQLRIGPAANKKNMGTQQTYSTNGYQSQSSQGNDVQNDPNNTTIFVGGLDSNIDENYLRQVFTPYGEVGYVKIPVGKRCGFVQFTSRSCAEEAINALNGTPIGGNNVRLSWGRSTQNKQAPQQDANQGNGSNYYGYQQGNDAYYGAPNAQDPSMQNYGYSGYGNYEQQQPAQQQQPPPSQQQQQQPPQQ

SEQ ID NO: 1831 - DNA, 1026 bp, Brachypodium distachyon
  Bradi1g26210.2
atgcagccgccgtaccagccgccgatgaacgggcagcacgcgcccccgcaggctccgccgcagtcctctggtcctccgcctccgcctccgcagcagcaggtccccccgccgcagcagtactaccaggcgccaccgcagtactaccagccgggacctccgccgccgatgtggggccatccgcagcagcatatgcctccgcagtacgcccccccaccgcagcagtacgcgcctccgccccctcaccagtacgggccaccaccgcagcagtacgcgcagccgccgccgcagcagtacggagcgcagatggcgggcgggcccgcgcccggaggcgaggatatcaggtccctgtggattggagatctccagtactggatggatgaggcctacctccataacgcttttgcgcccatggggccgcagcaggttgcctcagtgaaaattatccgcaacaagcaaactggacagccagagggttatggttttattgaatttcactctcgagctgctgcagaatatgccctggcgtcctttaatgggcatgcgatgcctaatgttgatctgccttttaaactaaactgggcttctgctagcgctggtgataggcgtggggatgatggttctgatcacacaatatttgttggtgatttggcttctgatgttactgactccatgctgcaagaaatattcaaagccagctacccttcagttagaggagctaacgttgttaccgacagggcaacaggacgctccaaaggatacggttttgtacgttttggggatgtaaatgagcagacacgtgctatgactgagatgaatggtgtgacattgtcttcaaggcaattgaggattgggcctgcggccaacaagaagaatatgggtactcagcagacatattcgactaatgggtaccagtcccagagctctcaaggaaatgatgttcagaatgatcccaataatactacagcaagcgttgtggatttgtccaatttaccagcaggtcatgcgctgaggaagccatcaatgcgc

SEQ ID NO: 1832 - protein, 342 aa, Brachypodium distachyon
  Bradi1g26210.2
MQPPYQPPMNGQHAPPQAPPQSSGPPPPPPQQQVPPPQQYYQAPPQYYQPGPPPPMWGHPQQHMPPQYAPPPQQYAPPPPHQYGPPPQQYAQPPPQQYGAQMAGGPAPGGEDIRSLWIGDLQYWMDEAYLHNAFAPMGPQQVASVKIIRNKQTGQPEGYGFIEFHSRAAAEYALASFNGHAMPNVDLPFKLNWASASAGDRRGDDGSDHTIFVGDLASDVTDSMLQEIFKASYPSVRGANVVTDRATGRSKGYGFVRFGDVNEQTRAMTEMNGVTLSSRQLRIGPAANKKNMGTQQTYSTNGYQSQSSQGNDVQNDPNNTTASVVDLSNLPAGHALRKPSMR

SEQ ID NO: 1833 - DNA, 1467 bp, Oryza sativa
  LOC_Os07g33330.1
atgcagcagcctcccccgccgacgatgaacggcggccaccacgcggcccctcctccgccgcaggtctccggggcgcccccgccgccgcatggccactaccagcagcagccgccgcctcagccgtactgccagcagcagcagccgctgccgccgcactactaccaggcggggcccccgcacgcgcctccgccgcagcagccgccggcgatgtggggccagccgccgccgccgccgccgcagtacgcgccacctccgccccagcagttccagctcccgcaccagcagtacgcacctccccctcagcattacgcgccgccgccgccgcagcagcagtacggggcgcagatggctggcgggcccgctccgggaggcgacgagatcaggtcgctgtggatcggggatctccagtactggatggatgagagctacctctccaacgcttttgcccccatgggacagcaggttacctctgtgaaagtcatccgcaacaagcagagtgggcactctgagggttatggttttattgaatttcagtctcacgctgctgcagaatatgctctggctaactttaatgggaggatgatgcttaatgttgaccaacttttcaagctaaactgggcttctagtggtgctggtgaaaggcgtgctgctgatgatggtcctgagcacacaatatttgttggtgatttagcttctgatgttacagactccatgttggaagaagcattcaaaaccagttatccttcagttagaggagccaaagttgtttttgacaaagtcactgggcgatccaagggatatggttttgtacgttttggagatgaaaatgagcaaacacgtgctatgactgagatgaatggagcgaccttgtctacaaggcaaatgaggcttgggccggcagctaacaagaagaatatgggtacccagcagacatattcaacaaatggttaccagagctcccaaggaaacagtttggagaatgatcccaataatacaacaatctttgtgggcgggttagattccaatgtaaatgaggaccatctaaagcaagtatttactccatatggggaaattggttatgtgaagattcctctaggcaagcgttgtggatttgtccaatttactagcaggtcatctgctgaagaagccatccgtgtgctgaatgggtctcagattggtgggcagcaagttcggctttcatggggccgtactcctcagaacaagcaggctccccagcaggatgccaaccagtggaatggcaactactatggataccaacagggctatgattcttcttactatggtgcacccaatgcacaggatcctagtgcgcaaaactactatggatattctggctatggcaattacgaacagcagcaggagcccccacagcagcagcagcaacccccacaacagcccccacagcagccacaagataacaagttcagtacatcatttatcacacga

SEQ ID NO: 1834 - protein, 489 aa, Oryza sativa
  LOC_Os07g33330.1
MQQPPPPTMNGGHHAAPPPPQVSGAPPPPHGHYQQQPPPQPYCQQQQPLPPHYYQAGPPHAPPPQQPPAMWGQPPPPPPQYAPPPPQQFQLPHQQYAPPPQHYAPPPPQQQYGAQMAGGPAPGGDEIRSLWIGDLQYWMDESYLSNAFAPMGQQVTSVKVIRNKQSGHSEGYGFIEFQSHAAAEYALANFNGRMMLNVDQLFKLNWASSGAGERRAADDGPEHTIFVGDLASDVTDSMLEEAFKTSYPSVRGAKVVFDKVTGRSKGYGFVRFGDENEQTRAMTEMNGATLSTRQMRLGPAANKKNMGTQQTYSTNGYQSSQGNSLENDPNNTTIFVGGLDSNVNEDHLKQVFTPYGEIGYVKIPLGKRCGFVQFTSRSSAEEAIRVLNGSQIGGQQVRLSWGRTPQNKQAPQQDANQWNGNYYGYQQGYDSSYYGAPNAQDPSAQNYYGYSGYGNYEQQQEPPQQQQQPPQQPPQQPQDNKFSTSFITR

SEQ ID NO: 1835 - DNA, 1449 bp, Zea mays
  GRMZM2G079954_T01
atggaagggacggcggcggaggtgggcgacgctgacgcggccggggatgtgcagattaagggtgccaaggagaatgcgcagcccatggcggtagcgcagcagcagctgtccggcagcgaggcgctggagaaggagaacattaaaaacctatatgaaagcgaacccaccctagggttcctgtgcctcgccagtgaagcgatgcagccgccgcaccaaccgtcgatgaacgggcaacacgcccagcctcagccgcaaggacctggggtgcccatgcctccgcagcagcaggcgcccccgctgccgtactaccagcagcatccgccaccgcagtactaccaacaggccctcttgcagccgtgggggcagcagcagcagtatgctgcaccgccgctgcagtacccgcctccgcctcagacgcagcagtacgcgacaccaccgcagcagtacgcccctttaccgcagcagcagtatgctcctccaccgcagcagcagtatgctccttcaccatatgggaccacaccgggaagcggtgaagtcaggacgctgtggatcggagatcttcagcactggatggacgagaactacctccactacaacgcctttgcggccgtggcccagcagattgcttctgtgaaaattatacggaacaagcagactgggcactcagaaggctatggttttattgagttttcctctcgagctactgcagaacatactctgatgaacttcaatgggcagatgatgccgaatgttgagatgacttttaagttgaactgggcttctgctagcactggtgataagcgtggagatagtggttctgatcacacaatatttgttggtgatttggctcatgatgttactgactccatgttggaagatgtgtttagagctaagtacccttcagttagacgagctaatgttgttgttgataggatgactggatggcccaaaggatatggtttcgtacgttttggagatctgaatgagcaggcacatgctatgactgagatgaatggaatgttgttatctacaaggcaaatgaggattggtgctacagctaacaagaagaatagggatgctcagcagacatatgcaactgacgacacaattaaggcaataaggcctactggagtttctgcattctcaagggttcatgggcattctaggctcccagcaatggaatctacaaggggaaagggtaaacctaaatcaaaatcaaaaccaaaggatacaggttcatggtttgatggcagcagaaaagccatgatccaactagctggagaacttttctggaaaatgggtgaagtcctggatagcatcgcaaaagatcatacaacttctcttgatgcttttattacacagctgcccatgcaacaacacgtcaatttgaagttccttctcttccgccttgacttcactgaatattatggccatgtttcctccaacaac

SEQ ID NO: 1836 - protein, 483 aa, Zea mays
  GRMZM2G079954_T01
MEGTAAEVGDADAAGDVQIKGAKENAQPMAVAQQQLSGSEALEKENIKNLYESEPTLGFLCLASEAMQPPHQPSMNGQHAQPQPQGPGVPMPPQQQAPPLPYYQQHPPPQYYQQALLQPWGQQQQYAAPPLQYPPPPQTQQYATPPQQYAPLPQQQYAPPPQQQYAPSPYGTTPGSGEVRTLWIGDLQHWMDENYLHYNAFAAVAQQIASVKIIRNKQTGHSEGYGFIEFSSRATAEHTLMNFNGQMMPNVEMTFKLNWASASTGDKRGDSGSDHTIFVGDLAHDVTDSMLEDVFRAKYPSVRRANVVVDRMTGWPKGYGFVRFGDLNEQAHAMTEMNGMLLSTRQMRIGATANKKNRDAQQTYATDDTIKAIRPTGVSAFSRVHGHSRLPAMESTRGKGKPKSKSKPKDTGSWFDGSRKAMIQLAGELFWKMGEVLDSIAKDHTTSLDAFITQLPMQQHVNLKFLLFRLDFTEYYGHVSSNN

SEQ ID NO: 1837 - DNA, 924 bp, Zea mays
  GRMZM2G127510_T03
atgcagccgccgcaccaaccgccgatgaacgggcaacactcccagcctccgccgcaaggacccgtggtgcccatgcctccgcagcagcaggcgcccccgctgccgtactaccagcagcagcaggcgccgcagtactaccaacaggccctcccgcagccgtgggggcagcagcagcagtacgctgcaccgccgccgcagtacccgcctccgcctcagacgcagcattacgcgacaccaccgcagcagtacgcccctctgccgcagcagcagtacgctcctccaccgcagcagcagtacgctccttcgccatatggtaccacgccgggaagcggtgaagtcaggacgctgtggatcggagatcttcagcactggatggacgagaactacctccactacaacgcctttgcggccgtggcccagcagattgcttctgtgaaaattatacggaacaagcaaactgggcactcagaaggctatggttttattgagttttactctcgagctgctgcagaacatactctgatgaacttcaatgggcagatgatgccgaatgttgagatgacttttaagctgaactgggcttctgctagcactggtgataagcgtggagatagtggttctgatcgcacaatatttgttggtgatttggctcatgatgttactgactccatgttggaagatgtgttcagagctaagtacccttcagttagaggagctaatgttgttgttgataggatgactggatggcccaaaggatttggtttcgtgcgttttggagatctgaatgagcaggcacgtgctatgactgagatgaatggaatgttgttatctacaaggcaaatgaggattggtgctgcagctaacaagaagaatagggatgctcagcagacatatgcaactgacggatgtcatgccatctgcatt

SEQ ID NO: 1838 - protein, 308 aa, Zea mays
  GRMZM2G127510_T03
MQPPHQPPMNGQHSQPPPQGPVVPMPPQQQAPPLPYYQQQQAPQYYQQALPQPWGQQQQYAAPPPQYPPPPQTQHYATPPQQYAPLPQQQYAPPPQQQYAPSPYGTTPGSGEVRTLWIGDLQHWMDENYLHYNAFAAVAQQIASVKIIRNKQTGHSEGYGFIEFYSRAAAEHTLMNFNGQMMPNVEMTFKLNWASASTGDKRGDSGSDRTIFVGDLAHDVTDSMLEDVFRAKYPSVRGANVVVDRMTGWPKGFGFVRFGDLNEQARAMTEMNGMLLSTRQMRIGAAANKKNRDAQQTYATDGCHAICI

SEQ ID NO: 1839 - DNA, 1452 bp, Zea mays
  GRMZM2G127510_T02
atgcagccgccgcaccaaccgccgatgaacgggcaacactcccagcctccgccgcaaggacccgtggtgcccatgcctccgcagcagcaggcgcccccgctgccgtactaccagcagcagcaggcgccgcagtactaccaacaggccctcccgcagccgtgggggcagcagcagcagtacgctgcaccgccgccgcagtacccgcctccgcctcagacgcagcattacgcgacaccaccgcagcagtacgcccctctgccgcagcagcagtacgctcctccaccgcagcagcagtacgctccttcgccatatggtaccacgccgggaagcggtgaagtcaggacgctgtggatcggagatcttcagcactggatggacgagaactacctccactacaacgcctttgcggccgtggcccagcagattgcttctgtgaaaattatacggaacaagcaaactgggcactcagaaggctatggttttattgagttttactctcgagctgctgcagaacatactctgatgaacttcaatgggcagatgatgccgaatgttgagatgacttttaagctgaactgggcttctgctagcactggtgataagcgtggagatagtggttctgatcgcacaatatttgttggtgatttggctcatgatgttactgactccatgttggaagatgtgttcagagctaagtacccttcagttagaggagctaatgttgttgttgataggatgactggatggcccaaaggatttggtttcgtgcgttttggagatctgaatgagcaggcacgtgctatgactgagatgaatggaatgttgttatctacaaggcaaatgaggattggtgctgcagctaacaagaagaatagggatgctcagcagacatatgcaactgacggagcataccagagctctaaaggaaattcttcagagaatgatcctaacaatacaacagtctttgtaggtgggttagattccaatgtaaatgaggagtatctaaggcaaatttttactccgtatggagaaatttcctatgtgaagattcctgtaggcaaacattgtggatttgttcaatttaccagcaggtcatgtgcagaggaagccatccgaatgctgaatgggagtcaggttggtgggcagaaagttcggctttcatggggccgtagtcctcaaaacagacaggcttctcagcatgatgccaacaaccagtataatgggaacagctattatggataccaacagccgggttatgaaggttatggctatggtgcttccagtgcacaagacccaagcatgcaaaactactacggatactctggttgtggtaactatgagcagcagcagccaacacaggaacagcagctgcagcagcctccaccaccacagcacgtagggcacggacaatccccattgcttaaatcttactatctttccatagttcaaatt

SEQ ID NO: 1840 - protein, 484 aa, Zea mays
  GRMZM2G127510_T02
MQPPHQPPMNGQHSQPPPQGPVVPMPPQQQAPPLPYYQQQQAPQYYQQALPQPWGQQQQYAAPPPQYPPPPQTQHYATPPQQYAPLPQQQYAPPPQQQYAPSPYGTTPGSGEVRTLWIGDLQHWMDENYLHYNAFAAVAQQIASVKIIRNKQTGHSEGYGFIEFYSRAAAEHTLMNFNGQMMPNVEMTFKLNWASASTGDKRGDSGSDRTIFVGDLAHDVTDSMLEDVFRAKYPSVRGANVVVDRMTGWPKGFGFVRFGDLNEQARAMTEMNGMLLSTRQMRIGAAANKKNRDAQQTYATDGAYQSSKGNSSENDPNNTTVFVGGLDSNVNEEYLRQIFTPYGEISYVKIPVGKHCGFVQFTSRSCAEEAIRMLNGSQVGGQKVRLSWGRSPQNRQASQHDANNQYNGNSYYGYQQPGYEGYGYGASSAQDPSMQNYYGYSGCGNYEQQQPTQEQQLQQPPPPQHVGHGQSPLLKSYYLSIVQI

SEQ ID NO: 1841 - DNA, 1395 bp, Zea mays
  GRMZM2G127510_T01
atgcagccgccgcaccaaccgccgatgaacgggcaacactcccagcctccgccgcaaggacccgtggtgcccatgcctccgcagcagcaggcgcccccgctgccgtactaccagcagcagcaggcgccgcagtactaccaacaggccctcccgcagccgtgggggcagcagcagcagtacgctgcaccgccgccgcagtacccgcctccgcctcagacgcagcattacgcgacaccaccgcagcagtacgcccctctgccgcagcagcagtacgctcctccaccgcagcagcagtacgctccttcgccatatggtaccacgccgggaagcggtgaagtcaggacgctgtggatcggagatcttcagcactggatggacgagaactacctccactacaacgcctttgcggccgtggcccagcagattgcttctgtgaaaattatacggaacaagcaaactgggcactcagaaggctatggttttattgagttttactctcgagctgctgcagaacatactctgatgaacttcaatgggcagatgatgccgaatgttgagatgacttttaagctgaactgggcttctgctagcactggtgataagcgtggagatagtggttctgatcgcacaatatttgttggtgatttggctcatgatgttactgactccatgttggaagatgtgttcagagctaagtacccttcagttagaggagctaatgttgttgttgataggatgactggatggcccaaaggatttggtttcgtgcgttttggagatctgaatgagcaggcacgtgctatgactgagatgaatggaatgttgttatctacaaggcaaatgaggattggtgctgcagctaacaagaagaatagggatgctcagcagacatatgcaactgacggagcataccagagctctaaaggaaattcttcagagaatgatcctaacaatacaacagtctttgtaggtgggttagattccaatgtaaatgaggagtatctaaggcaaatttttactccgtatggagaaatttcctatgtgaagattcctgtaggcaaacattgtggatttgttcaatttaccagcaggtcatgtgcagaggaagccatccgaatgctgaatgggagtcaggttggtgggcagaaagttcggctttcatggggccgtagtcctcaaaacagacaggcttctcagcatgatgccaacaaccagtataatgggaacagctattatggataccaacagccgggttatgaaggttatggctatggtgcttccagtgcacaagacccaagcatgcaaaactactacggatactctggttgtggtaactatgagcagcagcagccaacacaggaacagcagctgcagcagcctccaccaccacagcac

SEQ ID NO: 1842 - protein, 465 aa, Zea mays
  GRMZM2G127510_T01
MQPPHQPPMNGQHSQPPPQGPVVPMPPQQQAPPLPYYQQQQAPQYYQQALPQPWGQQQQYAAPPPQYPPPPQTQHYATPPQQYAPLPQQQYAPPPQQQYAPSPYGTTPGSGEVRTLWIGDLQHWMDENYLHYNAFAAVAQQIASVKIIRNKQTGHSEGYGFIEFYSRAAAEHTLMNFNGQMMPNVEMTFKLNWASASTGDKRGDSGSDRTIFVGDLAHDVTDSMLEDVFRAKYPSVRGANVVVDRMTGWPKGFGFVRFGDLNEQARAMTEMNGMLLSTRQMRIGAAANKKNRDAQQTYATDGAYQSSKGNSSENDPNNTTVFVGGLDSNVNEEYLRQIFTPYGEISYVKIPVGKHCGFVQFTSRSCAEEAIRMLNGSQVGGQKVRLSWGRSPQNRQASQHDANNQYNGNSYYGYQQPGYEGYGYGASSAQDPSMQNYYGYSGCGNYEQQQPTQEQQLQQPPPPQH

SEQ ID NO: 1843 - DNA, 1509 bp, Zea mays
  GRMZM2G169615_T01
atgcagccgctgcaccaaccgccgatgaacgggcaacacggcccgcctcctccgcagggatccggggttcccacggcttcgcagcagcaggcgccaccgccgtcgtactaccagcagcagcagcagcagcagcaggggccaccgcctcagtactaccagcagggtcccccacagccgtgggcgcagcagcaacagtacgctccaccgccgccgcagtacccgcctcagatgcagcagtacgctccaccaccgcagcagtacgcccctccgccgcagcagcagtacgccgctccgccgcagcagcagtacgccgctccgccgccgcagtacgcgcctccgccgccgcagtacgcgcctccgccgcagcagtacgcgcagccgccgcagtacgcgcagccaccgcagtatgggacaacgccgggaagcggtgaggtcaggaccctgtggattggagatcttcagtactggatggacgagaactatctccactacaacgccttcgcgcctgtggcccagcagattgcctctgtgaaaattatacggaacaagcagactgggcactcagaaggttatggttttattgagttttactctcaagccgctgcagaacatactctgatgaacttcaatgggcagatgatgccgaatattgagatggcttttaagctgaattgggcttctgctagcactggggataagcgtggagataatggttctgaccatgcaatatttgttggtgatttggcccctgatgttacggactccatgttggaagatgtgttcagagctaactatccttcagttagaggagctaaagttgttgttgataggatcactggacggcctaaaggatatgggttcgtgcattttggagatctgaatgagcaggcacgtgctatgaccgagatgaatggaatgatgttatctacaaggaaaatgaggattggggctgcagctagcaagaagaatacagatgctcagcagacatatgcaactaatggtgcataccagagttctcaaggcaattgttcagagaatgatcccaacaatacaacagtctttgtgggtgggttagattccaatgtagacgaggagtatctaaggcaaatttttactccgtacggagaaatttcctatgtgaagattcctgtaggcaagcattgtggatttgttcaatttaccagcaggtcatgtgctgaggaagccatccaaatgctgaatgggagtcagattggtggacagaaagctcggctttcatggggccgtagtactcaaaacagacaggcttctcagcatgatgccaacagccagtataatgggaacaactattatcgataccaacagccgggtaatgaaggttatagctatggtgcacccaatgcacaagacccaagcattcaaaactactatggataccctggttatggtaactatgagcagcagtcaacacaggaacagcagcagcagcagcctccaccagcacaggagcagcctccaccggcaccacag

SEQ ID NO: 1844 - protein, 503 aa, Zea mays
  GRMZM2G169615_T01
MQPLHQPPMNGQHGPPPPQGSGVPTASQQQAPPPSYYQQQQQQQQGPPPQYYQQGPPQPWAQQQQYAPPPPQYPPQMQQYAPPPQQYAPPPQQQYAAPPQQQYAAPPPQYAPPPPQYAPPPQQYAQPPQYAQPPQYGTTPGSGEVRTLWIGDLQYWMDENYLHYNAFAPVAQQIASVKIIRNKQTGHSEGYGFIEFYSQAAAEHTLMNFNGQMMPNIEMAFKLNWASASTGDKRGDNGSDHAIFVGDLAPDVTDSMLEDVFRANYPSVRGAKVVVDRITGRPKGYGFVHFGDLNEQARAMTEMNGMMLSTRKMRIGAAASKKNTDAQQTYATNGAYQSSQGNCSENDPNNTTVFVGGLDSNVDEEYLRQIFTPYGEISYVKIPVGKHCGFVQFTSRSCAEEAIQMLNGSQIGGQKARLSWGRSTQNRQASQHDANSQYNGNNYYRYQQPGNEGYSYGAPNAQDPSIQNYYGYPGYGNYEQQSTQEQQQQQPPPAQEQPPPAPQ

SEQ ID NO: 1845 - DNA, 1416 bp, Zea mays
  GRMZM2G169615_T02
atgcagccgctgcaccaaccgccgatgaacgggcaacacggcccgcctcctccgcagggatccggggttcccacggcttcgcagcagcaggcgccaccgccgtcgtactaccagcagcagcagcagcagcagcaggggccaccgcctcagtactaccagcagggtcccccacagccgtgggcgcagcagcaacagtacgctccaccgccgccgcagtacccgcctcagatgcagcagtacgctccaccaccgcagtacgcgcctccgccgcagcagtacgcgcagccgccgcagtacgcgcagccaccgcagtatgggacaacgccgggaagcggtgaggtcaggaccctgtggattggagatcttcagtactggatggacgagaactatctccactacaacgccttcgcgcctgtggcccagcagattgcctctgtgaaaattatacggaacaagcagactgggcactcagaaggttatggttttattgagttttactctcaagccgctgcagaacatactctgatgaacttcaatgggcagatgatgccgaatattgagatggcttttaagctgaattgggcttctgctagcactggggataagcgtggagataatggttctgaccatgcaatatttgttggtgatttggcccctgatgttacggactccatgttggaagatgtgttcagagctaactatccttcagttagaggagctaaagttgttgttgataggatcactggacggcctaaaggatatgggttcgtgcattttggagatctgaatgagcaggcacgtgctatgaccgagatgaatggaatgatgttatctacaaggaaaatgaggattggggctgcagctagcaagaagaatacagatgctcagcagacatatgcaactaatggtgcataccagagttctcaaggcaattgttcagagaatgatcccaacaatacaacagtctttgtgggtgggttagattccaatgtagacgaggagtatctaaggcaaatttttactccgtacggagaaatttcctatgtgaagattcctgtaggcaagcattgtggatttgttcaatttaccagcaggtcatgtgctgaggaagccatccaaatgctgaatgggagtcagattggtggacagaaagctcggctttcatggggccgtagtactcaaaacagacaggcttctcagcatgatgccaacagccagtataatgggaacaactattatcgataccaacagccgggtaatgaaggttatagctatggtgcacccaatgcacaagacccaagcattcaaaactactatggataccctggttatggtaactatgagcagcagtcaacacaggaacagcagcagcagcagcctccaccagcacaggagcagcctccaccggcaccacag

SEQ ID NO: 1846 - protein, 472 aa, Zea mays
  GRMZM2G169615_T02
MQPLHQPPMNGQHGPPPPQGSGVPTASQQQAPPPSYYQQQQQQQQGPPPQYYQQGPPQPWAQQQQYAPPPPQYPPQMQQYAPPPQYAPPPQQYAQPPQYAQPPQYGTTPGSGEVRTLWIGDLQYWMDENYLHYNAFAPVAQQIASVKIIRNKQTGHSEGYGFIEFYSQAAAEHTLMNFNGQMMPNIEMAFKLNWASASTGDKRGDNGSDHAIFVGDLAPDVTDSMLEDVFRANYPSVRGAKVVVDRITGRPKGYGFVHFGDLNEQARAMTEMNGMMLSTRKMRIGAAASKKNTDAQQTYATNGAYQSSQGNCSENDPNNTTVFVGGLDSNVDEEYLRQIFTPYGEISYVKIPVGKHCGFVQFTSRSCAEEAIQMLNGSQIGGQKARLSWGRSTQNRQASQHDANSQYNGNNYYRYQQPGNEGYSYGAPNAQDPSIQNYYGYPGYGNYEQQSTQEQQQQQPPPAQEQPPPAPQ

SEQ ID NO: 1847 - DNA, 1650 bp, Setaria italica
  Si029414m
atgatttcccttaaaaagatcaggctccgttccaaattcgagctcaaactaagcaggatccaagcaaaaggtaggacctcgaccttcaccctcatccgcatcccttcctctcgctctcgcgtgcgcaccctagggtttctccgccttgccggggacgcgatgcagccgccgcaccagccgccgatgaacgggcagcagggcgcgcccccgccacagggctctggggcgccggcgccgcctccgcagcagcaggcgccaccgccgccgtactaccagcagcagcagccgccgcagtactaccagcaggggccgcccccgcagccgtggggccagccgcagcagtatcctccgccgccgcagcagtacgctcccccgccgcagcagtacgcgcccccgccccagcagtacgctccgccgccaccccaacagtacgctcctccgccgcagcagtacgcgcctccgccacagcagtacgcgccgccgccacagtacgggaccgcgccgggaagtggcgagatcaggtctctttggatcggagatctccagtactggatggacgagagctaccttaactatcacgccttcgcgcccgtggcgccacagattgccaatgtgaaaattataaggaacaaacagaatgggcagtctgaaggttatggttttattgagtttcacacccgagctgctgcagaatatactctgatgaacttcaatgggcggatgatgccgaatgttgacatggcttttaagctaaactgggcatccgctagcgctggggataagcgtggggacaatggttctgatcacacaatatttgttggtgatttggctgctgatgttaccgattccatgttggaagaggtgttcagagctagctacccttcagttaggggggccaaagttgttattgacaagcccactggacgccccaaaggatatggtttcgtgcgctttggagatttgaatgagcaggcacgtgctatgactgagatgaatggaatgatgttatctacaaggcagatgaggattggacctgcagctaacaagaagaatatggatgcccagcagacatatgcaactaatggagcataccagagctctcaaggaaatctttcggagaatgatcccaacaatacaacagtctttgtgggtgggttagattccaatgtaaatgaggagtatctaaggcaaacttttactccttatggagaaattgcctatgtgaagattcctgtaggcaagcgttgtggatttgttcaatttaccagcaggtcatctgctgaggaagcaatccgtatgctcaatgggagcctgattggtgggcagaatgttcggctttcttggggtcgtagtcctcaaaacaaacaggctccccagcaagatgccaacagccagtataatggaaacaactactatggataccaacagcaaggttatgaaggttatggctacagtgcacccaatgcacaagactcaagcgtgcaaaactactatggataccctggttatggcaactatgagcagcaacaacagcaggtggcagcacctcagcagcagccaccgccagcacaaccagcacaggaggagcagcagcagcagcctccaccaccacaacagcagcagccacagccgcagcaacccctgcagcag

SEQ ID NO: 1848 - protein, 550 aa, Setaria italica
  Si029414m
MISLKKIRLRSKFELKLSRIQAKGRTSTFTLIRIPSSRSRVRTLGFLRLAGDAMQPPHQPPMNGQQGAPPPQGSGAPAPPPQQQAPPPPYYQQQQPPQYYQQGPPPQPWGQPQQYPPPPQQYAPPPQQYAPPPQQYAPPPPQQYAPPPQQYAPPPQQYAPPPQYGTAPGSGEIRSLWIGDLQYWMDESYLNYHAFAPVAPQIANVKIIRNKQNGQSEGYGFIEFHTRAAAEYTLMNFNGRMMPNVDMAFKLNWASASAGDKRGDNGSDHTIFVGDLAADVTDSMLEEVFRASYPSVRGAKVVIDKPTGRPKGYGFVRFGDLNEQARAMTEMNGMMLSTRQMRIGPAANKKNMDAQQTYATNGAYQSSQGNLSENDPNNTTVFVGGLDSNVNEEYLRQTFTPYGEIAYVKIPVGKRCGFVQFTSRSSAEEAIRMLNGSLIGGQNVRLSWGRSPQNKQAPQQDANSQYNGNNYYGYQQQGYEGYGYSAPNAQDSSVQNYYGYPGYGNYEQQQQQVAAPQQQPPPAQPAQEEQQQQPPPPQQQQPQPQQPLQQ

SEQ ID NO: 1849 - DNA, 1110 bp, Brachypodium distachyon
  Bradi1g59700.1
atggcgactcccaagaactgggccatggcgccgccctaccactaccacggcccggagccacagccacagtcacagcagcaggaggaggaggcagcgccggccgccgagggcgaaggcggcggagtggccgggtccggggaacaacagccgaggtcactcaggatcggcggccttctcgactggatgaacgaggaatacctccgcagctgcttcacccgctcgcccgagcttctgtcagcagtggtaaagcggaacaaggagaccggaaaatctgagtgttttggttatcttaacttcgccgaccatgctactgctgatcaaatccttcagagctacaacggccagaagatgcctaatgccgacagagatttcaggctcagctgggtcactaattatcctgttcagaagcgtgatgacgacggtcataacatatatgttggagatttggcctttgatgtgactgacttcatgctgcaccatgtgttcaagagtcgctatccatcagttaagcatgcaaaaattgcatgggatcatttcaatggccgctcaaagggctatgggtttgttgtgtttggagatgtcaatgaacgcagacaagcaatgactgaaatgaatggagcatactgttctactaggcctatgcgtgtcggacctgctaccaaaatggccggtccttatacacattggacagtggcagggaaatattctgattctgattcaaacaatacaagactatttgttggtggtcttgatcgaattgtgactgatgaggatctaaagaaagcctttagtccgtatggagaacttactgaggtcaaggtaatagcggggaagaaatgcggcttcgtgacatatttgaacagggcatcagctgaggaggctatgagaattctaaatggaagccttctgggagataataccataaggattagctggggccgttccctttaccacaagcagaaacatgatcagaatcaatggaatggtgagcgccaaggctctggacctggttatcgttcgcatcctgaggatcctaagatgcatggttacacaggccatccagaatatccacattacccacagcagcaagcacaggagacctcagtacag

SEQ ID NO: 1850 - protein, 370 aa, Brachypodium distachyon
  Bradi1g59700.1
MATPKNWAMAPPYHYHGPEPQPQSQQQEEEAAPAAEGEGGGVAGSGEQQPRSLRIGGLLDWMNEEYLRSCFTRSPELLSAVVKRNKETGKSECFGYLNFADHATADQILQSYNGQKMPNADRDFRLSWVTNYPVQKRDDDGHNIYVGDLAFDVTDFMLHHVFKSRYPSVKHAKIAWDHFNGRSKGYGFVVFGDVNERRQAMTEMNGAYCSTRPMRVGPATKMAGPYTHWTVAGKYSDSDSNNTRLFVGGLDRIVTDEDLKKAFSPYGELTEVKVIAGKKCGFVTYLNRASAEEAMRILNGSLLGDNTIRISWGRSLYHKQKHDQNQWNGERQGSGPGYRSHPEDPKMHGYTGHPEYPHYPQQQAQETSVQ

SEQ ID NO: 1851 - DNA, 981 bp, Setaria italica
  Si020700m
atgaacgaggactacctctacgcctgcttcacctactcgcccgagctcctttcccttgtcgtaaagcggagcaagcatactggccagtcggagggttttggctttctcagatttaacgaccatgctactgccactcgcattctcaagagctacaatggtcagaagatgcctaacgctgatcaagatttcaacctcaactgggccgctcagtcatatgctcctaacaaacttcctgatcaagattccaagctcgactgggccacgcagcaggatgggcacactaatgacactgctgctgcttctgagcatgtcatatttgttggggacttggcctatgatgttactgaatacatgctacaccatctgttcaagagtcgatatccatcggtcaagagtgcaaaagttatctttgacaagcttactggccgctcaaaaggctatggctttgttcgctttggagatgccaatgagcacgtacaagcaatgacagaaatgaatggggcatactgttctaccaggcctatgcgaattgggcctgctcccaacaagaaatattttgaccacagcacacaaggaactgattcttatcacgatccaaacaattcaagactgtttgttgggtcccttgatcaaagcatcacagatgatgatctactgcgggcctttagtccatacggagagcttgttaatgtcagagtactaccgggcaaggcatgcggctttgtcacatactcaaacagggcatcagcagaggaggccatgagaatgctaaatgggagtcagctgggaggtaacaacttgagactcacatggggtcgtcgttctggtaacaagcaggatccgcgaaatggtggccagcatggacgccccaaatgcattgatccttctagcttcggttggtctccacaggatccatatgcttatgctcagacaggccatccaggatatggatattaccgacatcagctgcccacagtacag

SEQ ID NO: 1852 - protein, 327 aa, Setaria italica
  Si020700m
MNEDYLYACFTYSPELLSLVVKRSKHTGQSEGFGFLRFNDHATATRILKSYNGQKMPNADQDFNLNWAAQSYAPNKLPDQDSKLDWATQQDGHTNDTAAASEHVIFVGDLAYDVTEYMLHHLFKSRYPSVKSAKVIFDKLTGRSKGYGFVRFGDANEHVQAMTEMNGAYCSTRPMRIGPAPNKKYFDHSTQGTDSYHDPNNSRLFVGSLDQSITDDDLLRAFSPYGELVNVRVLPGKACGFVTYSNRASAEEAMRMLNGSQLGGNNLRLTWGRRSGNKQDPRNGGQHGRPKCIDPSSFGWSPQDPYAYAQTGHPGYGYYRHQLPTVQ

SEQ ID NO: 1853 - DNA, 1218 bp, Oryza sativa
  LOC_Os03g37270.1
atgatgcagccgccgccgccgccgcagtgggcaatggggccgccgcctcctccgcagtacttccaggctggccctccgccgccgccgccacagtacttccagggggcgcatccacccgctgccatgtggggccagcccccgccgccgcaggctgcccctccgccggcgccggctggtggcgcagcaggggacgaggtgaggaccctgtggatcggcgacctccagttctggatggaagagaactacctgtacaactgcttctcccaggccggcgagcttatctcagcaaagataattcggaacaagcaaactgggcaacctgagggttatggtttcattgaatttggcagccatgctatagccgaacaagttctgcaaggctataatggtcaaatgatgcctaatggtaatcaggttttcaaattaaattgggcgacaagtggtgctggcgagaagcgtggagatgatggctcagattatactatatttgttggggatctcgcctcggatgttacagatttaattcttcaagatacattcaaggcccattaccaatcagttaagggtgcaaaagttgtctttgacagaagtactggtcgttcaaaaggctatggatttgttaagtttggagatttggatgaacagacacgtgcaatgactgaaatgaatggacaatattgttctagcaggcctatgcgtattggaccagcatccaacaagaaaaatataggtggccaacaacaaccaagtgctacataccagaatacacaaggaacagattctgatagcgatccaaacaatactactgtatttgttggtggtcttgatccaagtgtgactgatgaggttctgaaacaagccttcagtccatatggagaacttgtctacgtcaaaatacctgtaggaaagcgttgtggatttgttcaatattccaatagggcttcagctgaggaggccataaggatgctaaatggaagccaattaggaggtcagagcataaggctttcatggggtcgtagccctggaaacaagcagcctcagcaagaccagaaccaatggaatgctggctattatggatatcccccccaaggatatgatccatatggttatgttcggccgcctcaagatcctgccatgtacgcttatgcagcatatcctggatacgggaattatcaacaaccagcgccacagcagccccctcaacaggttaaggcactc

SEQ ID NO: 1854 - protein, 406 aa, Oryza sativa
  LOC_Os03g37270.1
MMQPPPPPQWAMGPPPPPQYFQAGPPPPPPQYFQGAHPPAAMWGQPPPPQAAPPPAPAGGAAGDEVRTLWIGDLQFWMEENYLYNCFSQAGELISAKIIRNKQTGQPEGYGFIEFGSHAIAEQVLQGYNGQMMPNGNQVFKLNWATSGAGEKRGDDGSDYTIFVGDLASDVTDLILQDTFKAHYQSVKGAKVVFDRSTGRSKGYGFVKFGDLDEQTRAMTEMNGQYCSSRPMRIGPASNKKNIGGQQQPSATYQNTQGTDSDSDPNNTTVFVGGLDPSVTDEVLKQAFSPYGELVYVKIPVGKRCGFVQYSNRASAEEAIRMLNGSQLGGQSIRLSWGRSPGNKQPQQDQNQWNAGYYGYPPQGYDPYGYVRPPQDPAMYAYAAYPGYGNYQQPAPQQPPQQVKAL

SEQ ID NO: 1855 - DNA, 1215 bp, Zea mays
  GRMZM2G002874_T01
atgatgcagccgccgccgccacatcagcagcagcaatgggcaatggcgcccccgcccccgccgcagtactaccaggcggggcaccctccgccgccgcccccgcagttctaccaggcgggccctccgcctcccgctatgtggggccaaccgccaccgcaggcggcggcggcgccggcgccggccggcggcggggcgggggacgaggcgaggaccctctggatcggggacctgcagtactggatggatgagaactacctctatagctgcttctcccaggctggcgaggttatttccgtgaagataattcggaacaagcagactgggcaacctgagggttatggttttattgaattcagcaaccatgctgtagccgaacaagttctgcagaactataatggtcaaatgatgcccaatgttaatcaacctttcaaattgaattgggctaccagtggggctggtgagaaacgtggagacgatggttcagattatactatatttgttggggacttggcctcggatgttacagatttcattctacaagatacgttcaagagtcgttatccatcagttaagggtgcaaaagttgtctttgacagaactactggccgttcgaaaggctatggttttgtaaagtttgcagattcggatgaacagacacgggcaatgactgaaatgaatggacaatactgttctagcagggccatgcgccttggaccagcatccaacaagaagaatactggtggaccacaaccatcgagtgctatttaccagaacacccaaggaactgattctgatagcgatccgaacaatactactgtatttgttggcggccttgacccgagtgtgactgacgagcttctgaagcaaactttcagtccatatggagagcttctctatgtcaaaatacctgtaggaaagcgctgcggatttgtccaatattctaacagggcatcagctgaggaggccataagggtgctaaatggaagccagttgggaggtcagagcataaggctctcatggggccgtagccctgcaaacaagcagcctcagcaagagcagagccaatggagcggtggtggctattatgggtatccccaaggatacgatccatatggctatgctcggccccctcaagatcctgccatgtacgcctacgcagcatatccagggtatggaaattaccagcaacagccaccacagcagcccccgccacaa

SEQ ID NO: 1856 - protein, 406 aa, Zea mays
  GRMZM2G002874_T01
MMQPPPPHQQQQWAMAPPPPPQYYQAGHPPPPPPQFYQAGPPPPAMWGQPPPQAAAAPAPAGGGAGDEARTLWIGDLQYWMDENYLYSCFSQAGEVISVKIIRNKQTGQPEGYGFIEFSNHAVAEQVLQNYNGQMMPNVNQPFKLNWATSGAGEKRGDDGSDYTIFVGDLASDVTDFILQDTFKSRYPSVKGAKVVFDRTTGRSKGYGFVKFADSDEQTRAMTEMNGQYCSSRAMRLGPASNKKNTGGPQPSSAIYQNTQGTDSDSDPNNTTVFVGGLDPSVTDELLKQTFSPYGELLYVKIPVGKRCGFVQYSNRASAEEAIRVLNGSQLGGQSIRLSWGRSPANKQPQQEQSQWSGGGYYGYPQGYDPYGYARPPQDPAMYAYAAYPGYGNYQQQPPQQPPPQQ

SEQ ID NO: 1857 - DNA, 1227 bp, Setaria italica
  Si035917m
atgatgcagccgccgccgccgccgccgcagcagcagcaatgggcaatggcgccgccgcccccaccgcagtactaccaggcggggcacccaccgccgccgcccccgcagttctaccaggcggggccaccgcctcccgctatgtggggccagccgccgccgcaggctgcgccggcgccggcgccggcaccgtccggcagcgggggaggggacgaggctaagaccctctggatcggggacctgcagtactggatggacgagaactacctctacagctgcttctcccaagccggcgaggttatttcagtgaagataattcggaacaagcagactgggcagcctgagggttatggttttattgaatttggcaaccatgcattagctgaacaagttcttcagaattataatggtcaaatgatgcctaatggtaatcaacctttcaaattgaattgggctacaagtggggctggtgagaaacgtggagatgatggctcagattatactatatttgttggggatctggcctcagatgttacagatttcattctacaagatacattcaagagtcgttatccatcagtcaagggtgcaaaagttgtctttgacagaactaccggccgctcgaaaggctatggttttgttaaatttggagatttggatgaacagactcgagctatgactgaaatgaatggacaatactgttctagcaggcccatgcgccttggaccagcatccaacaagaagaatatcagtggacaacaacagccatctagtgctacatacccgaatacacaaggaactgattctgataatgatccaaacaatactactgtatttgttggtggtcttgacccgagtgtgactgatgaggttctgaggcaaaccttcagtccatatggagagcttctctatgtcaaaatacctgtaggaaagcgatgcggatttgtgcaatattctaacagggcatcagctgaggaggccataagggtgctaaatggaacccagttaggaggccagagcgtaaggctctcgtggggtcgtagccctgcaaacaaacagcctcagcaagagcagaaccaatggagcagcggctactatggttatccccaaggttatgatccatatggttatgctcggcctcctcaagatcctgccatgtatgcgtatacagcatatccagggtatggaaattaccagcagcaaccaccacagcagcccccaccacaacag

SEQ ID NO: 1858 - protein, 409 aa, Setaria italica
  Si035917m
MMQPPPPPPQQQQWAMAPPPPPQYYQAGHPPPPPPQFYQAGPPPPAMWGQPPPQAAPAPAPAPSGSGGGDEAKTLWIGDLQYWMDENYLYSCFSQAGEVISVKIIRNKQTGQPEGYGFIEFGNHALAEQVLQNYNGQMMPNGNQPFKLNWATSGAGEKRGDDGSDYTIFVGDLASDVTDFILQDTFKSRYPSVKGAKVVFDRTTGRSKGYGFVKFGDLDEQTRAMTEMNGQYCSSRPMRLGPASNKKNISGQQQPSSATYPNTQGTDSDNDPNNTTVFVGGLDPSVTDEVLRQTFSPYGELLYVKIPVGKRCGFVQYSNRASAEEAIRVLNGTQLGGQSVRLSWGRSPANKQPQQEQNQWSSGYYGYPQGYDPYGYARPPQDPAMYAYTAYPGYGNYQQQPPQQPPPQQ

SEQ ID NO: 1859 - DNA, 1251 bp, Citrus clementina
  clementine0.9_011382m
atgatgcaacaaccgccatcacagccttccgatcagactagccagtaccagcagcaacatcagcagtggatggcgtatcaacagcagtcgcagcagcagcaacaacaacatcaaactccggtgccacctccggttggatggactccgcagccggtgcctcctccatctcagcagacgcagccctacggtgtcgcccccgatgcttcctccgacgggatccgttctttgtggatcggagacttgcagccgtggatggaggagagttatatcgccagcatcttcggccatactggagagtttgtttcaggaaaggttattcgcaacaagcaaacaaatttttcagagggttatggttttattgagtttgttagtcatgctgctgcagagagggttttgcagacttttaatggcacccaaatgccaagcactgagcaaaacttcagactgaattgggcaacctatggggctggtgagaggcgtcaagatgatggtcctgattttacaatttttgtgggagatttggctgccgatgtaactgactatgtgctacaagaaacatttagagctgtctactcgtcagtgaagggtgctaaagtggtcactgatagaaccactggacgctctaagggatatggttttgtgagatttggggatgaaagtgaacaattgcgttccatgactgaaatgaatggcgtgctctgctctactagacctatgcggattgggccagctgccaccaagaaagctgccactggccagcaatatcagaaagctacttatcaaaatacccaaggaagccagggcgagaatgatccaaataatacaacaatatttgttgggggtttggatcctagtgttacagatgacattttgaaaacagtttttggtcaatatggtgagttagttcatgtgaaaataccagcgggcaagcgctgcgggtttgttcagtttgctaacagaacttgtgcggagcaagcactatcagttttgaatggcacccaattaggaggacaaagcattagactgtcatgggggcgtagtccttcaaacaaacagtcggatcaggcccaatggaacggtggtggatactatggttttgcacaaggatacgaggcatatggatatgcgcctcctacccaagacccgaacatgtactatgggggctttcctggatatgggacttaccaacagccagggtcttaccaacagccacagcaggttagtgaatttaatgtttctcacatcattttt

SEQ ID NO: 1860 - protein, 417 aa, Citrus clementina
  clementine0.9_011382m
MMQQPPSQPSDQTSQYQQQHQQWMAYQQQSQQQQQQHQTPVPPPVGWTPQPVPPPSQQTQPYGVAPDASSDGIRSLWIGDLQPWMEESYIASIFGHTGEFVSGKVIRNKQTNFSEGYGFIEFVSHAAAERVLQTFNGTQMPSTEQNFRLNWATYGAGERRQDDGPDFTIFVGDLAADVTDYVLQETFRAVYSSVKGAKVVTDRTTGRSKGYGFVRFGDESEQLRSMTEMNGVLCSTRPMRIGPAATKKAATGQQYQKATYQNTQGSQGENDPNNTTIFVGGLDPSVTDDILKTVFGQYGELVHVKIPAGKRCGFVQFANRTCAEQALSVLNGTQLGGQSIRLSWGRSPSNKQSDQAQWNGGGYYGFAQGYEAYGYAPPTQDPNMYYGGFPGYGTYQQPGSYQQPQQVSEFNVSHIIF

SEQ ID NO: 1861 - DNA, 1218 bp, Citrus clementina
  clementine0.9_011817m
atgatgcaacaaccgccatcacagccttccgatcagactagccagtaccagcagcaacatcagcagtggatggcgtatcaacagcagtcgcagcagcagcaacaacaacatcaaactccggtgccacctccggttggatggactccgcagccggtgcctcctccatctcagcagacgcagccctacggtgtcgcccccgatgcttcctccgacgggatccgttctttgtggatcggagacttgcagccgtggatggaggagagttatatcgccagcatcttcggccatactggagagtttgtttcaggaaaggttattcgcaacaagcaaacaaatttttcagagggttatggttttattgagtttgttagtcatgctgctgcagagagggttttgcagacttttaatggcacccaaatgccaagcactgagcaaaacttcagactgaattgggcaacctatggggctggtgagaggcgtcaagatgatggtcctgattttacaatttttgtgggagatttggctgccgatgtaactgactatgtgctacaagaaacatttagagctgtctactcgtcagtgaagggtgctaaagtggtcactgatagaaccactggacgctctaagggatatggttttgtgagatttggggatgaaagtgaacaattgcgttccatgactgaaatgaatggcgtgctctgctctactagacctatgcggattgggccagctgccaccaagaaagctgccactggccagcaatatcagaaagctacttatcaaaatacccaaggaagccagggcgagaatgatccaaataatacaacaatatttgttgggggtttggatcctagtgttacagatgacattttgaaaacagtttttggtcaatatggtgagttagttcatgtgaaaataccagcgggcaagcgctgcgggtttgttcagtttgctaacagaacttgtgcggagcaagcactatcagttttgaatggcacccaattaggaggacaaagcattagactgtcatgggggcgtagtccttcaaacaaacagtcggatcaggcccaatggaacggtggtggatactatggttttgcacaaggatacgaggcatatggatatgcgcctcctacccaagacccgaacatgtactatgggggctttcctggatatgggacttaccaacagccagggtcttaccaacagccacagcag

SEQ ID NO: 1862 - protein, 406 aa, Citrus clementina
  clementine0.9_011817m
MMQQPPSQPSDQTSQYQQQHQQWMAYQQQSQQQQQQHQTPVPPPVGWTPQPVPPPSQQTQPYGVAPDASSDGIRSLWIGDLQPWMEESYIASIFGHTGEFVSGKVIRNKQTNFSEGYGFIEFVSHAAAERVLQTFNGTQMPSTEQNFRLNWATYGAGERRQDDGPDFTIFVGDLAADVTDYVLQETFRAVYSSVKGAKVVTDRTTGRSKGYGFVRFGDESEQLRSMTEMNGVLCSTRPMRIGPAATKKAATGQQYQKATYQNTQGSQGENDPNNTTIFVGGLDPSVTDDILKTVFGQYGELVHVKIPAGKRCGFVQFANRTCAEQALSVLNGTQLGGQSIRLSWGRSPSNKQSDQAQWNGGGYYGFAQGYEAYGYAPPTQDPNMYYGGFPGYGTYQQPGSYQQPQQ

SEQ ID NO: 1863 - DNA, 960 bp, Citrus clementina
  clementine0.9_016001m
atgatgcaacaaccgccatcacagccttccgatcagactagccagtaccagcagcaacatcagcagtggatggcgtatcaacagcagtcgcagcagcagcaacaacaacatcaaactccggtgccacctccggttggatggactccgcagccggtgcctcctccatctcagcagacgcagccctacggtgtcgcccccgatgcttcctccgacgggatccgttctttgtggatcggagacttgcagccgtggatggaggagagttatatcgccagcatcttcggccatactggagagtttgtttcaggaaaggttattcgcaacaagcaaacaaatttttcagagggttatggttttattgagtttgttagtcatgctgctgcagagagggttttgcagacttttaatggcacccaaatgccaagcactgagcaaaacttcagactgaattgggcaacctatggggctggtgagaggcgtcaagatgatggtcctgattttacaatttttgtgggagatttggctgccgatgtaactgactatgtgctacaagaaacatttagagctgtctactcgtcagtgaagggtgctaaagtggtcactgatagaaccactggacgctctaagggatatggttttgtgagatttggggatgaaagtgaacaattgcgttccatgactgaaatgaatggcgtgctctgctctactagacctatgcggattgggccagctgccaccaagaaagctgccactggccagcaatatcagaaagctacttatcaaaatacccaaggaagccagggcgagaatgatccaaataatacaacaatatttgttgggggtttggatcctagtgttacagatgacattttgaaaacagtttttggtcaatatggtgagttagttcatgtgaaaataccagcgggcaagcgctgcgggtttgttcagtttgctaacagg

SEQ ID NO: 1864 - protein, 320 aa, Citrus clementina
  clementine0.9_016001m
MMQQPPSQPSDQTSQYQQQHQQWMAYQQQSQQQQQQHQTPVPPPVGWTPQPVPPPSQQTQPYGVAPDASSDGIRSLWIGDLQPWMEESYIASIFGHTGEFVSGKVIRNKQTNFSEGYGFIEFVSHAAAERVLQTFNGTQMPSTEQNFRLNWATYGAGERRQDDGPDFTIFVGDLAADVTDYVLQETFRAVYSSVKGAKVVTDRTTGRSKGYGFVRFGDESEQLRSMTEMNGVLCSTRPMRIGPAATKKAATGQQYQKATYQNTQGSQGENDPNNTTIFVGGLDPSVTDDILKTVFGQYGELVHVKIPAGKRCGFVQFANR

SEQ ID NO: 1865 - DNA, 960 bp, Citrus clementina; identical to SEQ ID NO: 1863
  clementine0.9_016014m

SEQ ID NO: 1866 - protein, 320 aa, Citrus clementina; identical to SEQ ID NO: 1864
  clementine0.9_016014m

SEQ ID NO: 1867 - DNA, 858 bp, Citrus clementina
  clementine0.9_017768m
atgatgcaacaaccgccatcacagccttccgatcagactagccagtaccagcagcaacatcagcagtggatggcgtatcaacagcagtcgcagcagcagcaacaacaacatcaaactccggtgccacctccggttggatggactccgcagccggtgcctcctccatctcagcagacgcagccctacggtgtcgcccccgatgcttcctccgacgggatccgttctttgtggatcggagacttgcagccgtggatggaggagagttatatcgccagcatcttcggccatactggagagtttgtttcaggaaaggttattcgcaacaagcaaacaaatttttcagagggttatggttttattgagtttgttagtcatgctgctgcagagagggttttgcagacttttaatggcacccaaatgccaagcactgagcaaaacttcagactgaattgggcaacctatggggctggtgagaggcgtcaagatgatggtcctgattttacaatttttgtgggagatttggctgccgatgtaactgactatgtgctacaagaaacatttagagctgtctactcgtcagtgaagggtgctaaagtggtcactgatagaaccactggacgctctaagggatatggttttgtgagatttggggatgaaagtgaacaattgcgttccatgactgaaatgaatggcgtgctctgctctactagacctatgcggattgggccagctgccaccaagaaagctgccactggccagcaatatcagaaagctacttatcaaaatacccaaggaagccagggcgagaatgatccaaataatacaacagtgcgtagtttattttatgttgatactaat

SEQ ID NO: 1868 - protein, 286 aa, Citrus clementina
  clementine0.9_017768m
MMQQPPSQPSDQTSQYQQQHQQWMAYQQQSQQQQQQHQTPVPPPVGWTPQPVPPPSQQTQPYGVAPDASSDGIRSLWIGDLQPWMEESYIASIFGHTGEFVSGKVIRNKQTNFSEGYGFIEFVSHAAAERVLQTFNGTQMPSTEQNFRLNWATYGAGERRQDDGPDFTIFVGDLAADVTDYVLQETFRAVYSSVKGAKVVTDRTTGRSKGYGFVRFGDESEQLRSMTEMNGVLCSTRPMRIGPAATKKAATGQQYQKATYQNTQGSQGENDPNNTTVRSLFYVDTN

SEQ ID NO: 1869 - DNA, 819 bp, Citrus clementina
  clementine0.9_018398m
atgatgcaacaaccgccatcacagccttccgatcagactagccagtaccagcagcaacatcagcagtggatggcgtatcaacagcagtcgcagcagcagcaacaacaacatcaaactccggtgccacctccggttggatggactccgcagccggtgcctcctccatctcagcagacgcagccctacggtgtcgcccccgatgcttcctccgacgggatccgttctttgtggatcggagacttgcagccgtggatggaggagagttatatcgccagcatcttcggccatactggagagtttgtttcaggaaaggttattcgcaacaagcaaacaaatttttcagagggttatggttttattgagtttgttagtcatgctgctgcagagagggttttgcagacttttaatggcacccaaatgccaagcactgagcaaaacttcagactgaattgggcaacctatggggctggtgagaggcgtcaagatgatggtcctgattttacaatttttgtgggagatttggctgccgatgtaactgactatgtgctacaagaaacatttagagctgtctactcgtcagtgaagggtgctaaagtggtcactgatagaaccactggacgctctaagggatatggttttgtgagatttggggatgaaagtgaacaattgcgttccatgactgaaatgaatggcgtgctctgctctactagacctatgcggattgggccagctgccaccaagaaagctgccactggccagcaatatcagaaaggacaccaagaggctctcattttgagggagcctggaactgatttcggg

SEQ ID NO: 1870 - protein, 273 aa, Citrus clementina
  clementine0.9_018398m
MMQQPPSQPSDQTSQYQQQHQQWMAYQQQSQQQQQQHQTPVPPPVGWTPQPVPPPSQQTQPYGVAPDASSDGIRSLWIGDLQPWMEESYIASIFGHTGEFVSGKVIRNKQTNFSEGYGFIEFVSHAAAERVLQTFNGTQMPSTEQNFRLNWATYGAGERRQDDGPDFTIFVGDLAADVTDYVLQETFRAVYSSVKGAKVVTDRTTGRSKGYGFVRFGDESEQLRSMTEMNGVLCSTRPMRIGPAATKKAATGQQYQKGHQEALILREPGTDFG

SEQ ID NO: 1871 - DNA, 1290 bp, Populus trichocarpa
  POPTR_0001s45000.1
atgatgcaacaaccaggaatcgccggagcgggtgtcccgcaaccagatcaacaacaacaataccaacagcaatggatgatgcagcaacagcaacaatcgcaacccgtacctcctcctgctggatggactccgccgcctgttcctcctccgtcccagtatggttcagccgccggaagtgctgctgttggagacgagatcaagtcgttgtggatcggggatttgcagcagtggatggatgagaattatattctcagcatcttttctaccactggagaggttgtccaagctaaggttattcgtaataagcaaacaggttacccagagggttatggttttattgaatttgttagtcatgctgcagcagagaggattttgcaaacatacaatgggacaccaatgccaaacagtgagcagactttccggctgaactgggctaccctcggtgccggcgagaggcgccaagatgatgggcctgattatacagttttcattggagatttggctgctgatgtcaatgattacctcctacaagaaacatttagaaatgtttactcatccgtgaaaggtgcaaaagttgttactgatagagttactggacgttcaaagggatatggatttgttagatttgctgatgaaaatgaacaaatgcgtgccatggttgagatgaacggacaatactgctctactaggcctatgcggattggaccagcggccacaaagaaacctttgacccagcaatatcagaaagctgcttaccagagtcctcaaggaaatcagggggagagtgatccaaataacacaacaatatttgttggtgctttggatccaagtgtgactgatgacactttgagagcagtgtttagtaaatatggtgagctagtgcatgtgaaaatacctgcaggcaagcgttgtggattcgttcagtttgctaatcgcacttgtgcggagcaagcactatcgatgctgaacggaactcagatagctggtcaaaatattcgactctcatggggccgtagtccttctaacaaacaggctcagccagaccaaagccagtggaacggtggtggatattatggatatccacaaggatatgatgcatatggatatgctgctgctgctgctgctgccgccgccgctccccaagaccctagcatgtattatggaggatatcctggatatggaaactaccagcaaccaggagcttaccaacagcaaccgggagcttaccaacagcaaccgggagcataccaacagcaacccggagcttaccaacagcaacagcaggtagag

SEQ ID NO: 1872 - protein, 430 aa, Populus trichocarpa
  POPTR_0001s45000.1
MMQQPGIAGAGVPQPDQQQQYQQQWMMQQQQQSQPVPPPAGWTPPPVPPPSQYGSAAGSAAVGDEIKSLWIGDLQQWMDENYILSIFSTTGEVVQAKVIRNKQTGYPEGYGFIEFVSHAAAERILQTYNGTPMPNSEQTFRLNWATLGAGERRQDDGPDYTVFIGDLAADVNDYLLQETFRNVYSSVKGAKVVTDRVTGRSKGYGFVRFADENEQMRAMVEMNGQYCSTRPMRIGPAATKKPLTQQYQKAAYQSPQGNQGESDPNNTTIFVGALDPSVTDDTLRAVFSKYGELVHVKIPAGKRCGFVQFANRTCAEQALSMLNGTQIAGQNIRLSWGRSPSNKQAQPDQSQWNGGGYYGYPQGYDAYGYAAAAAAAAAAPQDPSMYYGGYPGYGNYQQPGAYQQQPGAYQQQPGAYQQQPGAYQQQQQVE

SEQ ID NO: 1873 - DNA, 1212 bp, Populus trichocarpa
  POPTR_0011s14150.1
atgatgcaacagcccggagtcgccggagtgggggccccacaaccagatcaacaacaacaataccaacaacaacagcagcaatggatgatgcagcaacagcaacaatcgcaaccggtgcctcctcctgctggctggaatccgccgcctgttcctcctccgacccagtacggtgcagccgccggaagtggaggagatggagacgagattaagtcgttgtggatcggggatttgcagcagtggatggatgagaattatcttcttagcatcttctctgcaactggagagattgttcaagctaaggttattcgtaataagcaaacgggttatccagagggttatggttttattgagtttgtaagtcgtgctgcagcagagagaattttgcagacatacaatggcacaccaatgccaaatagtgagcaggctttccggctgaactgggcaacccttggtgctggtgagaggcggcaagatgatgggcctgattttacagtttttgttggagatttggctgctgatgtcaacgattaccttctacaagaaacatttagaaatgtgtacccatctgtgaaaggtgcaaaagttgttactgatagggtcactggacgttccaagggatatggatttattaggtttgctgatgaaaatgaacaaaggcgtgccatggttgagatgaatggacaatactgctctaccaggcccatgcggattggaccagctgccacgaagaaacccttgacccagcagtatcagaaagctacttaccagaatcctcaaggaaatcagggagagaatgatccaaataacacaacaatatttgtcggggccttggatccaagtgtgactgatgacactttgagagcagtgtttagtaaatatggcgagctagtgcacgtgaaaatacctgcaggcaagcgttgtggattcgttcagtttgctaatcgaactagcgcggagcaagcactatcaatgttgaacggaacccagatagctggtcaaaatatccgtctctcatggggccgtagtccttctaacaaacaggttcagccagatcaaagccagtggaatggcggtggatattatggatatccacaaggatatgatgcatatggatatgctgctgctgctccccaagaccctaacatgtattatggaggctatcctggatatggaaactaccagcaaccgggagcttaccaacagcaacagcag

SEQ ID NO: 1874 - protein, 404 aa, Populus trichocarpa
  POPTR_0011s14150.1
MMQQPGVAGVGAPQPDQQQQYQQQQQQWMMQQQQQSQPVPPPAGWNPPPVPPPTQYGAAAGSGGDGDEIKSLWIGDLQQWMDENYLLSIFSATGEIVQAKVIRNKQTGYPEGYGFIEFVSRAAAERILQTYNGTPMPNSEQAFRLNWATLGAGERRQDDGPDFTVFVGDLAADVNDYLLQETFRNVYPSVKGAKVVTDRVTGRSKGYGFIRFADENEQRRAMVEMNGQYCSTRPMRIGPAATKKPLTQQYQKATYQNPQGNQGENDPNNTTIFVGALDPSVTDDTLRAVFSKYGELVHVKIPAGKRCGFVQFANRTSAEQALSMLNGTQIAGQNIRLSWGRSPSNKQVQPDQSQWNGGGYYGYPQGYDAYGYAAAAPQDPNMYYGGYPGYGNYQQPGAYQQQQQ

SEQ ID NO: 1875 - DNA, 672 bp, Vitis vinifera
  GSVIVT01037635001
atggttcagttcctttacactattaccgtatatctgaatacaagttttcctttccttttttgggttcccgtgggtaatttcgcttccaattttcagcttttttcttcttttcagaatactcaaggaaatcagggtgagagtgatccaaataacacaacaatatttgttggtggtttggactccaatgttactgatgactatttgagacaagtgtttagccaatatggtgaattggttcatgtgaaaataccagtaggcaagcgctgtgggtttgttcaattcgctaatagagcttgtgctgagcaagctttagctgggttaaatggtactcaattaggagcacagagtattcgtctttcatgggggcgtagtccttcgaacaaacaggcccagccagatcaggcccagtggaatggtggatattatggatatgctcaaggatatgaggcatatgggtatgcgccacctcctcaagaccctaacatgtactatggagcctatcctggatatggaaattaccagcagccacagcaaggaaaagcttctatgcttataaagctagaatccccagtactctctcattctgcctggttggatgagaattgtaggacactggatgctacatgtttgttggtggggcctgacttacgaaaaatattattgatctgttgc

SEQ ID NO: 1876 - protein, 224 aa, Vitis vinifera
  GSVIVT01037635001
MVQFLYTITVYLNTSFPFLFWVPVGNFASNFQLFSSFQNTQGNQGESDPNNTTIFVGGLDSNVTDDYLRQVFSQYGELVHVKIPVGKRCGFVQFANRACAEQALAGLNGTQLGAQSIRLSWGRSPSNKQAQPDQAQWNGGYYGYAQGYEAYGYAPPPQDPNMYYGAYPGYGNYQQPQQGKASMLIKLESPVLSHSAWLDENCRTLDATCLLVGPDLRKILLICC

SEQ ID NO: 1877 - DNA, 1230 bp, Solanum lycopersicum
  Solyc07g064510.2.1
atgatgccacaaagtggagttgctcagccagcaatggcacctatgtcaatggatcagtatcagcagcaagctccgccgacgcagcagcaacaacaatggatgatgcaacctccgcaagctcaacaacctcaatttcaaccttcttggggtcagcagcaacaacagccatcgcaaactatgtctcaacagtatgttgcgactaattctagccctagctcgaatgttaatccaaatgaggttaggtctctttggattggggacttgcagtattggatggatgagagttatctctccacttgtttctatcacaccggcgagcttgtttctgctaaggtcatcaggaacaagcaaagtggccagtctgaaggttatggattcctcgaattcaggagtcatgcggctgcagaaactgttttacaaacatataatggcgccttgatgccaaatgtggaacagaatttccgtatgaactgggcatctcttggtgccggtgagaggcgagatgattcacccgagtacacaatatttgttggtgatttggctgctgatgtgacggattatgtgctacaagagacattcaaacccgtgtattcatcagtaaaaggtgcaaaagttgtaacagatagaattactggacgtaccaagggatatggatttgtcaagttctctgatgagagtgaacaattgcgtgctatgactgaaatgaatggtgtactttgttcatctaggcccatgaggattggcccggctgcaaacaagaaaccaatgggtaccccccagaaagctacctaccaaaatcctcaagctactcaaggcgaaagtgaccccaataatacaactatatttgttggtggtttggatcccagtgttgcagaagagcatttgcgacaagttttctccccatatggtgaattggttcacgtgaagatagtggctggaaagcgctgtggctttgttcagtttggtagtagagcttctgctgagcaggctttgtcaagcttgaatggcacacaattgggaggacaaagcattcggctttcttgggggcgtagcccctctaacaaacagtccgatcaggctcaatggggtggaagtgccggtgctggtgctggtgcatattatgggtatgcccaaggatatgaggcttatggatatgctcctcccgctcaggaccctaatatgtattatgggaattacccaggatatgggaattatcagcagccacagcag

SEQ ID NO: 1878 - protein, 410 aa, Solanum lycopersicum
  Solyc07g064510.2.1
MMPQSGVAQPAMAPMSMDQYQQQAPPTQQQQQWMMQPPQAQQPQFQPSWGQQQQQPSQTMSQQYVATNSSPSSNVNPNEVRSLWIGDLQYWMDESYLSTCFYHTGELVSAKVIRNKQSGQSEGYGFLEFRSHAAAETVLQTYNGALMPNVEQNFRMNWASLGAGERRDDSPEYTIFVGDLAADVTDYVLQETFKPVYSSVKGAKVVTDRITGRTKGYGFVKFSDESEQLRAMTEMNGVLCSSRPMRIGPAANKKPMGTPQKATYQNPQATQGESDPNNTTIFVGGLDPSVAEEHLRQVFSPYGELVHVKIVAGKRCGFVQFGSRASAEQALSSLNGTQLGGQSIRLSWGRSPSNKQSDQAQWGGSAGAGAGAYYGYAQGYEAYGYAPPAQDPNMYYGNYPGYGNYQQPQQ

SEQ ID NO: 1879 - DNA, 1191 bp, Eucalyptus grandis
  Eucgr.F03462.1
atgatgcagcagccggtccccggagccgtccccgaccagcagcagcagtaccagcagcagcagcagcagcagtggatgatgatgcagcaggccgcccagcccgtgcccccgccggtgggctggaccccgcagccggtcccgccgcccatggcggcccagtcgatggccggcggcgcggcggccgagatcaagtcgctctggatcggcgacctgcagcctcacatggacgagacctatctcctcaactgcttcgcccactccggggaggttctctcagctaaggtgattagaaataagcagactgctctgcccgagggttacggtttcattgaatttatgacccgtgcagcagcagagaggattttgcagacgtacaatggcacattgatgccaaattctgaccagaatttccgactgaactgggctacacttggtcctggtgagaggcgtcaagatgagggtcctgactatacaatttttgttggagatctggctgctgatgtaacagatcacatgctacaggagacatttagagctcactatccatctgtgaaaggtgccaaaatagttatcgacaggacaactggccgttctaagggctatgggtttgttaggttcggcgatgagactgagcagttacgggccatgaccgaaatgaatggcatgtattgttcttctcgccccatgaggattgggcccgctgctaacaagaagcctattgctacccagcaatatcagagtgcatcttaccagaacagtcaaggaaaccaaggggagaatgatccaaataatacaactatatttgtcgggggtctggatccaagtgtatcagatgaccttttgaggcaagtattcagtcaatatggagagttgcatcatgtgaaaattccacctggcaaacgttgcggttttgttcaattcacaagcagagcttgtgctgagcaagccttgttgatgttgaatggaacccagttgggaggacaaagcattcgactgtcatgggggcggagtccctcgaacaagcaggctcagccggagcaggcacagtggaatggtggtggatattatggatatccacagggatatgaagcatatggttatgcccctcctacccaggaccctaatatgttctatggaggttatgctgggtataattatcagcagcctgtaacctaccagcagccacagcag

SEQ ID NO: 1880 - protein, 397 aa, Eucalyptus grandis
  Eucgr.F03462.1
MMQQPVPGAVPDQQQQYQQQQQQQWMMMQQAAQPVPPPVGWTPQPVPPPMAAQSMAGGAAAEIKSLWIGDLQPHMDETYLLNCFAHSGEVLSAKVIRNKQTALPEGYGFIEFMTRAAAERILQTYNGTLMPNSDQNFRLNWATLGPGERRQDEGPDYTIFVGDLAADVTDHMLQETFRAHYPSVKGAKIVIDRTTGRSKGYGFVRFGDETEQLRAMTEMNGMYCSSRPMRIGPAANKKPIATQQYQSASYQNSQGNQGENDPNNTTIFVGGLDPSVSDDLLRQVFSQYGELHHVKIPPGKRCGFVQFTSRACAEQALLMLNGTQLGGQSIRLSWGRSPSNKQAQPEQAQWNGGGYYGYPQGYEAYGYAPPTQDPNMFYGGYAGYNYQQPVTYQQPQQ

SEQ ID NO: 1881 - DNA, 804 bp, Eucalyptus grandis
  Eucgr.F03462.2
atgatgcagcagccggtccccggagccgtccccgaccagcagcagcagtaccagcagcagcagcagcagcagtggatgatgatgcagcaggccgcccagcccgtgcccccgccggtgggctggaccccgcagccggtcccgccgcccatggcggcccagtcgatggccggcggcgcggcggccgagatcaagtcgctctggatcggcgacctgcagcctcacatggacgagacctatctcctcaactgcttcgcccactccggggaggttctctcagctaaggtgattagaaataagcagactgctctgcccgagggttacggtttcattgaatttatgacccgtgcagcagcagagaggattttgcagacgtacaatggcacattgatgccaaattctgaccagaatttccgactgaactgggctacacttggtcctggtgagaggcgtcaagatgagggtcctgactatacaatttttgttggagatctggctgctgatgtaacagatcacatgctacaggagacatttagagctcactatccatctgtgaaaggtgccaaaatagttatcgacaggacaactggccgttctaagggctatgggtttgttaggttcggcgatgagactgagcagttacgggccatgaccgaaatgaatggcatgtattgttcttctcgccccatgaggattgggcccgctgctaacaagaagcctattgctacccagcaatatcagagtggacgccaagaggctctcattttggagggcctggaactgatttcagctgaaatgattccactt

SEQ ID NO: 1882 - protein, 268 aa, Eucalyptus grandis
  Eucgr.F03462.2
MMQQPVPGAVPDQQQQYQQQQQQQWMMMQQAAQPVPPPVGWTPQPVPPPMAAQSMAGGAAAEIKSLWIGDLQPHMDETYLLNCFAHSGEVLSAKVIRNKQTALPEGYGFIEFMTRAAAERILQTYNGTLMPNSDQNFRLNWATLGPGERRQDEGPDYTIFVGDLAADVTDHMLQETFRAHYPSVKGAKIVIDRTTGRSKGYGFVRFGDETEQLRAMTEMNGMYCSSRPMRIGPAANKKPIATQQYQSGRQEALILEGLELISAEMIPL

SEQ ID NO: 1883 - DNA, 582 bp, Vitis vinifera
  GSVIVT01037634001
atggaagagaactatctgtggggatgtttctctcagaccggagaggtggtttcagtgaaggttatccgaaataagcaaactggccaatgtgagggctatggctttattgaattggctactcgtgccgcagccgaaaggattctgcagacttacaatggcacattgatgccaaattctgaacagaacttccgactgaactgggccactcttggtgctggtgagagacgtgcagatgacactcctgactatactatctttgttggagatttggcttctgatgtgacagattacgtgttacaagaaacattcagaggccactatccatcggttaagggtgcaaaggtggtcactgataggaccactgggcgttctaagggttacgggtttgtgaggtttggagatgaaggtgaacaactgcgtgcgatgaatgaaatgaatggaatgttctgttcaaccagacccatgcgaattggccctgctgctaccaagaaacctgttggtggtcagcaattccagaaaggactccaagaggctctcattttggggggcctggaactgatttcagctgaaatgattccactt

SEQ ID NO: 1884 - protein, 194 aa, Vitis vinifera
  GSVIVT01037634001
MEENYLWGCFSQTGEVVSVKVIRNKQTGQCEGYGFIELATRAAAERILQTYNGTLMPNSEQNFRLNWATLGAGERRADDTPDYTIFVGDLASDVTDYVLQETFRGHYPSVKGAKVVTDRTTGRSKGYGFVRFGDEGEQLRAMNEMNGMFCSTRPMRIGPAATKKPVGGQQFQKGLQEALILGGLELISAEMIPL

SEQ ID NO: 1885 - DNA, 1239 bp, Citrus clementina
  clementine0.9_011566m
atgatgcagccagcgcccggagcggtcccacccccgccaccaccgatggccgctcaccagtaccaataccaacaacaggcgccgcctcagcagcagccgccaccgcaaccctcgccgtacatgatgatgatgccgcctcagccccaggcccagcctcctgccatgtgggccacgcatgctgctgctcctcaggcagcgggagttgcggtaccgcctcagcagcagggtcagcccggtgagatccggaccctgtggatcggggacttgcagtattggatggatgagacctatctcaacacttgttttgcacacaccggcgaggttgtcgctgtaaaagtaattcgtaataagcaaactggtcaaatagaaggttatggatttattgagtttatttcgcgtgctggtgctgaaagagttttgcagacatataacggtacccctatgccaaacggtgagcagaacttcaggctaaactgggcatcttttggtgctggcgagaagcgcgatgacacccctgaccacacaatatttgttggagatttggctgctgacgttactgattacatgcttcaagagaccttcagggcccgctatccctctactaaaggtgcaaaggttgtcattgataggcttactggacgcacaaagggttatggatttgtgagatttggtgatgaaagtgaacagctacgtgccatgactgagatgaatggtgtcttttgttctacgagaccaatgcggattggtccagctactaataagaaaactgtttcaggtcagcagcagtaccctaaagcttcatatcagaattctcaagtggcacagagtgatgacgatccaaataatacaacggtgtttgttggtaatctggactctattgttacggatgaacatttgagagaactgttcagccaatatgggcaactagtacatgtgaaaataccagcaggcaagcgatgtggatttgttcaatttgctgacagaagttgtgcagaggaagcattgagaatgttaaatggaactcagttgggaggacaaaatatccggctatcatggggacgtagtccttcaaacaaacaggctcagccagacccaaaccagtggaatgctggatactatggatatgcccaaggttatgagaattatggttatgcggctgctgctccgcaagaccctagcatgtactacggaggatatccaggatatggaaattatcagcagccccagcaaccacagcag

SEQ ID NO: 1886 - protein, 413 aa, Citrus clementina
  clementine0.9_011566m
MMQPAPGAVPPPPPPMAAHQYQYQQQAPPQQQPPPQPSPYMMMMPPQPQAQPPAMWATHAAAPQAAGVAVPPQQQGQPGEIRTLWIGDLQYWMDETYLNTCFAHTGEVVAVKVIRNKQTGQIEGYGFIEFISRAGAERVLQTYNGTPMPNGEQNFRLNWASFGAGEKRDDTPDHTIFVGDLAADVTDYMLQETFRARYPSTKGAKVVIDRLTGRTKGYGFVRFGDESEQLRAMTEMNGVFCSTRPMRIGPATNKKTVSGQQQYPKASYQNSQVAQSDDDPNNTTVFVGNLDSIVTDEHLRELFSQYGQLVHVKIPAGKRCGFVQFADRSCAEEALRMLNGTQLGGQNIRLSWGRSPSNKQAQPDPNQWNAGYYGYAQGYENYGYAAAAPQDPSMYYGGYPGYGNYQQPQQPQQ

SEQ ID NO: 1887 - DNA, 1218 bp, Citrus clementina
  clementine0.9_011807m
atgatgcagccagcgcccggagcggtcccacccccgccaccaccgatggccgctcaccagtaccaataccaacaacaggcgccgcctcagcagcagccgccaccgcaaccctcgccgtacatgatgatgatgccgcctcagccccaggcccagcctcctgccatgtgggccacgcatgctgctgctcctcaggcagcgggagttgcggtaccgcctcagcagcagggtcagcccggtgagatccggaccctgtggatcggggacttgcagtattggatggatgagacctatctcaacacttgttttgcacacaccggcgaggttgtcgctgtaaaagtaattcgtaataagcaaactggtcaaatagaaggttatggatttattgagtttatttcgcgtgctggtgctgaaagagttttgcagacatataacggtacccctatgccaaacggtgagcagaacttcaggctaaactgggcatcttttggtgctggcgagaagcgcgatgacacccctgaccacacaatatttgttggagatttggctgctgacgttactgattacatgcttcaagagaccttcagggcccgctatccctctactaaaggtgcaaaggttgtcattgataggcttactggacgcacaaagggttatggatttgtgagatttggtgatgaaagtgaacagctacgtgccatgactgagatgaatggtgtcttttgttctacgagaccaatgcggattggtccagctactaataagaaaactgtttcagcttcatatcagaattctcaagtggcacagagtgatgacgatccaaataatacaacggtgtttgttggtaatctggactctattgttacggatgaacatttgagagaactgttcagccaatatgggcaactagtacatgtgaaaataccagcaggcaagcgatgtggatttgttcaatttgctgacagaagttgtgcagaggaagcattgagaatgttaaatggaactcagttgggaggacaaaatatccggctatcatggggacgtagtccttcaaacaaacaggctcagccagacccaaaccagtggaatgctggatactatggatatgcccaaggttatgagaattatggttatgcggctgctgctccgcaagaccctagcatgtactacggaggatatccaggatatggaaattatcagcagccccagcaaccacagcag

SEQ ID NO: 1888 - protein, 406 aa, Citrus clementina
  clementine0.9_011807m
MMQPAPGAVPPPPPPMAAHQYQYQQQAPPQQQPPPQPSPYMMMMPPQPQAQPPAMWATHAAAPQAAGVAVPPQQQGQPGEIRTLWIGDLQYWMDETYLNTCFAHTGEVVAVKVIRNKQTGQIEGYGFIEFISRAGAERVLQTYNGTPMPNGEQNFRLNWASFGAGEKRDDTPDHTIFVGDLAADVTDYMLQETFRARYPSTKGAKVVIDRLTGRTKGYGFVRFGDESEQLRAMTEMNGVFCSTRPMRIGPATNKKTVSASYQNSQVAQSDDDPNNTTVFVGNLDSIVTDEHLRELFSQYGQLVHVKIPAGKRCGFVQFADRSCAEEALRMLNGTQLGGQNIRLSWGRSPSNKQAQPDPNQWNAGYYGYAQGYENYGYAAAAPQDPSMYYGGYPGYGNYQQPQQPQQ

SEQ ID NO: 1889 - DNA, 1062 bp, Citrus clementina
  clementine0.9_014256m
atgatgcagccagcgcccggagcggtcccacccccgccaccaccgatggccgctcaccagtaccaataccaacaacaggcgccgcctcagcagcagccgccaccgcaaccctcgccgtacatgatgatgatgccgcctcagccccaggcccagcctcctgccatgtgggccacgcatgctgctgctcctcaggcagcgggagttgcggtaccgcctcagcagcagggtcagcccggtgagatccggaccctgtggatcggggacttgcagtattggatggatgagacctatctcaacacttgttttgcacacaccggcgaggttgtcgctgtaaaagtaattcgtaataagcaaactggtcaaatagaaggttatggatttattgagtttatttcgcgtgctggtgctgaaagagttttgcagacatataacggtacccctatgccaaacggtgagcagaacttcaggctaaactgggcatcttttggtgctggcgagaagcgcgatgacacccctgaccacacaatatttgttggagatttggctgctgacgttactgattacatgcttcaagagaccttcagggcccgctatccctctactaaaggtgcaaaggttgtcattgataggcttactggacgcacaaagggttatggatttgtgagatttggtgatgaaagtgaacagctacgtgccatgactgagatgaatggtgtcttttgttctacgagaccaatgcggattggtccagctactaataagaaaactgtttcaggtcagcagcagtaccctaaagcttcatatcagaattctcaagtggcacagagtgatgacgatccaaataatacaacggtgtttgttggtaatctggactctattgttacggatgaacatttgagagaactgttcagccaatatgggcaactagtacatgtgaaaataccagcaggcaagcgatgtggatttgttcaatttgctgacaggcaattgtgcagaggaagcattgagaatgttaaatggaactcagttgggaggacaaaatatccggctatcatggggacg

SEQ ID NO: 1890 - protein, 354 aa, Citrus clementina
  clementine0.9_014256m
MMQPAPGAVPPPPPPMAAHQYQYQQQAPPQQQPPPQPSPYMMMMPPQPQAQPPAMWATHAAAPQAAGVAVPPQQQGQPGEIRTLWIGDLQYWMDETYLNTCFAHTGEVVAVKVIRNKQTGQIEGYGFIEFISRAGAERVLQTYNGTPMPNGEQNFRLNWASFGAGEKRDDTPDHTIFVGDLAADVTDYMLQETFRARYPSTKGAKVVIDRLTGRTKGYGFVRFGDESEQLRAMTEMNGVFCSTRPMRIGPATNKKTVSGQQQYPKASYQNSQVAQSDDDPNNTTVFVGNLDSIVTDEHLRELFSQYGQLVHVKIPAGKRCGFVQFADRQLCRGSIENVKWNSVGRTKYPAIMGT

SEQ ID NO: 1891 - DNA, 915 bp, Citrus clementina
  clementine0.9_016790m
atgatgcagccagcgcccggagcggtcccacccccgccaccaccgatggccgctcaccagtaccaataccaacaacaggcgccgcctcagcagcagccgccaccgcaaccctcgccgtacatgatgatgatgccgcctcagccccaggcccagcctcctgccatgtgggccacgcatgctgctgctcctcaggcagcgggagttgcggtaccgcctcagcagcagggtcagcccggtgagatccggaccctgtggatcggggacttgcagtattggatggatgagacctatctcaacacttgttttgcacacaccggcgaggttgtcgctgtaaaagtaattcgtaataagcaaactggtcaaatagaaggttatggatttattgagtttatttcgcgtgctggtgctgaaagagttttgcagacatataacggtacccctatgccaaacggtgagcagaacttcaggctaaactgggcatcttttggtgctggcgagaagcgcgatgacacccctgaccacacaatatttgttggagatttggctgctgacgttactgattacatgcttcaagagaccttcagggcccgctatccctctactaaaggtgcaaaggttgtcattgataggcttactggacgcacaaagggttatggatttgtgagatttggtgatgaaagtgaacagctacgtgccatgactgagatgaatggtgtcttttgttctacgagaccaatgcggattggtccagctactaataagaaaactgtttcaggtcagcagcagtaccctaaaggtactttcttggtggttggtacaggattttgtctgcaaattaagtttaaatttaagtacttcattggatggctgatctttatcattatttttttcaatatctctacatccagcacacat

SEQ ID NO: 1892 - protein, 305 aa, Citrus clementina
  clementine0.9_016790m
MMQPAPGAVPPPPPPMAAHQYQYQQQAPPQQQPPPQPSPYMMMMPPQPQAQPPAMWATHAAAPQAAGVAVPPQQQGQPGEIRTLWIGDLQYWMDETYLNTCFAHTGEVVAVKVIRNKQTGQIEGYGFIEFISRAGAERVLQTYNGTPMPNGEQNFRLNWASFGAGEKRDDTPDHTIFVGDLAADVTDYMLQETFRARYPSTKGAKVVIDRLTGRTKGYGFVRFGDESEQLRAMTEMNGVFCSTRPMRIGPATNKKTVSGQQQYPKGTFLVVGTGFCLQIKFKFKYFIGWLIFIIIFFNISTSSTH

SEQ ID NO: 1893 - DNA, 1227 bp, Populus trichocarpa
  POPTR_0004s01690.1
atgatgcagcaaccaggaccaggaggagccatgctaccccaacaacaacaaccaccacagcaataccagcaacctccttacatgatgatgatgccgccaccaccaatggctcaaacccaacctccaccaccacacatgtgggctcaacatcaggcccatcaggcttctattccaccaccacagcaacaacagggacagggacaacctcctgctactgctgatgaggtcaggactctttggattggtgacttgcagtactggatggatgagaactatattgctagctgttttgctcatactggagaggttgcttctgtgaaaatcattcgtaataagcaaacttctcaaatcgaaggttatggatttattgagatgaccagtcatggggctgcagaaaggatattgcagacttataatggtaccccaatgccaaatggcgagcagaactttaggctgaactgggcttcttttagtgggggtgataagcgtgatgattctcctgacttcactatatttgtgggagacttggctgctgatgttacagatttcatgctccaagagacattcagggcccactttccctcagtgaagggtgcaaaggtggtgattgataggctcactggacgcacaaagggttatggatttgttcgttttggagatgaaagtgaacagctacgtgctatgaccgagatgaatggggcattttgttcgacaaggcctatgcgagtagggcttgcttcaaacaagaaggctgtggttggtcagcaatatccaaaagcttcatatcagaatcctcagcctcagaacgacggcgaccctaataatacaactatatttgttggtaatttggattctaatgttatggatgatcatttgaaagaactctttggccaatatggacaattattgcatgtgaagatacctgcaggcaagagatgtgggtttgttcagtttgctgacaggagctctgcagaagaagcactgaaaatgttaaatggagctcagttgagcggacagaatattcgattgtcatggggccgtaatccttcaaataaacaggctcagccagatgcaaaccagtatggtggtggatactatggatatggacaacagggatatgaaaattatgggtatgccccagctactcaggaccccaatatgtactacggaggttatcctggttatgggaactatcagcagggccagcagcagcaagtaggatatagc

SEQ ID NO: 1894 - protein, 409 aa, Populus trichocarpa
  POPTR_0004s01690.1
MMQQPGPGGAMLPQQQQPPQQYQQPPYMMMMPPPPMAQTQPPPPHMWAQHQAHQASIPPPQQQQGQGQPPATADEVRTLWIGDLQYWMDENYIASCFAHTGEVASVKIIRNKQTSQIEGYGFIEMTSHGAAERILQTYNGTPMPNGEQNFRLNWASFSGGDKRDDSPDFTIFVGDLAADVTDFMLQETFRAHFPSVKGAKVVIDRLTGRTKGYGFVRFGDESEQLRAMTEMNGAFCSTRPMRVGLASNKKAVVGQQYPKASYQNPQPQNDGDPNNTTIFVGNLDSNVMDDHLKELFGQYGQLLHVKIPAGKRCGFVQFADRSSAEEALKMLNGAQLSGQNIRLSWGRNPSNKQAQPDANQYGGGYYGYGQQGYENYGYAPATQDPNMYYGGYPGYGNYQQGQQQQVGYS

SEQ ID NO: 1895 - DNA, 1281 bp, Eucalyptus grandis
  Eucgr.D01310.1
atgatgcaaccatctgcaaccggcatggtccctcccccgctcgatcagcagcagcagcagcagcagcagcagcagtaccaataccagcagcagccgccgcagcaaccgccgcagcagccgtcgcagcagccgccgccgccgcagccctacatgatgatgccccccgccggccacccttcccaggccccgccgccgccgcagatgtgggccgcccaccagcccctccccgcgatgccccagcaggccgctcccggcggcggcggcgacgaggtgcgcaccctctggatcggggacctgcagtactggatggacgaggcctatctcggcacctgcttcgccgccaccggagaggtggccaacgtaaaggttatcaggaacaagcagacaatgcaaccagaaggttatggtttcattgagttttacactcgggcagcagccgaaagagtactgcagacgtacaatggtgcaatcatgcccaatggtggacagagctttagactgaactgggctagtgctggtgaaaagcgtgcggacgatacccctgactatacaatttttgtgggggacttggcttcagatgttacggactatatgttgcaagagatgttcagaggacgctatccttctgttaggagtgcaaaagtagtaatggacaggcttacgagccgtacaaagggttatgggtttgttaagttcggagatgaaagtgagcagatacgtgctatgagtgagatgaatggagtcttcctttcaacaagaccgatgagaattggacttgccacaaataagaagatcgctactgggcaacagtatcaaaaagcatcttaccagaacactcaagttactccaaatgagactgatcccaataataaaactgtatttgttggtggtctagatcccaatgtgactgatgaccacttgagacaagtttttggacaatacggcgaaattgtccaggtgaagataccacctggaaagcggtgtggatttgttcagtttgctgataggagctgcgcggaagaagctttgcgaatgttgaatggaacccagctgggaggacagaacattaggctttcatggggccggagtcctgcaaacaaacagccacagtcagatcctagccagtatggagggtattacggatatgctgctggttatgaaaactatggatatggtgcagcttcgcaagatgctaacatgtactatggcggttatgctggatatgcaaattatcagcagccccagcagcaacagcagcaacagcaacaattaggttacagt

SEQ ID NO: 1896 - protein, 427 aa, Eucalyptus grandis
  Eucgr.D01310.1
MMQPSATGMVPPPLDQQQQQQQQQQYQYQQQPPQQPPQQPSQQPPPPQPYMMMPPAGHPSQAPPPPQMWAAHQPLPAMPQQAAPGGGGDEVRTLWIGDLQYWMDEAYLGTCFAATGEVANVKVIRNKQTMQPEGYGFIEFYTRAAAERVLQTYNGAIMPNGGQSFRLNWASAGEKRADDTPDYTIFVGDLASDVTDYMLQEMFRGRYPSVRSAKVVMDRLTSRTKGYGFVKFGDESEQIRAMSEMNGVFLSTRPMRIGLATNKKIATGQQYQKASYQNTQVTPNETDPNNKTVFVGGLDPNVTDDHLRQVFGQYGEIVQVKIPPGKRCGFVQFADRSCAEEALRMLNGTQLGGQNIRLSWGRSPANKQPQSDPSQYGGYYGYAAGYENYGYGAASQDANMYYGGYAGYANYQQPQQQQQQQQQLGYS

SEQ ID NO: 1897 - DNA, 810 bp, Eucalyptus grandis
  Eucgr.D01313.1
atgcccaatggtggagagagctttagactgaactgggctagtgctagtgaaaaacgtgcggacgatacccctgactatacaatttttgtgggggacttggcttcagatgttacggactacatgttgcaagagatgttcagaggacgctatccttctgttaggagtgcaaaagtagtaatggacaggcttacgagccgtacaaagggttatgggtttgttaagtttggagatgaaagtgagcagatacgtgctatgagtgagatgaatggagtcttcctttcaacaagaccgatgagaattggacttgccacaaataagaaaatcgctactgggcaacagtatcaaaaagcatcttaccagaacactcaagttactccaaatgagactgatcccaataataaaactgtatttgttggtggtctagatcccaatgtgactgatgaccacttgagacaagtttttggacaatacggcgaaattgtccaggtgaagataccacctggaaagcggtgcggatttgttcagtttgctgataggagctgcgcggaagaagctttgcgaatgttgaatggaacccagctgggaggacagaacattaggctttcatggggccggagtcctgcaaataaacagccacagtcagatcctagccagtatggagggtattacggatatgctgctggttatgaaaactatggatatggtgcagcttcgcaagatgctaacatgtactatggcggttacgctggatatgcaaattatcagcagccccagcagcaacagcagcaacaacaacaattaggttacagt

SEQ ID NO: 1898 - protein, 270 aa, Eucalyptus grandis
  Eucgr.D01313.1
MPNGGESFRLNWASASEKRADDTPDYTIFVGDLASDVTDYMLQEMFRGRYPSVRSAKVVMDRLTSRTKGYGFVKFGDESEQIRAMSEMNGVFLSTRPMRIGLATNKKIATGQQYQKASYQNTQVTPNETDPNNKTVFVGGLDPNVTDDHLRQVFGQYGEIVQVKIPPGKRCGFVQFADRSCAEEALRMLNGTQLGGQNIRLSWGRSPANKQPQSDPSQYGGYYGYAAGYENYGYGAASQDANMYYGGYAGYANYQQPQQQQQQQQQLGYS

SEQ ID NO: 1899 - DNA, 810 bp, Eucalyptus grandis
  Eucgr.L02167.1
atgcccaatggtggacaaagctttagactgaactgggctagtgctagtgaaaaacgtgcggacgatacccctgaccatacaatttttgtgggggacttggcttcagatgttacggactacatgttgcaagagatgttcagaggacgctatccttctgttaggagtgcaaaagtagtaatggacaggcttacgagccgtacaaagggttatgggtttgttaagtttggagatgaaagtgagcagatacgtgctatgagtgagatgaatggagtcttcctttcaacaagaccgatgagaattggacttgccacaaataagaagatcgctactgggcaacagtatcaaaaagcatcttaccagaacactcaagttactccaaatgagactgatcccaataataaaactgtatttgttggtggtctagatcccaatgtgactgatgaccacttgagacaagtttttggacaatacagtgaaattgtccaggtgaagataccacctggaatgcggtgcggaattgttcagtttgctgataggagctgcgcggaagaagctttgcgaatgttgaatggaacccagctgggaggacagaacattaggctttcatggggccggagtcctgcaaacaaacagccacagtcagatcctagccagtatggagggtattacggatatgctgctggttatgaaaactatggatatggtgcagcttcgcaagatgctaacatgtactatggcggttacgctggatatgcaaattatcagcagccccagcagcaacagcagcaacaacaacaattaggttacagt

SEQ ID NO: 1900 - protein, 270 aa, Eucalyptus grandis
  Eucgr.L02167.1
MPNGGQSFRLNWASASEKRADDTPDHTIFVGDLASDVTDYMLQEMFRGRYPSVRSAKVVMDRLTSRTKGYGFVKFGDESEQIRAMSEMNGVFLSTRPMRIGLATNKKIATGQQYQKASYQNTQVTPNETDPNNKTVFVGGLDPNVTDDHLRQVFGQYSEIVQVKIPPGMRCGIVQFADRSCAEEALRMLNGTQLGGQNIRLSWGRSPANKQPQSDPSQYGGYYGYAAGYENYGYGAASQDANMYYGGYAGYANYQQPQQQQQQQQQLGYS

SEQ ID NO: 1901 - DNA, 900 bp, Eucalyptus grandis
  Eucgr.D01310.2
atgatgcaaccatctgcaaccggcatggtccctcccccgctcgatcagcagcagcagcagcagcagcagcagcagtaccaataccagcagcagccgccgcagcaaccgccgcagcagccgtcgcagcagccgccgccgccgcagccctacatgatgatgccccccgccggccacccttcccaggccccgccgccgccgcagatgtgggccgcccaccagcccctccccgcgatgccccagcaggccgctcccggcggcggcggcgacgaggtgcgcaccctctggatcggggacctgcagtactggatggacgaggcctatctcggcacctgcttcgccgccaccggagaggtggccaacgtaaaggttatcaggaacaagcagacaatgcaaccagaaggttatggtttcattgagttttacactcgggcagcagccgaaagagtactgcagacgtacaatggtgcaatcatgcccaatggtggacagagctttagactgaactgggctagtgctggtgaaaagcgtgcggacgatacccctgactatacaatttttgtgggggacttggcttcagatgttacggactatatgttgcaagagatgttcagaggacgctatccttctgttaggagtgcaaaagtagtaatggacaggcttacgagccgtacaaagggttatgggtttgttaagttcggagatgaaagtgagcagatacgtgctatgagtgagatgaatggagtcttcctttcaacaagaccgatgagaattggacttgccacaaataagaagatcgctactgggcaacagtatcaaaaaggctgtcgagaggctctatcatataggggcctggaactgatttcagatgaaatggttgtccttttagtccgtggcctcgct

SEQ ID NO: 1902 - protein, 300 aa, Eucalyptus grandis
  Eucgr.D01310.2
MMQPSATGMVPPPLDQQQQQQQQQQYQYQQQPPQQPPQQPSQQPPPPQPYMMMPPAGHPSQAPPPPQMWAAHQPLPAMPQQAAPGGGGDEVRTLWIGDLQYWMDEAYLGTCFAATGEVANVKVIRNKQTMQPEGYGFIEFYTRAAAERVLQTYNGAIMPNGGQSFRLNWASAGEKRADDTPDYTIFVGDLASDVTDYMLQEMFRGRYPSVRSAKVVMDRLTSRTKGYGFVKFGDESEQIRAMSEMNGVFLSTRPMRIGLATNKKIATGQQYQKGCREALSYRGLELISDEMVVLLVRGLA

SEQ ID NO: 1903 - DNA, 1191 bp, Glycine max
  Glyma07g38940.1
atgatgcaggctggacccggcggcatggcccaacaagcgaaccaacaatacgcacagcaacagcaacaaccctacatgatgatgccgccgcagcctcagccccctcagatgtgggccacatcggcccagcctccgtcccagtcggtggctcctccgcaacccaccagcgccgatgaggtccgtaccctctggatcggtgatttgcagtactggatggacgaaaattatctctacacctgtttggcacacaccggcgaggtggcttcagttaaagtcattcggaacaaacaaactagtcaatcggagggatatgggtttattgagtttactagtcgtgctggtgctgagagagtccttcaaacatacaatggcaccattatgccaaatggcgggcagaacttcagattgaactgggcaactcttagtgcaggtgagaggcgtcacgatgatagcccagatcacaccatatttgttggagacctggctgccgatgttacggattatcttcttcaagagacatttcgggcacgatatccctcaattaagggggccaaagttgtaattgataggctaactggacggacaaagggttatggttttgttaggtttggagatgagagtgaacaggttagagctatgactgaaatgcaaggggttctttgttcaacaaggcccatgcgaattggaccagcctctaataaaaaccctagcactcagtctcagccaaaagcatcatatcagaatcctcaaggggcacagaacgagcatgatccaaataatacaactatttttgtcggcaatttggatcctaacgtcacggatgaccatttgagacaagtttttgggcattatggagagttagttcatgtgaagattccagctggcaagcgatgtggatttgtccaatttgcggaccggagctgtgcggaagaggcactgcgggttttgaatggcacacttctaggcggacaaaatgttaggctttcatgggggcgaagtccttcaaacaaacaggctcaaccagatgcaaaccagtggaatggtagtggtggtggatactacggatatgctcaggggggctatgaaaattatggttatgcccctgctggacaggaccccaatatgtatggcagttatcctgggtatgcgaattaccaacctccccagcaacagcagcaaataggatatagc

SEQ ID NO: 1904 - protein, 397 aa, Glycine max
  Glyma07g38940.1
MMQAGPGGMAQQANQQYAQQQQQPYMMMPPQPQPPQMWATSAQPPSQSVAPPQPTSADEVRTLWIGDLQYWMDENYLYTCLAHTGEVASVKVIRNKQTSQSEGYGFIEFTSRAGAERVLQTYNGTIMPNGGQNFRLNWATLSAGERRHDDSPDHTIFVGDLAADVTDYLLQETFRARYPSIKGAKVVIDRLTGRTKGYGFVRFGDESEQVRAMTEMQGVLCSTRPMRIGPASNKNPSTQSQPKASYQNPQGAQNEHDPNNTTIFVGNLDPNVTDDHLRQVFGHYGELVHVKIPAGKRCGFVQFADRSCAEEALRVLNGTLLGGQNVRLSWGRSPSNKQAQPDANQWNGSGGGYYGYAQGGYENYGYAPAGQDPNMYGSYPGYANYQPPQQQQQIGYS

SEQ ID NO: 1905 - DNA, 1206 bp, Glycine max
  Glyma17g01800.1
atgatgcaggctggacccggcggcatggcccaacaagcgaaccagcaatacgcacagcaacagcaacaacaacaacaacaagcctacatgatgatgccgccgcagcctcagccccctcagatgtgggccccatcggcccagcctccgtcccaatcggtagctcctccgcaacccaccagcgccgatgaggtccgtaccctctggatcggcgatttgcagtactggatggacgaaaattatctctatacctgtttcgcacacaccggcgagctggcttcagttaaagtcattaggaacaaacaaactagtcaatcggagggatatgggtttattgagtttactagtcgagctggtgccgagagagtccttcaaacatacaatggcaccattatgccgaatggcgggcagaacttcagattgaactgggcaacttttagtgcaggtgagaggcgtcatgatgacagcccggatcacaccatatttgttggagacctggctgcagatgttacggattatcttctgcaagagacatttcgggcacgatatccttcagctaagggggccaaagttgtaattgataggttaactggacggacaaagggctatggttttgttaggtttggagatgagagtgaacaggttagggctatgagtgaaatgcaaggggttctttgttcaacaaggcccatgcgaattggaccagcctctaataaaaaccctagcactcagtctcagccaaaagcatcatatcagaatcctcaaggggcacagaacgagcatgatccaaataataccactatttttgttgggaatttggatcctaacgtcacggatgatcatctgagacaagtttttgggcagtatggggagttagttcatgtgaagattccagctggcaagagatgtggatttgtccaatttgcggacaggagctgtgcagaagaggcactgcgggttttgaatggcacacttttaggcggacaaaatgttcggctttcatggggccgaagtccttcaaacaaacaggctcaaccagatgcaaaccagtggaatggtagtggtggtggtggatactatggatatgcgcaggggggctatgaaaattacggttatgcccctgctggacaggatcccaatatgtatggcagttatcctggctatgcaaattaccaaccaccccagcaaccgcagcaaataggatatagc

SEQ ID NO: 1906 - protein, 402 aa, Glycine max
  Glyma17g01800.1
MMQAGPGGMAQQANQQYAQQQQQQQQQAYMMMPPQPQPPQMWAPSAQPPSQSVAPPQPTSADEVRTLWIGDLQYWMDENYLYTCFAHTGELASVKVIRNKQTSQSEGYGFIEFTSRAGAERVLQTYNGTIMPNGGQNFRLNWATFSAGERRHDDSPDHTIFVGDLAADVTDYLLQETFRARYPSAKGAKVVIDRLTGRTKGYGFVRFGDESEQVRAMSEMQGVLCSTRPMRIGPASNKNPSTQSQPKASYQNPQGAQNEHDPNNTTIFVGNLDPNVTDDHLRQVFGQYGELVHVKIPAGKRCGFVQFADRSCAEEALRVLNGTLLGGQNVRLSWGRSPSNKQAQPDANQWNGSGGGGYYGYAQGGYENYGYAPAGQDPNMYGSYPGYANYQPPQQPQQIGYS

SEQ ID NO: 1907 - DNA, 1227 bp, Glycine max
  Glyma13g27570.1
atgatgcagcagccaggacccggcatggcacctcccaccatgggccagcagccgccgcaacagtaccagcagcctccgccgcagcagcagcaaccctacgtcatgatgccgccgcaggcccaggccccgcaggccatgtgggccccctccgcccagcctccgcctcagcagcagcccgccagcgccgacgaggtccgaaccctctggatcggggatctgcagtactggatggacgagaactatctctatacctgctttgctcacaccggcgaggttacatcggttaaagtaattcgaaacaagcaaactagtcaatctgaaggttatgggtttattgagtttaatagtcgtgctggagctgagagaattcttcaaacatataatggggcaataatgccaaatggggggcagagtttcaggttgaattgggcaacttttagtgctggtgagaggtcgcgccacgacgattctccagattacaccatatttgttggtgacttggctgcagatgttactgattatcttcttcaggagacatttagggctcgttataactcggtgaagggtgcaaaagttgtcattgataggctaactggccggaccaagggatatggctttgtaaggttttcagatgagagtgagcaagtgagggctatgactgagatgcaaggggttctttgctcaacaagacccatgaggattggacccgcctctaataaaacccccaccactcagtcccagcccaaagcttcatatcagaattctcaacctcaaggttcacagaatgagaatgatccaaataatacaactatttttgttggtaatttggatcctaatgtcactgatgatcatctgaggcaagttttcagccagtatggagaattagtgcatgtgaagattccagcaggcaagcgatgtgggtttgtccaattcgcagacaggagctgtgccgaagaggcacttcgggtgttgaatgggaccctgttgggtggtcaaaatgttcgtctttcatggggccgcagtccttcaaacaaacaggctcaggcagatccaaaccagtggaatggtggtgctggttctggtggtggatactatgggtatgctgcacaaggttatgaaaattatgggtatgctcctgctgctggacaggatcccaacatgtatggcagttatccggggtatcctggttaccaaccacctcagcaacagcaacaaataggatatagt

SEQ ID NO: 1908 - protein, 409 aa, Glycine max
  Glyma13g27570.1
MMQQPGPGMAPPTMGQQPPQQYQQPPPQQQQPYVMMPPQAQAPQAMWAPSAQPPPQQQPASADEVRTLWIGDLQYWMDENYLYTCFAHTGEVTSVKVIRNKQTSQSEGYGFIEFNSRAGAERILQTYNGAIMPNGGQSFRLNWATFSAGERSRHDDSPDYTIFVGDLAADVTDYLLQETFRARYNSVKGAKVVIDRLTGRTKGYGFVRFSDESEQVRAMTEMQGVLCSTRPMRIGPASNKTPTTQSQPKASYQNSQPQGSQNENDPNNTTIFVGNLDPNVTDDHLRQVFSQYGELVHVKIPAGKRCGFVQFADRSCAEEALRVLNGTLLGGQNVRLSWGRSPSNKQAQADPNQWNGGAGSGGGYYGYAAQGYENYGYAPAAGQDPNMYGSYPGYPGYQPPQQQQQIGYS

SEQ ID NO: 1909 - DNA, 1200 bp, Glycine max
  Glyma13g27570.2
atgatgcagcagccaggacccggcatggcacctcccaccatgggccagcagccgccgcaacagtaccagcagcctccgccgcagcagcagcaaccctacgtcatgatgccgccgcaggcccaggccccgcaggccatgtgggccccctccgcccagcctccgcctcagcagcagcccgccagcgccgacgaggtccgaaccctctggatcggggatctgcagtactggatggacgagaactatctctatacctgctttgctcacaccggcgaggttacatcggttaaagtaattcgaaacaagcaaactagtcaatctgaaggttatgggtttattgagtttaatagtcgtgctggagctgagagaattcttcaaacatataatggggcaataatgccaaatggggggcagagtttcaggttgaattgggcaacttttagtgctggtgagaggtcgcgccacgacgattctccagattacaccatatttgttggtgacttggctgcagatgttactgattatcttcttcaggagacatttagggctcttgtcattgataggctaactggccggaccaagggatatggctttgtaaggttttcagatgagagtgagcaagtgagggctatgactgagatgcaaggggttctttgctcaacaagacccatgaggattggacccgcctctaataaaacccccaccactcagtcccagcccaaagcttcatatcagaattctcaacctcaaggttcacagaatgagaatgatccaaataatacaactatttttgttggtaatttggatcctaatgtcactgatgatcatctgaggcaagttttcagccagtatggagaattagtgcatgtgaagattccagcaggcaagcgatgtgggtttgtccaattcgcagacaggagctgtgccgaagaggcacttcgggtgttgaatgggaccctgttgggtggtcaaaatgttcgtctttcatggggccgcagtccttcaaacaaacaggctcaggcagatccaaaccagtggaatggtggtgctggttctggtggtggatactatgggtatgctgcacaaggttatgaaaattatgggtatgctcctgctgctggacaggatcccaacatgtatggcagttatccggggtatcctggttaccaaccacctcagcaacagcaacaaataggatatagt

SEQ ID NO: 1910 - protein, 400 aa, Glycine max
  Glyma13g27570.2
MMQQPGPGMAPPTMGQQPPQQYQQPPPQQQQPYVMMPPQAQAPQAMWAPSAQPPPQQQPASADEVRTLWIGDLQYWMDENYLYTCFAHTGEVTSVKVIRNKQTSQSEGYGFIEFNSRAGAERILQTYNGAIMPNGGQSFRLNWATFSAGERSRHDDSPDYTIFVGDLAADVTDYLLQETFRALVIDRLTGRTKGYGFVRFSDESEQVRAMTEMQGVLCSTRPMRIGPASNKTPTTQSQPKASYQNSQPQGSQNENDPNNTTIFVGNLDPNVTDDHLRQVFSQYGELVHVKIPAGKRCGFVQFADRSCAEEALRVLNGTLLGGQNVRLSWGRSPSNKQAQADPNQWNGGAGSGGGYYGYAAQGYENYGYAPAAGQDPNMYGSYPGYPGYQPPQQQQQIGYS

SEQ ID NO: 1911 - DNA, 1233 bp, Glycine max
  Glyma15g11380.1
atgatgcagcagccaggacccggcatggcacctcccaccatgggccagcagccgcagcaacagtaccagcagcagcctccgccgcagcagcaacaaccctacgtcatgatgccgccgcagcatcaggcgccgcagcctatgtgggccccatccgcccagcctccgctgccgcagcagcctgctagcgccgacgaggtccgaaccctctggatcggggatctgcagtactggatggacgagaactatctctacacctgctttgctcataccggcgaggtttcgtcagttaaagtgattcggaacaagcaaactagtcaatctgaaggttatgggtttattgagtttaatagtcgtgctggagctgagagaattctccaaacatataatggggctattatgccgaatggggggcagagtttcaggttgaattgggcaacttttagtgccggtgagaggtcgcgtcaagatgattctcctgattacaccatatttgttggtgacttggctgcagatgttactgattatcttcttcaggagacattcagggctcgttacaactcggtgaagggtgcaaaagttgtcattgataggctaactggccgtaccaaggggtatggctttgtaaggttttcagaagagagtgagcaaatgagagctatgactgagatgcaaggggttctttgctcaacaagacccatgaggattggaccagcctctaataaaacccctgccactcagtcccagccaaaagcttcatatctgaattctcaacctcaaggctcacagaatgagaatgatccaaataatacgactatttttgttggcaatttggatcctaatgtaaccgatgatcatctgaggcaagttttcagccagtatggagaattagttcatgtgaagattccagcaggcaagcgatgtgggtttgtccaatttgcagacaggagctgtgctgaagaggcccttcgggtgttgaatgggacgctgttgggtggacaaaatgtgcgtctttcatggggtcgcagtccttcaaacaaacaggctcaggcagatccaaaccagtggaatggtgctgctggtgctggttctggtggtggatattatgggtatgctgctcaaggatatgaaaattatggttatgctcctgctggacaggatcccaacatgtatggcagttatccgggatatcctggttaccaagctcctcaacaacagcagcaaataggatatagt

SEQ ID NO: 1912 - protein, 411 aa, Glycine max
  Glyma15g11380.1
MMQQPGPGMAPPTMGQQPQQQYQQQPPPQQQQPYVMMPPQHQAPQPMWAPSAQPPLPQQPASADEVRTLWIGDLQYWMDENYLYTCFAHTGEVSSVKVIRNKQTSQSEGYGFIEFNSRAGAERILQTYNGAIMPNGGQSFRLNWATFSAGERSRQDDSPDYTIFVGDLAADVTDYLLQETFRARYNSVKGAKVVIDRLTGRTKGYGFVRFSEESEQMRAMTEMQGVLCSTRPMRIGPASNKTPATQSQPKASYLNSQPQGSQNENDPNNTTIFVGNLDPNVTDDHLRQVFSQYGELVHVKIPAGKRCGFVQFADRSCAEEALRVLNGTLLGGQNVRLSWGRSPSNKQAQADPNQWNGAAGAGSGGGYYGYAAQGYENYGYAPAGQDPNMYGSYPGYPGYQAPQQQQQIGYS

SEQ ID NO: 1913 - DNA, 1101 bp, Glycine max
  Glyma13g27570.3
atgatgcagcagccaggacccggcatggcacctcccaccatgggccagcagccgccgcaacagtaccagcagcctccgccgcagcagcagcaaccctacgtcatgatgccgccgcaggcccaggccccgcaggccatgtgggccccctccgcccagcctccgcctcagcagcagcccgccagcgccgacgaggtccgaaccctctggatcggggatctgcagtactggatggacgagaactatctctatacctgctttgctcacaccggcgaggttacatcggttaaagtaattcgaaacaagcaaactagtcaatctgaaggttatgggtttattgagtttaatagtcgtgctggagctgagagaattcttcaaacatataatggggcaataatgccaaatggggggcagagtttcaggttgaattgggcaacttttagtgctggtgagaggtcgcgccacgacgattctccagattacaccatatttgttggtgacttggctgcagatgttactgattatcttcttcaggagacatttagggctcgttataactcggtgaagggtgcaaaagttgtcattgataggctaactggccggaccaagggatatggctttgtaaggttttcagatgagagtgagcaagtgagggctatgactgagatgcaaggggttctttgctcaacaagacccatgaggattggacccgcctctaataaaacccccaccactcagtcccagcccaaagcttcatatcagaattctcaacctcaaggttcacagaatgagaatgatccaaataatacaactatttttgttggtaatttggatcctaatgtcactgatgatcatctgaggcaagttttcagccagtatggagaattagtgcatgtgaagattccagcagtccttcaaacaaacaggctcaggcagatccaaaccagtggaatggtggtgctggttctggtggtggatactatgggtatgctgcacaaggttatgaaaattatgggtatgctcctgctgctggacaggatcccaacatgtatggcagttatccggggtatcctggttaccaaccacctcagcaacagcaacaaa

SEQ ID NO: 1914 - protein, 367 aa, Glycine max
  Glyma13g27570.3
MMQQPGPGMAPPTMGQQPPQQYQQPPPQQQQPYVMMPPQAQAPQAMWAPSAQPPPQQQPASADEVRTLWIGDLQYWMDENYLYTCFAHTGEVTSVKVIRNKQTSQSEGYGFIEFNSRAGAERILQTYNGAIMPNGGQSFRLNWATFSAGERSRHDDSPDYTIFVGDLAADVTDYLLQETFRARYNSVKGAKVVIDRLTGRTKGYGFVRFSDESEQVRAMTEMQGVLCSTRPMRIGPASNKTPTTQSQPKASYQNSQPQGSQNENDPNNTTIFVGNLDPNVTDDHLRQVFSQYGELVHVKIPAVLQTNRLRQIQTSGMVVLVLVVDTMGMLHKVMKIMGMLLLLDRIPTCMAVIRGILVTNHLSNSNK

SEQ ID NO: 1915 - DNA, 1239 bp, Solanum lycopersicum
  Solyc02g080420.2.1
atgcaaccagcgaattccatggttccaccaccacagtaccagcagacacagcagtggatggctcagccgccgccgcagtatcaggttgcgcctccgcagcaatcgggatattactaccagcaacctcagcaacagggcggagttcctccaccccaacaacaacaacttcagtacaacgcctctggtttggctgctactgccggttctgttcagccgactagtgctgatgagatccgaagcctttggatcggagatctacagttttggatggatgagcaataccttctcaactgtttcgcacaaactggagaggtgacctctgctaaagttatccgtaacaagcaaagtggacaatcagagggttatggctttattgagtttattagtcatgctgctgcagaaaggaatctgcaagcatataatggtaccttgatgcctaatattgagcaaaatttcagactcaactgggcttcactcggttctggtgaaaaacgttctgataatggtcctgaatatacaatatttgttggtgacttggcagccgatgtttctgattatatgcttcaggagacatttagggctaactatccttctgtgaagggcgctaaggttgtaacagataaggccacggggcgcaccaagggttatggttttgttaagtttggggatgaaagtgagcagttgcgcgctatgactgagatgaatggacagttttgctccactaggcccatgcggattggtcccgcagctaacaagaagagtatgggtggtcaaagtcaagcttcgtatcaaagttcacctggaactcaaaatgaggacgacccatctaataccactatttttgttgggaacttggattccaatataacggatgaacatttaaggcagatttttggacactatgggcagttgcttcatgtaaaaataccagtaggcaagcggtgtggctttattcagtttgctgacagaagttgtgctgaggaagctctacgggtattaaatggaactcagctgggtggacaaagcatccgtctttcatggggtcgaagtcctgcaaacaagcagcagcctcagcttgatccaaaccaatatgctggttattatgggtatactgctggatatgaaggttatggttatgccccccctgctcaggatccaaatcagtattatgcgggctatgctggatatggaaattacgcacaacctcaacagcagcagcaagttttgcagcatcctcag

SEQ ID NO: 1916 - protein, 413 aa, Solanum lycopersicum
  Solyc02g080420.2.1
MQPANSMVPPPQYQQTQQWMAQPPPQYQVAPPQQSGYYYQQPQQQGGVPPPQQQQLQYNASGLAATAGSVQPTSADEIRSLWIGDLQFWMDEQYLLNCFAQTGEVTSAKVIRNKQSGQSEGYGFIEFISHAAAERNLQAYNGTLMPNIEQNFRLNWASLGSGEKRSDNGPEYTIFVGDLAADVSDYMLQETFRANYPSVKGAKVVTDKATGRTKGYGFVKFGDESEQLRAMTEMNGQFCSTRPMRIGPAANKKSMGGQSQASYQSSPGTQNEDDPSNTTIFVGNLDSNITDEHLRQIFGHYGQLLHVKIPVGKRCGFIQFADRSCAEEALRVLNGTQLGGQSIRLSWGRSPANKQQPQLDPNQYAGYYGYTAGYEGYGYAPPAQDPNQYYAGYAGYGNYAQPQQQQQVLQHPQ

SEQ ID NO: 1917 - DNA, 1233 bp, Solanum lycopersicum
  Solyc10g005260.2.1
atgcaaccggcggcaagttcaatggttccaccaccaatggcggcgcaaccacagtaccaacagcagtggatggctcagcagccgcagtaccaggttctgccaccgcaggccggttattattaccaaccaccaccgcagcagggtggcggagtacccccaccgcagcagcaacaacaacaatctcagtacacggcttcagctcagccgaccagtgctgatgaagtccggacgctttggattggagatctacagttttggatggatgagcagtacctatatagttgcttcgcgcaaactggagaggtggtttccgctaaagttatccgcaacaagcaaactcagcaatcagagggttatggctttattgagtttaatagtcatgctgctgcagaaaggaatctacaagcatacaatggcaccttgatgcctaatattgagcaaaattttaggctcaactgggcatcacttggttcgggtgaaaagcgttcagataacacccctgaatatacaatatttgttggagacttggcagctgatgtcacagattacatgcttcaggagacattcagacccaattatccttcaatcaagggtgctaaggttgtaacagatagggcaaccgggcacacaaagggttatgggtttgttagatttggggatgagagtgagcagttacgagctatgactgagatgaatggaaagttttgctccactaggcccatgcgcattggtcctgcagctaacaagaagaattctggtggtcagatgcaagcttcatatcaaagtactggaactcaaaatgaggatgaccctactaatacgacgattttcgttgggaacttggatgctagtgtaactgatgatcacctcaggcaggtttttgggaactatgggcaattgcttcatgtaaaaataccactaggcaaacgttgtggttttgttcaatttactgatagaagctgtgctgaggaagctctaaatgcattgagtggaactcagttgggtggacaaaccatccgcctttcatggggtcgtagcccttcaaacaagcagcagtctcagggtgatccgaaccagtggagtgggggttattatgggtatacaccaggatatgacgcctatggttatgcccaacctactcaggacccaaatatgtactatgcaggctatgccgggtatgggaattatgcacaacctccacatcaacagcaacaaatgccgcagcagcctcag

SEQ ID NO: 1918 - protein, 411 aa, Solanum lycopersicum
  Solyc10g005260.2.1
MQPAASSMVPPPMAAQPQYQQQWMAQQPQYQVLPPQAGYYYQPPPQQGGGVPPPQQQQQQSQYTASAQPTSADEVRTLWIGDLQFWMDEQYLYSCFAQTGEVVSAKVIRNKQTQQSEGYGFIEFNSHAAAERNLQAYNGTLMPNIEQNFRLNWASLGSGEKRSDNTPEYTIFVGDLAADVTDYMLQETFRPNYPSIKGAKVVTDRATGHTKGYGFVRFGDESEQLRAMTEMNGKFCSTRPMRIGPAANKKNSGGQMQASYQSTGTQNEDDPTNTTIFVGNLDASVTDDHLRQVFGNYGQLLHVKIPLGKRCGFVQFTDRSCAEEALNALSGTQLGGQTIRLSWGRSPSNKQQSQGDPNQWSGGYYGYTPGYDAYGYAQPTQDPNMYYAGYAGYGNYAQPPHQQQQMPQQPQ

SEQ ID NO: 1919 - DNA, 1215 bp, Solanum lycopersicum
  Solyc03g031720.2.1
atgcaaccagcgaattccatggttccacaaccaatggcggctccatcgcaacaacagtatcaacagcagccgcagcaacattggatggctcagcagcagccggcagcgtatcaggttccgcagcagcaatcggcgtattattaccagcaacagcaacaacctcagtacaacgccgcggcagctgctgctcaaccgaccagttccgatgagatccggagcttgtggatcggagatctacagttttggatggatgaacagtatatccagaactgcttcgctcacactggagaggtggcctctgttaaagttatccgcaacaagcaatctggacaatctgagggttatggatttgttgagtttattagtcatgcggctgctgaaagaaacctacaaacatataatggctccatgatgcctaatagtgagcaaccctttagactcaactgggcatcactcggttcgggtgaaaaacgttcagataatggtcctgaatacacaatttttgttggagacttggcagctgatgtcactgactatatgcttcaggagacattcagggccaactacccctcagtcaagggtgcaaaggttgtgactgatagggtcactgggcgcacaaagggctatgggtttgttaaatttgcagatgaaagtgagcaattgcatgctatgactgagatgaatggcaagttctgctccactaggccaatgcggataggccctgcagctaacaagaagagtgtacctggtcaggtgcaagcttcatatcaaagtaccaatggaactcaaaatgaggacgatccttctaatacaactatattcgttgggaatttggatgctaatgtaacagatgaccatctaaggcaggtttttggaaattatggacagttgcttcatgtgaaaataccagtaggcaaacgttgtggctttgttcaatttgctgacagaagttgtgctgaggaagctctacgagcattaagtggaactcagctgggtggacaaactatccgcctttcatggggtcgtagcccttccaacaagcagcagcctcaggctgacccaaaccaatacggtggttattatgggtattcagctggatatgatgctgccgctgctgctgcctatggttatgctcaacctgctcaggatccaaatctatattatgggggttacgctgggtatggaaattaccctccacagcagcaacaaccacag

SEQ ID NO: 1920 - protein, 405 aa, Solanum lycopersicum
  Solyc03g031720.2.1
MQPANSMVPQPMAAPSQQQYQQQPQQHWMAQQQPAAYQVPQQQSAYYYQQQQQPQYNAAAAAAQPTSSDEIRSLWIGDLQFWMDEQYIQNCFAHTGEVASVKVIRNKQSGQSEGYGFVEFISHAAAERNLQTYNGSMMPNSEQPFRLNWASLGSGEKRSDNGPEYTIFVGDLAADVTDYMLQETFRANYPSVKGAKVVTDRVTGRTKGYGFVKFADESEQLHAMTEMNGKFCSTRPMRIGPAANKKSVPGQVQASYQSTNGTQNEDDPSNTTIFVGNLDANVTDDHLRQVFGNYGQLLHVKIPVGKRCGFVQFADRSCAEEALRALSGTQLGGQTIRLSWGRSPSNKQQPQADPNQYGGYYGYSAGYDAAAAAAYGYAQPAQDPNLYYGGYAGYGNYPPQQQQPQ

SEQ ID NO: 1921 - DNA, 1194 bp, Arabidopsis thaliana
  AT3G05200.1
atgagaagctccgatcatatggcgtttgccggcgttttgccgattgttttcttgcttatattatcatcagcggatctagcagcgagtcaatcacagcccggtccaacaaatcaaccgtataactacggcagactaagtccagccatggcagtgatcgtcgtgatcctaatcgctgctctcttcttcatgggcttcttctctatctacttccgtcactgctcaggcgtaccagacgccggtgtttctccagctggtggagctagatccagagcaaccgtcaacgcggcggcgcgtggtctcgacgtttcagttgtcgagacttttcctacgttcttgtactcagatgtgaaaacgcagaagcttggtaaaggagagttagagtgtgcgatatgtttgaacgagttcgaagacgacgaaacgctgcgtttgcttcccaagtgtgatcacgtgtttcatccgcactgcatcgatgcttggctcgaggctcacgtgacttgtcccgtttgcagagcgaatcttgctgaacaggtagctgaaggtgagtcagttgaaccgggaggaactgaaccggatcttgaattgcagcaggttgtggtgaatcctgaaccggtggttactgcaccggtaccggaacaattggtgactagtgaagtcgattcgaggagattacctggtgtaccggtggatcttaaaagagttaaattctcgagatcgcatacgacgggacattcggtggttcaaccgggagaatgtaccgaacggtttactcttcggttaccggaagatgtgaggaagaggataatgaaggattggaaattgaaccggacgaatagtcttctggttcttcctagaggagggagttcgaggagaggtaaaccgattgaccggtcaagggctcggtctgatcgatggttgtttcgtaaaacgccttcgtttctgtggaggagtcgtgatgatggttcgattaggttaggtgctaccggtagcgttcgagccagtgctgtaccgaattcaaccggtagtgattcggtacgtgcaggagaccggtgggcttttcttagaaacgcgtcgtttttgtggaggaactcttcggtacatgtgccaagaggaggagtcaataaagacggcgaaggaacttcggttaaatcgaccggtgcaagtggctcaactagcggttcggtgagattaccggtt

SEQ ID NO: 1922 - protein, 398 aa, Arabidopsis thaliana
  AT3G05200.1
MRSSDHMAFAGVLPIVFLLILSSADLAASQSQPGPTNQPYNYGRLSPAMAVIVVILIAALFFMGFFSIYFRHCSGVPDAGVSPAGGARSRATVNAAARGLDVSVVETFPTFLYSDVKTQKLGKGELECAICLNEFEDDETLRLLPKCDHVFHPHCIDAWLEAHVTCPVCRANLAEQVAEGESVEPGGTEPDLELQQVVVNPEPVVTAPVPEQLVTSEVDSRRLPGVPVDLKRVKFSRSHTTGHSVVQPGECTERFTLRLPEDVRKRIMKDWKLNRTNSLLVLPRGGSSRRGKPIDRSRARSDRWLFRKTPSFLWRSRDDGSIRLGATGSVRASAVPNSTGSDSVRAGDRWAFLRNASFLWRNSSVHVPRGGVNKDGEGTSVKSTGASGSTSGSVRLPV

SEQ ID NO: 1923 - DNA, 1104 bp, Arabidopsis thaliana
  AT5G27420.1
atggatcccataaaacacatctctttaccagttcttgtcttgtttctactattatccgtgtcggcgggtcaacccggaaccccggaccagagacatgacccgtatgcttacagcggcagtctaagtccagccatggctgttgtcgttgtagttgtcatcgcagctctcttcttcatgggcttcttcaccgtctatatacgtcactgtactggcgcagtagacggtagcgttactcctgcaggaggagctaggaggagagtgacgaacgcaacggttgcgcgtgggttagacgcggagacgatcgagacgtttccgacttttgtttactcagaagtgaagacacagaagattggtaaaggagcgttggagtgtgcgatttgtttgaatgagtttgaagacgatgaaacgctgcgtctgttgcctaaatgtgatcacgtgtttcatcctcattgtatcggcgcgtggcttcaaggtcacgtgacttgtccggtttgtcggactaatcttgctgaacagacgcctgaaccggaagtggtggtggaaaccgatcttgaggcgcagcagcaatcggcggttcctgtaccggtggtggaacttccacgtgttaaattcccgaggtcgcatacgacagggcattcggtggttttaccgggagagagtaccgaccggtttacgcttagagtaccggaagaattaaggaagaagataatggcgaattggaaattgaaccggtcgaatagtgtttttgttttaccgagaggaggaagctcgaggagtggtaaacaggttgaccggtcgagggctaaatcggaccggtggttgttccgtaaaactccgtcgtttctatggaggaaccgggatgatggttcgattaggctaggtggtaccggtagtgttagaggaaattcagtaacaagtccgagcggtgactcggtacgagcagaccggtgggcttttcttagaaacccatcgtttctctggaggaatacgacgccggttccttcgccgagagttgaagtcaataataaggacggtgaaggaacatcgtcagttcaacatatcggtacagttggttcaactagcggttcccttaggctaccggtt

SEQ ID NO: 1924 - protein, 368 aa, Arabidopsis thaliana
  AT5G27420.1
MDPIKHISLPVLVLFLLLSVSAGQPGTPDQRHDPYAYSGSLSPAMAVVVVVVIAALFFMGFFTVYIRHCTGAVDGSVTPAGGARRRVTNATVARGLDAETIETFPTFVYSEVKTQKIGKGALECAICLNEFEDDETLRLLPKCDHVFHPHCIGAWLQGHVTCPVCRTNLAEQTPEPEVVVETDLEAQQQSAVPVPVVELPRVKFPRSHTTGHSVVLPGESTDRFTLRVPEELRKKIMANWKLNRSNSVFVLPRGGSSRSGKQVDRSRAKSDRWLFRKTPSFLWRNRDDGSIRLGGTGSVRGNSVTSPSGDSVRADRWAFLRNPSFLWRNTTPVPSPRVEVNNKDGEGTSSVQHIGTVGSTSGSLRLPV

SEQ ID NO: 1925 - DNA, 1062 bp, Brachypodium distachyon
  Bradi3g46500.1
atggccgcctcccgccgccgttccttcgcctccgctattttcacagtgatcgcgtcctgcgccgctgcgcagtcggcgggaggcccgggaccgaattacaactcgatgagtttgtccgacgtgatgaccatctccttcttcatggccattttcttccccatcttcgtcgtcttgctggcgttcgcctgcctccgcctgttccgcccaccagacgagcccgcggccgcggacgccgcctcgtcgcagtggtcgcacggccccaaggagggcctcgacgcctcggagatcgcggcgctaccgctggtgtcgtaccgggacgtcaaggagcaccggatcagcgccggcccgacggtggacccgctggagtgcgcggtgtgcctcctggaattcgaggacgacgacagcctccgcctcctcccgacgtgcccgcacgccttccacccggagtgcatcggctcctggctcgagaagcacgtcacgtgcccgctctgccgcgccaacgtcctcgacgcgccgccggatccacgggagctgctgcaggtcgtgcagcccccgtcgccgccacacgaaacggcggtggcgtcgccacccgactcgccgccggctcacgacacggtggtgctgatcggcgccgacgtcgagcgcagcgaggaggaggaggacgagatcaggtccaggatcgcgctcgctaggacgcagcgcgaggccgggcggcaggtgctgccgcggtccaactcgacggggcacgagcgcgccgggggcggcgggatggagcgattcgcgctgcggctgccggagcatgtccgcctcgagatcctaatgtcgcacaggctgaggcacgcgaccagcgcggtggcgtccgtgcgcgtcagggaagggagtgggtatgaccaaggcgcaggcgggaattcggtgcggagcgccgtggcgaggctgatttcgcttttcgcgcccggagcagggtggaagggcgacgacgaggacaggtcaggcgctggcgggtcgtctcgccggcggcgcgatgaatcggcgcggggagctggagaagagaagagaagcgat

SEQ ID NO: 1926 - protein, 354 aa, Brachypodium distachyon
  Bradi3g46500.1
MAASRRRSFASAIFTVIASCAAAQSAGGPGPNYNSMSLSDVMTISFFMAIFFPIFVVLLAFACLRLFRPPDEPAAADAASSQWSHGPKEGLDASEIAALPLVSYRDVKEHRISAGPTVDPLECAVCLLEFEDDDSLRLLPTCPHAFHPECIGSWLEKHVTCPLCRANVLDAPPDPRELLQVVQPPSPPHETAVASPPDSPPAHDTVVLIGADVERSEEEEDEIRSRIALARTQREAGRQVLPRSNSTGHERAGGGGMERFALRLPEHVRLEILMSHRLRHATSAVASVRVREGSGYDQGAGGNSVRSAVARLISLFAPGAGWKGDDEDRSGAGGSSRRRRDESARGAGEEKRSD

SEQ ID NO: 1927 - DNA, 1035 bp, Brachypodium distachyon
  Bradi3g46510.1
atggcctcctccggccgccgctccttcgtctccgcaatcctcccagcggtcgcgtcctgcgccgctgcgcagtcggcgggggcgaacaactcgataatgagtttctccaactcgatgaccgtctgcttcttcgtggccattttggccttccccatcctcgccgtcctcctggcgttcgcgtgcctccgtttgttccgaccgccagacgataatgatcccacggcctcggagtcgtcgtcgggcggccgacccagggagggcctcgacgcgtcggagatcgcggcgctgccgctggtgtcctaccgggacgtcaaggagcaccggatcagcgacggcctgacggtactggacccgctggagtgcgcggtgtgcctcctggaattcgaggacgacgacagcctccgcctgctcccgacgtgcccgcacgcgttccacccggagtgcatcggctcctggctcgagaggcacgtcacgtgcccgctctgccgcgccaacgtcctcgatcaggcgccaaaggagccacgggagctgccgctgccgccccaggaaacgtcggcttcttcttcgccgccagaagcgccgccggttcacgacgacacggtggacgtgttgatcggcgccgaggacgaagatgcggcgagggggcggcgagaggccaggcggcaggcggtgctgccgcggtcgaactcgacggggcacgagcgcgccggcggccgcgggatggagcggttcgcgctgcggctgccggagcacgtccgcctcgagatcctcatgtcgcacaggctgaggcacgtgacgagcgcggtggcgtccgtgcgcgtcagagaagggagcacacatgactaccccggcggggtcagcgtgggcgggaagccggggcggagcgccgtggcgaggctgctgtcgcttttcgctcccggagcagggtggaagggagacaacaacgaggacaggtccggcgccagcgggtcgtctcgccggtggtggcgcagggagcaggagaagaaaagagaagcgattaagaaaacggaacct

SEQ ID NO: 1928 - protein, 345 aa, Brachypodium distachyon
  Bradi3g46510.1
MASSGRRSFVSAILPAVASCAAAQSAGANNSIMSFSNSMTVCFFVAILAFPILAVLLAFACLRLFRPPDDNDPTASESSSGGRPREGLDASEIAALPLVSYRDVKEHRISDGLTVLDPLECAVCLLEFEDDDSLRLLPTCPHAFHPECIGSWLERHVTCPLCRANVLDQAPKEPRELPLPPQETSASSSPPEAPPVHDDTVDVLIGAEDEDAARGRREARRQAVLPRSNSTGHERAGGRGMERFALRLPEHVRLEILMSHRLRHVTSAVASVRVREGSTHDYPGGVSVGGKPGRSAVARLLSLFAPGAGWKGDNNEDRSGASGSSRRWWRREQEKKREAIKKTEP

SEQ ID NO: 1929 - DNA, 1044 bp, Oryza sativa
  LOC_Os02g36320.1
atgggcgtcgccgccgccaacgtcgccgccttcgttttgctggccatcgcgcccgtggccgccgcgccgtcgtcgccgcctcgatctggcggcgactccctgagtttctccgacgtgatcagcatctccttcttcatggccgtcttcttccccgtgttcatcgtcctcctcgcgttcgcgtgcctccgcctgttccggccgctcgacgacgacgacggcgagcccgcgctggcggacacgtcgtcgtcggagtggtcccgccgggggggagggggcggcaacagggcggggctcgacgccgcggagatcgcggcgctgccgctggtgtcgtaccgcgacgccaggcggcaccggatcggggacgcgcggggcgacccgctggagtgcgcggtgtgcctcctcgagttcgaagacgacgacgccctccgcctcctcccggcgtgcccgcacgcgttccatcccgagtgcatcggcctctggctcgagaagcacgtcacctgcccgctctgccgcgccaacgtcctcgacgcgccgccgccgccgccccctcccccgccttcgctggagcaggacacggcgtcgccgccgccggctcacgagacggtggtggtgatcggcgacgccggcgccagcgaggaggcggaagcggaagagaggatcaggatccagtgcctcgcgggggtccgtcgcgcggcggggcggcaggctctcccgcggtcgaactcgacggggcacgagcgcggcggcggcgggatggagcggttcgcgctgcggctgccggagcacgtccgcctcgagatcctcatgtcgcacaggctgaggcacgtgacgagcgcggtggcgtccgtgcgcgtcagggaggggagcgcccacgacgccggcgccgtgcggaacgccgtggcgaggctcctgtcgctgttcgtgcccggagccgggtggaagggagacgacgagggcaagtccagcaaggcggcggaagggtcgtctcgccggcggcgcgacgagtcggcgaggggaggagtcggagaagagaagaggagcgag

SEQ ID NO: 1930 - protein, 348 aa, Oryza sativa
  LOC_Os02g36320.1
MGVAAANVAAFVLLAIAPVAAAPSSPPRSGGDSLSFSDVISISFFMAVFFPVFIVLLAFACLRLFRPLDDDDGEPALADTSSSEWSRRGGGGGNRAGLDAAEIAALPLVSYRDARRHRIGDARGDPLECAVCLLEFEDDDALRLLPACPHAFHPECIGLWLEKHVTCPLCRANVLDAPPPPPPPPPSLEQDTASPPPAHETVVVIGDAGASEEAEAEERIRIQCLAGVRRAAGRQALPRSNSTGHERGGGGMERFALRLPEHVRLEILMSHRLRHVTSAVASVRVREGSAHDAGAVRNAVARLLSLFVPGAGWKGDDEGKSSKAAEGSSRRRRDESARGGVGEEKRSE

SEQ ID NO: 1931 - DNA, 1161 bp, Brachypodium distachyon
  Bradi5g11870.1
atgggggtggtgttgcgcgcacacctcctcgtcgctctctgcctcgtcggcgccggtggggcggccatggcgcagaattcggcgccgccgccgcgcgggcatgcgcagccgctgccgaagcagacgccgttcgggcgcgccatgtcgacggtcatcacggtggccatcagcgtcttcttcttcctgctcttcttctgcgcctacatcaaccagtgccgcctcgcgggcgaaggcggcggcgcgccgcgggggaccaacgttgcgggcgccggggccggggccggggcgtccaggagggggaagcgcgggctggaccccgcggtcgtggcgacgttccccatcatgccgtacagggagatcaaggagcacaagatcggcaggggcgtgctggagtgcgccgtgtgcctgaccgcgttcgaggaaggggacgacctccggctgctgccccactgctcgcacgcgttccacccggagtgcatcgacccctggctcgaggcgcgggtcacgtgcccgctgtgccgcgccaacctcgagaagccgccgccgcccccaacggcggcggctgtcgtgacgcccccttcgccagagcagatggcgccttcgcctgcgccatccccgccgccgcatgccgtggcggtggcgataccggtgcgggaagaggaggaggagagcgacgaggaggacaggaaggaggaggccatggagctcgagctgctccgcagcgagcggcgcgcggcgaggctgccgaggtcgcactcgacggggcactcgctctatgcggcgtccgcggccgccgcggaacgcagcgaccacgagaggttcacgctgcggctgccgcaccacgtgagggagcaggtgctcaggtcgcgccgcctgcgccacgccacgagcctgatcgacatctccggcttgagccccgaggggagctcgcgcggaggacggcgcgcagtgggaggaggcagcttcggcaacgccgaaggcggcagcagccatggcgggcggcggtggcaggcgttcctggccaggacgatgtcgtgggcccgagggggaggcgacggatcggtgcggaaggggtgggacggatcgactaggaggggaagggaggatgccgaatcgagcaggaaggggctggcttcgccttcgccggcggcggggcggcca

SEQ ID NO: 1932 - protein, 387 aa, Brachypodium distachyon
  Bradi5g11870.1
MGVVLRAHLLVALCLVGAGGAAMAQNSAPPPRGHAQPLPKQTPFGRAMSTVITVAISVFFFLLFFCAYINQCRLAGEGGGAPRGTNVAGAGAGAGASRRGKRGLDPAVVATFPIMPYREIKEHKIGRGVLECAVCLTAFEEGDDLRLLPHCSHAFHPECIDPWLEARVTCPLCRANLEKPPPPPTAAAVVTPPSPEQMAPSPAPSPPPHAVAVAIPVREEEEESDEEDRKEEAMELELLRSERRAARLPRSHSTGHSLYAASAAAAERSDHERFTLRLPHHVREQVLRSRRLRHATSLIDISGLSPEGSSRGGRRAVGGGSFGNAEGGSSHGGRRWQAFLARTMSWARGGGDGSVRKGWDGSTRRGREDAESSRKGLASPSPAAGRP

SEQ ID NO: 1933 - DNA, 1161 bp, Oryza sativa
  LOC_Os04g37730.1
atggggacgcgcgagctcctcgtcgttcttgccgtcgtcgtcatggccgccgtcggcgccggcgcgcagtcttcttcggcgtcgccggcgccggcgacgtcgcaggcaccgacggtgcggcagcagacgccgttcgggcggaccatgtcgaccgtcatcacggtgtccatcagcgtgttcttcttcctgctcttcttctgcgcgtacatcaaccagtgtcgcctcgccgaggccggggacgccagggccgcggcggcggcggcggccggcgggggagccggaggagggccgtccaggagagggaagcgcgggctggacccggcggtggtggccacgttcccgatcgtgccgtacagggaggtggtgaagcacaagatcggcaagagcgtgctggagtgcgccgtgtgcctgacgtcgttcgacgacggcgacgacctccggctgctgccgcactgctcgcacgcgttccacccggagtgcatcgacccctggctggagtcccgggtcacgtgcccgctgtgccgcgccaacctcgagaagcctccgccgccgccaccgccgccgccggcggcggcggcggcgtccccttcgccggagcggtcgccgcggtgccagccttcgccgccgccgccgccgccgccgcacgccctggtgataccggtggaggacgaggaagacgacagcgacgaggacgacaggaaggaggaggccgtggagctcgagatgctgcgcagcgagcggcgcgccgcgaggctgccgaggtcgcactcgacggggcactcgctggtcgcgtcggcggccgccgccgccgagtccggcgaccacgagcggttcacgctgcggctgccgcagcacgtgcgggacgaggtgctccggtcgctccgcctccgccacgccgccagcctggtcaacctctcggacatgagctccgaggggagctcgaggggaggacggcgtgcattaggcctcgccttcggcaacggcggcgggagcagccacggcggccgccggtggcaggcgttcttggcgaggacggtgtcatgggcgcgaggcggaggcgacggctcggtgcgcaggggctgggacggctcgacgagaagaggaaaagatgacgccgagtcgagcagaaagggggcgacctcaccggcggccggccggccg

SEQ ID NO: 1934 - protein, 387 aa, Oryza sativa
  LOC_Os04g37730.1
MGTRELLVVLAVVVMAAVGAGAQSSSASPAPATSQAPTVRQQTPFGRTMSTVITVSISVFFFLLFFCAYINQCRLAEAGDARAAAAAAAGGGAGGGPSRRGKRGLDPAVVATFPIVPYREVVKHKIGKSVLECAVCLTSFDDGDDLRLLPHCSHAFHPECIDPWLESRVTCPLCRANLEKPPPPPPPPPAAAAASPSPERSPRCQPSPPPPPPPHALVIPVEDEEDDSDEDDRKEEAVELEMLRSERRAARLPRSHSTGHSLVASAAAAAESGDHERFTLRLPQHVRDEVLRSLRLRHAASLVNLSDMSSEGSSRGGRRALGLAFGNGGGSSHGGRRWQAFLARTVSWARGGGDGSVRRGWDGSTRRGKDDAESSRKGATSPAAGRP

SEQ ID NO: 1935 - DNA, 1164 bp, Zea mays
  GRMZM2G160966_T01
atggagacgcggcagctgctcctcgtgttctgcctcctcggcgccggcatggccgtcgtcgtggacgcgcaggcgcagtcggcgccggcgccgccgcctcggcagacgccttctgcgccgccgcaacagacgcagttcggccgcaccatgtcgaccttcatcacggtggccatcagcgtcttcttcttcttgctcttcgtctgcgcgtacatcaaccagtgccgcctagcggaccccggggcggcggcggcggcagcggcagcggcagcggcagccggcggcgggggcgggggcccgtccaggagggggaagcgcgggctggaccccgcggtcgtcgccacgttcccgattgtgtcgtacagggaggtcgtggagcacaagatcggcaagggcgtgctggagtgcgcggtgtgcctgacggcgttcgaggacgacgacgacctccgcctgctgccgcactgctcccacgcgttccacccggagtgcatcgacccctggctgcagtcgcgggtcacgtgcccgctctgccgcgcgaacctcgagaagccggcgccggcgccggcggtggcgcccccgtcgccttcgccgcggctagcgccgcgccagccttcgccgccgccggaggccgtggcgataccggtgtcggacgacggatcggaggggggcagcagcagctgcgaggacgacaggaaggaggaggccgtcgagctggagacgctgcgcagcgcgcggcgcgccgccaggatgccgcggtcgcactcgacggggcactcgctgttcgcggcggcggcggccgccgccgccgcggaggaaggcgaccacgagaggttcacgctgcggctgccggagcacgtgcgggagcaggtgctccggtctcgccgcctgcgccacgccaccagcctgctcaacctctcggacatgagttccgaggggagctcccgaggcggaaggggcgtagcaggagcaggaagctttggcaacggcggggggagcagccacggcgggcgccggtggcaatcgttcctggccaggacggtctcctgggcgcgaggcggcggcgacggctcggtgcggagaggctgggacgggtccacgaggagggggagggacggcggtgagtcaagctggaagggcgtggcgtcgccgccgccgacgggccggccg

SEQ ID NO: 1936 - protein, 388 aa, Zea mays
  GRMZM2G160966_T01
METRQLLLVFCLLGAGMAVVVDAQAQSAPAPPPRQTPSAPPQQTQFGRTMSTFITVAISVFFFLLFVCAYINQCRLADPGAAAAAAAAAAAAGGGGGGPSRRGKRGLDPAVVATFPIVSYREVVEHKIGKGVLECAVCLTAFEDDDDLRLLPHCSHAFHPECIDPWLQSRVTCPLCRANLEKPAPAPAVAPPSPSPRLAPRQPSPPPEAVAIPVSDDGSEGGSSSCEDDRKEEAVELETLRSARRAARMPRSHSTGHSLFAAAAAAAAAEEGDHERFTLRLPEHVREQVLRSRRLRHATSLLNLSDMSSEGSSRGGRGVAGAGSFGNGGGSSHGGRRWQSFLARTVSWARGGGDGSVRRGWDGSTRRGRDGGESSWKGVASPPPTGRP

SEQ ID NO: 1937 - DNA, 1161 bp, Setaria italica
  Si012790m
atggggacgcgggagctactcctcgtcctctgcctcctcggcgccggcatggccgtctgcgacgcgcaggcgccgtccccgaattcgacttcgttctcctcgccgccgccggcgcctcagccgccgcctcagcagcagacggcgttcgggcggaccatgtcgacgttcatcacggtggccatcagcgtcttcttcttcctgctcttcatctgcgcgtacgtcaaccagtgccgcctcgcggaccccggcgcgcacggggaggccgcggcggcggccgcggggaccgggggcccgtccaggagggggaagcgcgggctggaccccgccgtggtggccacgttccccatcgtctcctacagggaggtggtggcgcacaagattggcaagggcgtgctcgagtgcgccgtgtgcctgacggcgttcgaggacgacgacgacctccgcctgctgccgcactgctcccacgccttccacccggagtgcatcgacccctggctgcagtcgcgggtcacctgcccgctctgccgcgccaacctcgagaagccggcgccggcggtggcggtggcgatggcagtggcagtggcgcccccctcgccgcaggagcagcgccagccctcgccgccgcaggaggccgtgtcgatacccgtggtggacgaggactccgaggaggaggacagcgacgaggacgacaggaaggaggaggccatcgagctcgagatgctgcgcagcgcgcgtcgcgcggtgaggatgccgcggtcgcactcgacgggccactcgctctccgcggcggcggccgccgccgcggaggagggcgaccacgagaggttcacgctgcggctcccggagcacgtgctccggtccctacgcctgcggcacgccaccagcctgatcaacctctccgacatgagctccgagggcagctcccgaggcggacgccgcctaggaggagggggaggaagcttcggcaacggcggcggcggcggcgggagcagccacggcgggcgccggtggcactcgttcctggtccggacggtctcgtgggcgcgaggcgggggcgacggctccgtccggaaggggtgggacgggtccacgaggggggcaagggacggcggcgagtccagcaggaagggctcggccacgccgccgccggcgggacggccg

SEQ ID NO: 1938 - protein, 387 aa, Setaria italica
  Si012790m
MGTRELLLVLCLLGAGMAVCDAQAPSPNSTSFSSPPPAPQPPPQQQTAFGRTMSTFITVAISVFFFLLFICAYVNQCRLADPGAHGEAAAAAAGTGGPSRRGKRGLDPAVVATFPIVSYREVVAHKIGKGVLECAVCLTAFEDDDDLRLLPHCSHAFHPECIDPWLQSRVTCPLCRANLEKPAPAVAVAMAVAVAPPSPQEQRQPSPPQEAVSIPVVDEDSEEEDSDEDDRKEEAIELEMLRSARRAVRMPRSHSTGHSLSAAAAAAAEEGDHERFTLRLPEHVLRSLRLRHATSLINLSDMSSEGSSRGGRRLGGGGGSFGNGGGGGGSSHGGRRWHSFLVRTVSWARGGGDGSVRKGWDGSTRGARDGGESSRKGSATPPPAGRP

SEQ ID NO: 1939 - DNA, 1047 bp, Oryza sativa
  LOC_Os02g36300.1
atggggcggcgcgcgcgctgcctctgcctcctcctcctcctcctcctcgtcgtaggtggcggtttccacgtggccaacgcgcaggcgtcgccggcgccgccacagacgggcacgagggcggtcaaccgcgccgtgtccaccgtcatcaccgtcgtcatcggcgtcttcttcgtcctcgtcttcgtatgcgtcatcgtcaaccagtgctgcgactgcgactcctccgctggcgctggggctgggcaagggcagtcgtcggctgctcggcgccgccgcgggctcgacccggcggcggtggcggcgatcccggtcgtgccgtacgcggaggtcaggaagcacaggagcggcggcggcggcgcgctggagtgcgccgtgtgcctcaccgtgttcgacgacggggacgacctccgcctcctcccgcagtgctcccacgcgttccaccccgactgcatcgacccctggctcgagggccacgtcacctgcccgctgtgccgcgccaacctcgagaagcagccagcgccgtcgccgcctgccgtggagttctcctcctcgcctgctgcggccgcggcggcggcggaggagtcgcgtacgcccgaggccgcggcggtgcgggttgaggaggtggcggaggcgagcgacgaagaggagacgaggaggagggaggaggaggccgtggagctggagagtctgcgcgccgtgcggcgggcggcgaggatgccgaggtcgaactcgacggggcactcgctgtgcgcgctgccggcgccgcgcgcgccggggccgggcgacggcggtgaccacgagaggttcacggtgcggctgccgccgcacgtccgggaggaggtgctcaagtcgaggcgcctccggcacgccacgagcctcgtcctcggcatcaggggatcgagccgcgagggcagctcgaggggcggcggcgggagctggcacggcgcgcggcggtggccgtccttcctggcaaggacggtgtcgtgggcgcgcggcggcgtgggagcggacaccagcgcgaaggagacgccatgccgtgatgcggtc

SEQ ID NO: 1940 - protein, 349 aa, Oryza sativa
  LOC_Os02g36300.1
MGRRARCLCLLLLLLLVVGGGFHVANAQASPAPPQTGTRAVNRAVSTVITVVIGVFFVLVFVCVIVNQCCDCDSSAGAGAGQGQSSAARRRRGLDPAAVAAIPVVPYAEVRKHRSGGGGALECAVCLTVFDDGDDLRLLPQCSHAFHPDCIDPWLEGHVTCPLCRANLEKQPAPSPPAVEFSSSPAAAAAAAEESRTPEAAAVRVEEVAEASDEEETRRREEEAVELESLRAVRRAARMPRSNSTGHSLCALPAPRAPGPGDGGDHERFTVRLPPHVREEVLKSRRLRHATSLVLGIRGSSREGSSRGGGGSWHGARRWPSFLARTVSWARGGVGADTSAKETPCRDAV

SEQ ID NO: 1941 - DNA, 1077 bp, Setaria italica
  Si020159m
atggttttccttcaggcgggacagggacaccctcttgccgtcctctctctccaactcgccgtcgtaggtgctctaaccatggtcaacgcgcaggctccgccaccgccgcagctgcagctgctcaagacgaccaccggccgcagcgtgcctcctactgccgtcatcaccatcgccatcatcgccttcttcgtcctcgttttattttgtgtcttcgtcaacctgtggcgcagaagctccgcggacgccagcgccggcgcacggcatgggtccatcaggaagcgcaggcgggggctcgacccggcggcgttggccgcgctcccggtcgtgccgtacgcggagatcaggaagcacaagagcggtggcggcgtgctggagtgcgccgtgtgcctcaccgcgttcgacgacggcgacgagctccggctgctgccgcagtgctcccacgcgttccacccggagtgcatcgacccctggctcgagggccacgtcacatgcccgctctgccgcggcaacctcgagaagcccgtgccgcttccttcgcccgacaagccgcctcgacagatgccagaggccgtcgccgttcgggtggaggcggagaacgacgaggagaggaaggaggaggacgcggcgctcgagaagctgcgctgcgcacggcgcgcggcgaggatgccgcggtcacgctcgacggggccctcggcctccacgacggccgcggccgagacgggagaccacgagaggttcaccgtgcggctgccgccgcacgtccgggaggaggttctcaggtcgaggcggctgcggcacgcgaccagcctcgtcatcaccctgggcggcggcgcctcgaactgcgcggggagctggacggcgtgttcggctggtggcgagaggtgcgtgcggcgccgttgggcgtccttgttgtccaggacggcgtcgtggtcgtgggcacagggcggtggggaagcgtcggcggggaagaaaggcgcggggcctgagacaggcgtcacgagacggccaccgtgcggccatgtggtgtgcaccttggtggcgcggtggccggcccggtgcaaagccaagaatttggct

SEQ ID NO: 1942 - protein, 359 aa, Setaria italica
  Si020159m
MVFLQAGQGHPLAVLSLQLAVVGALTMVNAQAPPPPQLQLLKTTTGRSVPPTAVITIAIIAFFVLVLFCVFVNLWRRSSADASAGARHGSIRKRRRGLDPAALAALPVVPYAEIRKHKSGGGVLECAVCLTAFDDGDELRLLPQCSHAFHPECIDPWLEGHVTCPLCRGNLEKPVPLPSPDKPPRQMPEAVAVRVEAENDEERKEEDAALEKLRCARRAARMPRSRSTGPSASTTAAAETGDHERFTVRLPPHVREEVLRSRRLRHATSLVITLGGGASNCAGSWTACSAGGERCVRRRWASLLSRTASWSWAQGGGEASAGKKGAGPETGVTRRPPCGHVVCTLVARWPARCKAKNLA

SEQ ID NO: 1943 - DNA, 1341 bp, Brachypodium distachyon
  Bradi3g58350.1
atggacatgctgctcgccgcgctccttgtggcgtgcgctctggcctcgtccggcaccgcgcagccgacgccgccagggaagagctacgactacacggccggcgccggctcgcagcagccgccccagcaggacatggccgtcagcacgacgatgatcgcgctgcttgccggtgccgtggcggtgttcgtcttcatcgcgctctccatcatctacctccgccactgcaccggctactacgacaacgcctacacagccgaccgctccacgctccccggcgccatggacgggtccacgttcatttccaggcggcatcggcagcatcgtgggacggcgtcgacgcgcgggcttgacaaggaggtggtcgaggcgttcccgaccatgaagtacgcggaggccaaggcgctgcgcgtggggaagacgcaggcgctggagtgcgcggtgtgcctgagcgagttcgaggacgaggagaagctcaggctgctgcccaggtgcagccacgcgttccacccggactgcatcggcgcgtggctcgccagccacgtcacctgccccgtctgccgccgcaacctcgacccttccaaggaccccggcagcgacgacgagccgggctcaatccttccttctgccccggcagcagccgcagaatcgaatcacagtgatcacagccacagcatctccagcgagatagccgccgttgttgtcgtagggctacggaacgatggtgacgtggcgatcgacgtggcggccgagctggaggatgaggagcggaggaaggaggcgctggagctgcagcggatagggacccagcagcggcgcgcgatgcggtcccggtcgtccaataagaaggcgcggctcgtccggtcccactccacaggccacgactcactcgctgctgcttctgctgctgctggacgagacgacatggagcggttcacgctgcggctgccggagcacgtgcgcagggagatgatggctactgcctcgtcgtgggatcagccgagcagcacacgccggggacaaaaatccgggggaggagttagcgctagcagccgccgcggggccacgaaatggccgtccttcttcgcgtgcactaccaggacgtggtcgggaaggctgccggtcttcttgccgatttcgaggagagcgccggagcagagctatgacgggggagaggtttcgtcgacttcgtcttcgaggatcagagggaagcgcgtggccgccgtcgatgtcgtcgatggcggcggctttgctgtgggggctgctgaccgctttggcggcggcgaagtcggctctgtggcggttgatgtggactacaaggcaactagccggcaggttcgaacg

SEQ ID NO: 1944 - protein, 447 aa, Brachypodium distachyon
  Bradi3g58350.1
MDMLLAALLVACALASSGTAQPTPPGKSYDYTAGAGSQQPPQQDMAVSTTMIALLAGAVAVFVFIALSIIYLRHCTGYYDNAYTADRSTLPGAMDGSTFISRRHRQHRGTASTRGLDKEVVEAFPTMKYAEAKALRVGKTQALECAVCLSEFEDEEKLRLLPRCSHAFHPDCIGAWLASHVTCPVCRRNLDPSKDPGSDDEPGSILPSAPAAAAESNHSDHSHSISSEIAAVVVVGLRNDGDVAIDVAAELEDEERRKEALELQRIGTQQRRAMRSRSSNKKARLVRSHSTGHDSLAAASAAAGRDDMERFTLRLPEHVRREMMATASSWDQPSSTRRGQKSGGGVSASSRRGATKWPSFFACTTRTWSGRLPVFLPISRRAPEQSYDGGEVSSTSSSRIRGKRVAAVDVVDGGGFAVGAADRFGGGEVGSVAVDVDYKATSRQVRT

SEQ ID NO: 1945 - DNA, 1314 bp, Oryza sativa
  LOC_Os02g52210.1
atgccaagttgccgagctaggatgcacgcgcaccagcaccagcacgcgctgctcgcggcgctcctcgcgtgcgcgctcgcggcgtcgtcgtcgacggccggagcgcagccggcggggcagcaggggtatgcctacggcgacgtgtccgggcagcaggtgcacgtcagcacgacgatgatcgtgctgctggccgccgtcgtcggggttttcctgttcatcgcgatctccaccatctacctccgccactgcaccggttacgaccccgcgacggagggcggcggcgtcggcgggagccgttccatgatcctccctgccaacagcttcgtctcgaggcggcagcggcggccgcgcgggctcgactcgtcggtggtccggatgttccccaccatgaagtacgccgaggcgaaggcgctgcgggtggggaaggtcgccggcgccgcgctggagtgcgcggtgtgcctcagcgagttcgaggacgacgagatgctcaggttcctgcccaagtgcagccacgccttccacccggactgcatcggccagtggctcgccagccacgtgacctgccccgtctgccgccgcaatctcgaccctaacaaggacaccaccgaagaggtgatcatcccggccgccgccgccgccgatccgaacagcacctccagtgaaatagttgtgatacggcaagaagacggggcgcacccagcagccgtggtgatcgacgtggtcaccgaggaggacgacgaggagcggaggaaggaggagctagagcttcaggcgataggcacccagctccgcgcgatgcggtcacggtcggggctgcggccaaagacgtcggcggcgaagcttccccggtcgcactccactggccactccctcgccgtccggctcgacggcgacctagagcggtacacgctgcggctgccggagcacgtacacagggagatggtcgcggcgggggagcagagcgtgcgccgcgggaggagactcggggaaggggtcggcatgggcgctcggtgcagcccccggttttcgcggtcgggcagatggtcatcttttctctcaaattctttgtcaggaaagctgtctttcctctccccgtcgtcgaggagaacgccggatagcacccaggtggaagtgtcatcatcctcgtcgtcgtcggtgacgaaggtgaaagggaagcgcgtggccgccgtcgatgttgccgacgacggttctgctcatgggactgcacagtaccctggttgcactgtggccagctcggcggcggcggcggctgtggacgtggagaaggcagctaccaggagacgaatgcataaa

SEQ ID NO: 1946 - protein, 438 aa, Oryza sativa
  LOC_Os02g52210.1
MPSCRARMHAHQHQHALLAALLACALAASSSTAGAQPAGQQGYAYGDVSGQQVHVSTTMIVLLAAVVGVFLFIAISTIYLRHCTGYDPATEGGGVGGSRSMILPANSFVSRRQRRPRGLDSSVVRMFPTMKYAEAKALRVGKVAGAALECAVCLSEFEDDEMLRFLPKCSHAFHPDCIGQWLASHVTCPVCRRNLDPNKDTTEEVIIPAAAAADPNSTSSEIVVIRQEDGAHPAAVVIDVVTEEDDEERRKEELELQAIGTQLRAMRSRSGLRPKTSAAKLPRSHSTGHSLAVRLDGDLERYTLRLPEHVHREMVAAGEQSVRRGRRLGEGVGMGARCSPRFSRSGRWSSFLSNSLSGKLSFLSPSSRRTPDSTQVEVSSSSSSSVTKVKGKRVAAVDVADDGSAHGTAQYPGCTVASSAAAAAVDVEKAATRRRMHK

SEQ ID NO: 1947 - DNA, 1311 bp, Oryza sativa
  LOC_Os02g52210.2
atgccaagttgccgagctaggatgcacgcgcaccagcaccagcacgcgctgctcgcggcgctcctcgcgtgcgcgctcgcggcgtcgtcgtcgacggccggagcgcagccggcggggcagcaggggtatgcctacggcgacgtgtccgggcagcaggtgcacgtcagcacgacgatgatcgtgctgctggccgccgtcgtcggggttttcctgttcatcgcgatctccaccatctacctccgccactgcaccggttacgaccccgcgacggagggcggcggcgtcggcgggagccgttccatgatcctccctgccaacagcttcgtctcgaggcggcagcggcggccgcgcgggctcgactcgtcggtggtccggatgttccccaccatgaagtacgccgaggcgaaggcgctgcgggtggggaaggtcgccggcgccgcgctggagtgcgcggtgtgcctcagcgagttcgaggacgacgagatgctcaggttcctgcccaagtgcagccacgccttccacccggactgcatcggccagtggctcgccagccacgtgacctgccccgtctgccgccgcaatctcgaccctaacaaggacaccaccgaagaggtgatcatcccggccgccgccgccgccgatccgaacagcacctccagtgaaatagttgtgatacggcaagaagacggggcgcacccagcagccgtggtgatcgacgtggtcaccgaggaggacgacgaggagcggaggaaggaggagctagagcttcaggcgataggcacccagctccgcgcgatgcggtcacggtcggggctgcggccaaagacgtcggcggcgaagcttccccggtcgcactccactggccactccctcgccgtccggctcgacggcgacctagagcggtacacgctgcggctgccggagcacgtacacagggagatggtcgcggcgggggagcagagcgtgcgccgcgggaggagactcggggaaggggtcggcatgggcgctcggtgcagcccccggttttcgcggtcgggcagatggtcatcttttctctcaaattctttgtcaggaaagctgtctttcctctccccgtcgtcgaggagaacgccggatagcacccaggtggaagtgtcatcatcctcgtcgtcgtcggtgacgaaggtgaaagggaagcgcgtggccgccgtcgatgttgccgacgacggttctgctcatgggactgcacagtaccctggttgcactgtggccagctcggcggcggcggcggctgtggacgtggagaaggcagctaccaggcaagttcgaaca

SEQ ID NO: 1948 - protein, 437 aa, Oryza sativa
  LOC_Os02g52210.2
MPSCRARMHAHQHQHALLAALLACALAASSSTAGAQPAGQQGYAYGDVSGQQVHVSTTMIVLLAAVVGVFLFIAISTIYLRHCTGYDPATEGGGVGGSRSMILPANSFVSRRQRRPRGLDSSVVRMFPTMKYAEAKALRVGKVAGAALECAVCLSEFEDDEMLRFLPKCSHAFHPDCIGQWLASHVTCPVCRRNLDPNKDTTEEVIIPAAAAADPNSTSSEIVVIRQEDGAHPAAVVIDVVTEEDDEERRKEELELQAIGTQLRAMRSRSGLRPKTSAAKLPRSHSTGHSLAVRLDGDLERYTLRLPEHVHREMVAAGEQSVRRGRRLGEGVGMGARCSPRFSRSGRWSSFLSNSLSGKLSFLSPSSRRTPDSTQVEVSSSSSSSVTKVKGKRVAAVDVADDGSAHGTAQYPGCTVASSAAAAAVDVEKAATRQVRT

SEQ ID NO: 1949 - DNA, 1251 bp, Zea mays
  GRMZM2G035704_T01
atgcacatgcctcgccacggccacacgctgctcgccgcgctgctcgcgtccgcgctcgcagcagccagcgcgcagccgagctacgatgacaacggccaggtgcacgtcagcacggccatgatcgcgctcctggccgccgtcatcgccgtgttcgtcttcatcgccttcttcaccgtctacctccgccactgcaccggcagctacgcggccaggccggacgactacgaccaccgcgccatgcccaacttcgacgccttcatctcgcggtcgcggaggcagcggcggccgcgcggcctcgacgccgacgtggtcgaggccttccccaccatgaagtacgccgaggccaaggcgctgcgggtcggcaagggctgcagcgcgctcgagtgcgcggtgtgcctcagcgagttcgaggacgaggagcgcctcaggctcttgcccaggtgcagccacgcattccacccggactgcatcggcgagtggctcgccagccacgtgacctgccccgtctgccgccgcaacctcgacccttacaaggataccagcagcgacgaagaccccgctagcttcgtcccgccgattccagtggccagcagcatctccagcgagactactgcggtgttagggcagggacgaccgctaccggtcgccgtggtgatcgatgtcatcacccagcaggaggaagaggcgcggaggcaggaggcactggagctgcagcagatagggacccagcggcgagccatgcggcggtcgcggtcggggcgcaagccggttccgacgcagctcgcccggtcgcactctacgggccactccctcgccgtccggctggaccgcgacctggagcgcttcacgctgcggctgccggagcacgtgcgtagggagatggtcgccgccgcgggcgagcacagccacagcatgcagttgcgtcgcgggcgaagagccggggaaggaagcagccgcggcggacgaagcgccccgctcggccggacgcccagatggcagttgcttctcgcgaggacgctctccgggaagctgtccttcttttcggcgtccagggtaacggtaagctccgaactgggagaagtgtcgtcctggtcctcgatcacgagggcgagagggaaccgcgtggccgccgttgaagccgacgacgttcctgctaaggggatcggcggcgggtctggcgctgcgtcccgcgaggtggcggcagcggcggacgaggagaagaagaaggcagctacgcagcaggttcgcacg

SEQ ID NO: 1950 - protein, 417 aa, Zea mays
  GRMZM2G035704_T01
MHMPRHGHTLLAALLASALAAASAQPSYDDNGQVHVSTAMIALLAAVIAVFVFIAFFTVYLRHCTGSYAARPDDYDHRAMPNFDAFISRSRRQRRPRGLDADVVEAFPTMKYAEAKALRVGKGCSALECAVCLSEFEDEERLRLLPRCSHAFHPDCIGEWLASHVTCPVCRRNLDPYKDTSSDEDPASFVPPIPVASSISSETTAVLGQGRPLPVAVVIDVITQQEEEARRQEALELQQIGTQRRAMRRSRSGRKPVPTQLARSHSTGHSLAVRLDRDLERFTLRLPEHVRREMVAAAGEHSHSMQLRRGRRAGEGSSRGGRSAPLGRTPRWQLLLARTLSGKLSFFSASRVTVSSELGEVSSWSSITRARGNRVAAVEADDVPAKGIGGGSGAASREVAAAADEEKKKAATQQVRT

SEQ ID NO: 1951 - DNA, 1506 bp, Zea mays
  GRMZM2G323013_T01
atggctcgccacggccaagcgctgctcgccgcgctcctcgtgtccgcggtcggcgcagccagcgcgcagccgagctacgatgacggcggccagggccaggtcagcacggccatgatcgcgctcctggtcgccgtcatcgcggtgttcgtgttcatcgcctcattcaccgtctacctccgccactgcaccggctccgcggccacgtcggacgactacgaccgcgccagagccgtgcccaatttcgacgccttcatctcgcggtcgcggaggcagcggcggccgcgcgggctggacgccgaggtggtcgaggctttccccaccatgaagtacgccgaggccaaggcgctccgggtgggcaagggcggcgcgctcgagtgcgcagtgtgcctcagcgagttcgaggacgaggagcggctcaggctcttgcccaagtgcagccacgccttccacccggaatgcatcggcgagtggctcgccagccacgtgacctgccccgtctgccgctgcaacctcgaccctaacaaggataccagcagcgatgaacagcggcccgacagtttcccgccgatcccagtggcgagcagcatctcgagcgaaaccgcggtgtcgtctgggcatggaccgctacctgtggccgtggtgatcgatgtgatcaccgaggaggaggaagaggcgcggcggcaggaggcgctggagctgcagcagatagggacccagcggcgcgccatgcggtcgcggtcggggcgcaagccggtcccgacgcagctcgcccggtcgcactctacgggacactccctcgccgtccggctcgaccgcgacctggagcggttcacgctgcggctgccggagcacgtgcgcagggagatggtcgccgcgggcgagcagagcatgcgactgcgtcgcgggcgaagagccggggaaggaagcagccgaggcggccgaagcgcccccctcggccgggcgagcagatggcagtcgcttctcgcggggaccttctccgggaagctgtccttcttttcggcgtccaggataacggtcagctcggccgagctgggagaggtgtcgtcctcgtcgtccacgagggcgagagggaagcgcgtggccgccgttgatgccgccgacgctcttgctagtgctaagggcagcgtccgccttgaccgcatcggaggcggcggcgtgtccggcgctgcgtcccgctcccgcgaggtggcggcagcggcggacgaggagaagtcagctacgcaacagatattcagatgtcctgtcctcattcatggtccagagtccagactccagaatgaagctgaagtagccttgtttgaactttctattcattcgctgcttcttccaagaagactttttggtgttcggtttgtgatccatttgttttgctggtctcattgtttggaagcaaaatttgattggctctcattcacccctggtcgccttacaaggtcctacacttacaataaagtttgctccaacatgattgatgaagatgacatg

SEQ ID NO: 1952 - protein, 502 aa, Zea mays
  GRMZM2G323013_T01
MARHGQALLAALLVSAVGAASAQPSYDDGGQGQVSTAMIALLVAVIAVFVFIASFTVYLRHCTGSAATSDDYDRARAVPNFDAFISRSRRQRRPRGLDAEVVEAFPTMKYAEAKALRVGKGGALECAVCLSEFEDEERLRLLPKCSHAFHPECIGEWLASHVTCPVCRCNLDPNKDTSSDEQRPDSFPPIPVASSISSETAVSSGHGPLPVAVVIDVITEEEEEARRQEALELQQIGTQRRAMRSRSGRKPVPTQLARSHSTGHSLAVRLDRDLERFTLRLPEHVRREMVAAGEQSMRLRRGRRAGEGSSRGGRSAPLGRASRWQSLLAGTFSGKLSFFSASRITVSSAELGEVSSSSSTRARGKRVAAVDAADALASAKGSVRLDRIGGGGVSGAASRSREVAAAADEEKSATQQIFRCPVLIHGPESRLQNEAEVALFELSIHSLLLPRRLFGVRFVIHLFCWSHCLEAKFDWLSFTPGRLTRSYTYNKVCSNMIDEDDM

SEQ ID NO: 1953 - DNA, 1257 bp, Zea mays
  GRMZM2G323013_T02
atggctcgccacggccaagcgctgctcgccgcgctcctcgtgtccgcggtcggcgcagccagcgcgcagccgagctacgatgacggcggccagggccaggtcagcacggccatgatcgcgctcctggtcgccgtcatcgcggtgttcgtgttcatcgcctcattcaccgtctacctccgccactgcaccggctccgcggccacgtcggacgactacgaccgcgccagagccgtgcccaatttcgacgccttcatctcgcggtcgcggaggcagcggcggccgcgcgggctggacgccgaggtggtcgaggctttccccaccatgaagtacgccgaggccaaggcgctccgggtgggcaagggcggcgcgctcgagtgcgcagtgtgcctcagcgagttcgaggacgaggagcggctcaggctcttgcccaagtgcagccacgccttccacccggaatgcatcggcgagtggctcgccagccacgtgacctgccccgtctgccgctgcaacctcgaccctaacaaggataccagcagcgatgaacagcggcccgacagtttcccgccgatcccagtggcgagcagcatctcgagcgaaaccgcggtgtcgtctgggcatggaccgctacctgtggccgtggtgatcgatgtgatcaccgaggaggaggaagaggcgcggcggcaggaggcgctggagctgcagcagatagggacccagcggcgcgccatgcggtcgcggtcggggcgcaagccggtcccgacgcagctcgcccggtcgcactctacgggacactccctcgccgtccggctcgaccgcgacctggagcggttcacgctgcggctgccggagcacgtgcgcagggagatggtcgccgcgggcgagcagagcatgcgactgcgtcgcgggcgaagagccggggaaggaagcagccgaggcggccgaagcgcccccctcggccgggcgagcagatggcagtcgcttctcgcggggaccttctccgggaagctgtccttcttttcggcgtccaggataacggtcagctcggccgagctgggagaggtgtcgtcctcgtcgtccacgagggcgagagggaagcgcgtggccgccgttgatgccgccgacgctcttgctagtgctaagggcagcgtccgccttgaccgcatcggaggcggcggcgtgtccggcgctgcgtcccgctcccgcgaggtggcggcagcggcggacgaggagaagtcagctacgcaacaggttcgcacg

SEQ ID NO: 1954 - protein, 419 aa, Zea mays
  GRMZM2G323013_T02
MARHGQALLAALLVSAVGAASAQPSYDDGGQGQVSTAMIALLVAVIAVFVFIASFTVYLRHCTGSAATSDDYDRARAVPNFDAFISRSRRQRRPRGLDAEVVEAFPTMKYAEAKALRVGKGGALECAVCLSEFEDEERLRLLPKCSHAFHPECIGEWLASHVTCPVCRCNLDPNKDTSSDEQRPDSFPPIPVASSISSETAVSSGHGPLPVAVVIDVITEEEEEARRQEALELQQIGTQRRAMRSRSGRKPVPTQLARSHSTGHSLAVRLDRDLERFTLRLPEHVRREMVAAGEQSMRLRRGRRAGEGSSRGGRSAPLGRASRWQSLLAGTFSGKLSFFSASRITVSSAELGEVSSSSSTRARGKRVAAVDAADALASAKGSVRLDRIGGGGVSGAASRSREVAAAADEEKSATQQVRT

SEQ ID NO: 1955 - DNA, 1359 bp, Setaria italica
  Si017178m
atgtcctccacgcctcgccacggcggccaccgcgcggcgctgctcgccgcggtcgtcctcgcgtccatgctcgcggcagcccgcgcgcagcaggcgcagggcggtgacgcgtcgtcaggctccggcggcccggaccaagtcagcacggccatggtcgcgctcctcgccgccgtcgtcgcggtgttcgtcttcatcgccgcctccaccgtttacctccgccactgcagcggctacgccgtcagcaccaggtcgacgtcgggcgatggcggacgcgcggccggcgccccaagcagcctcgacgccttcttcgcctcgcggtcgcggtggcagaggcggcgtaggtcgcgcgggctcgacgccgaggtcgtcgaggcgttccccaccatgacgtacaccgaagccaaggcgctgcgagtcggaaagggcggcggcgcgctcgagtgcgcggtgtgccttagcgagttcgagggcggggaccggctccgcctgctgctgcccaagtgcagtcacgccttccacccggactgcatcggcgagtggctcgccggccacgtcacctgccccgtatgccgctgcaacctcgaacctgatcacaaggacaccaccagcgacgacggggagccgacgagcttcccgccgacgattccgttagcgagcagcatctccagcgacacagcggtggcactgcaatacgctggcccgctaccggtggctgtggtgatcgacgtggtcaccgaggaggaggaagaggagcggaggcaggaggccctagagctgcagcggatcgggacccaccggcgggccatgcggtcgcggtcggggacccagccgccgacggcggcaaagctcgcccggtggcactccacgggccactcccactccctcgccgccaggctcgaccgcgacctggagctgttcacgctgcggctgccggagcaagttcgcagggagatggtcgccgccgcggccgagcgcagctcgcagctgcgccgcgggcggaggagagccaccgcggaaggaggcggcgcccgcagcgcgcccctcgtagggcagctgggcaggtggcagtcgcttctcgggaggaccttctccgggaggctgtccttcttctccgcgtcgagggtgacggtaggctccggcggcggagaagtgtcgtcctcgtcgtcttactcttacgcgaggctgagagggaagcgcgtcgccgccgttgatgtcgccgacgacgttccagctgaggggagcatctgccttgacagcattggagttggaggcagcgggtcctgtgcaagtgcaaaagcgacccccgaggaggtggcggcagcagcgaacgagaaggaagttaaaaagcagcttcggacg

SEQ ID NO: 1956 - protein, 453 aa, Setaria italica
  Si017178m
MSSTPRHGGHRAALLAAVVLASMLAAARAQQAQGGDASSGSGGPDQVSTAMVALLAAVVAVFVFIAASTVYLRHCSGYAVSTRSTSGDGGRAAGAPSSLDAFFASRSRWQRRRRSRGLDAEVVEAFPTMTYTEAKALRVGKGGGALECAVCLSEFEGGDRLRLLLPKCSHAFHPDCIGEWLAGHVTCPVCRCNLEPDHKDTTSDDGEPTSFPPTIPLASSISSDTAVALQYAGPLPVAVVIDVVTEEEEEERRQEALELQRIGTHRRAMRSRSGTQPPTAAKLARWHSTGHSHSLAARLDRDLELFTLRLPEQVRREMVAAAAERSSQLRRGRRRATAEGGGARSAPLVGQLGRWQSLLGRTFSGRLSFFSASRVTVGSGGGEVSSSSSYSYARLRGKRVAAVDVADDVPAEGSICLDSIGVGGSGSCASAKATPEEVAAAANEKEVKKQLRT

SEQ ID NO: 1957 - DNA, 1347 bp, Brachypodium distachyon
  Bradi1g45727.1
atgccgacgacgaatacgaagccgagccgccatgcgctcgcgctgccgctgcttctgctcctcctaatcgtggccggcgcggccgcgcagccgaacgactggcgggacgacaggagcgacgacgacgacgacggcaggaggcagccgccgggcccgagggcgaggcagccgccgccgccgagcttcagcacacccatggtggtgctcctggtggcgctcatcgccgtcttcttcttcatcggcttcttctccatctacatccgccagtgcggccgtgggggcgcctcctccggccccgccatccctgccgccgcgctcctagcgctgtcacggcaggagcagcagcagcagcagcagaatcagctgcagcagcgcaacgggctcgaccccgcccttgtagcctcgttccccaccatgacgtacgccgaggccagggcgctccgtgtccgggacgacggcaagggcaaggacgacatggccgtgctggagtgcgccgtgtgcctgagcgagttcgacgacgacgaggagctccggctcctccccaagtgtagccacgccttccaccccgactgcatcggcgagtggctcgccggccacgtcacctgccccgtctgccgctgcagcctcaaacccgaggagcacgaggaagtggagccagcagccgcggctgaggccaacgtgtcctcggagcagcagcaggatcaggatcaggtggccatcgacatgaacggccaggaggaagagaggagaagggaagaggaggaggaggcgacggagctggacaggatcgggagccagcgccgcgcgatgcggtcgcggtcagggcggtcgatctcgcgcgcgcactccacgggccactgtcactccctctccctctccgcgcggcggccacgcgagctcgacctcgagcggttcacgctgcggctcccggagcaggtgcgcagggagatggaggcggagagcatgcggcgtgcggtggcgcgggacgcccggagcgcgcggatcgggcggtcggaccggtggcagcagcagcagcagtcgttcatcgccaggaccttctcctcctccagggtgctgttttggggggcggcggcgtcgaggagggctccgccggacgccgaagcaggagcaggaggggtgctgccggcgggctctacgacgacgatgacgcctgcagcgacgactacggggcaggggagagccgttcgtgagaagacgggcgatgggtccgtgggttcggctaagatggggagcgtgcgcttcgactgcctcggcggaggcggcgccgtcgccgacgacgacagcgagaacgaggcggaggaggagaaggcgatcgtccggcgagtc

SEQ ID NO: 1958 - protein, 449 aa, Brachypodium distachyon
  Bradi1g45727.1
MPTTNTKPSRHALALPLLLLLLIVAGAAAQPNDWRDDRSDDDDDGRRQPPGPRARQPPPPSFSTPMVVLLVALIAVFFFIGFFSIYIRQCGRGGASSGPAIPAAALLALSRQEQQQQQQNQLQQRNGLDPALVASFPTMTYAEARALRVRDDGKGKDDMAVLECAVCLSEFDDDEELRLLPKCSHAFHPDCIGEWLAGHVTCPVCRCSLKPEEHEEVEPAAAAEANVSSEQQQDQDQVAIDMNGQEEERRREEEEEATELDRIGSQRRAMRSRSGRSISRAHSTGHCHSLSLSARRPRELDLERFTLRLPEQVRREMEAESMRRAVARDARSARIGRSDRWQQQQQSFIARTFSSSRVLFWGAAASRRAPPDAEAGAGGVLPAGSTTTMTPAATTTGQGRAVREKTGDGSVGSAKMGSVRFDCLGGGGAVADDDSENEAEEEKAIVRRV

SEQ ID NO: 1959 - DNA, 1326 bp, Oryza sativa
  LOC_Os06g11450.1
atgccgacgcctcgtcctcgccaccgccaccatgcgctcccgctcgcgctcgcgctcgccgcgccgctgctgctgctagccgcggcggacgggcagccgaacgagtcgagggacaagaacaacggcggcgggggaggtgggttcatggcgcccagcggcggaggcggcggcatgggctctcagtcgccgagcttcagcgcgcccatggtggtgctcctcgtggcgctcatcgcggccttcttcttcatcgggttcttctccatctatatccggcggtgcggcggcgaggcctccacggggccgaccatcccggccgcggcgctggcggcgctgtcgcggcaggagcagcggagccggcggcagcgcgggctcgaccccgccgtggtcgagtcgttccccaccatgaagtacgccgaggcgagggagctccgcgacggcggcaaggacgccgtgctcgagtgcgccgtctgcctcagcgagttcgacgacgacgaggagctccggttgctgcccaagtgcagccacgccttccacccggactgcatcggggagtggctcgccggccacgtcacctgccctgtctgtcggtgcaaccttgcgcccgacgcggcggcggcggaagcgaacgtcgtctccggcgaggtggatggggagcagcaggaggaggaggtggtggtggccatcgacgtggaccgcgagggcgaggaggaggacgaggagaggcggagggaggcgatggagctcgagaggatcggcagccagcgccgcgcggtgcggtcgaggtcggggcggccgctgccgctgccgcggtcgcactcgacgggccactccctcgccacgacgcggctcggcgacgccggcgacctcgagcggttcacgctgcgcctgccggagcacgtgcgcagggagatggtcgccgccgccggcgaggagagcctgcgccgcaccgccgtccgggaaggccgcgtcggcggcggcgcccggagcgcgcggatcgggcggtccgaccggtggccgtcgttcatcgcgaggaccttctcctcgaggatcccgttctggtctgcgtcgaggagggtactcgacgccgcggaggccggagctgacgccgccgccaccaccaccaccacgacgccaacgtcaacggcgaggaccaagcgtgacaagacggccgccgccgcagatggctccgtgagctcagccaagggcagcgtccgcttcgactgtctcggcggcggcggcggcggcggcggcccgagcaacagagtcgtcgccttcgccaacgacgacgaggaggatgacgacgagaagccaatcgcccggcaagtt

SEQ ID NO: 1960 - protein, 442 aa, Oryza sativa
  LOC_Os06g11450.1
MPTPRPRHRHHALPLALALAAPLLLLAAADGQPNESRDKNNGGGGGGFMAPSGGGGGMGSQSPSFSAPMVVLLVALIAAFFFIGFFSIYIRRCGGEASTGPTIPAAALAALSRQEQRSRRQRGLDPAVVESFPTMKYAEARELRDGGKDAVLECAVCLSEFDDDEELRLLPKCSHAFHPDCIGEWLAGHVTCPVCRCNLAPDAAAAEANVVSGEVDGEQQEEEVVVAIDVDREGEEEDEERRREAMELERIGSQRRAVRSRSGRPLPLPRSHSTGHSLATTRLGDAGDLERFTLRLPEHVRREMVAAAGEESLRRTAVREGRVGGGARSARIGRSDRWPSFIARTFSSRIPFWSASRRVLDAAEAGADAAATTTTTTPTSTARTKRDKTAAAADGSVSSAKGSVRFDCLGGGGGGGGPSNRVVAFANDDEEDDDEKPIARQV

SEQ ID NO: 1961 - DNA, 1263 bp, Zea mays
  GRMZM2G329195_T01
atgacgacgcctcgccacaatgcgtcgccgccgccgctccccgtgctcacgctcctctggctactgctgctcgacgctcccgccgccgcgcagcagagcccgtcgcgcgacaaggataacgggggcggtggcggtggagggggcatgccagcccagacgcccagcttcagcgctcccatggtcgtgctgctggtggcgctcatcgcggccttcttcttcatcggtttcttctccgtgtacatgcgccggtgcgggcggggcgcctcggccggtcccgtgatcccggccgccgcgctgctcgctctgtcgcggcaggaggagcgcaaccagcagcgcgggctcgaccccgccgtggtcgcgtcgttcccgacgatgaggtacgcggacgcgagagagcttcgggtcggcggcaaggacgccgcgctcgagtgcgccgtctgcctcagcgagttcgaggacgacgaggagctccggctgctgcccagctgcagccacgccttccacccggactgcatcggcgagtggctcgccggccacgtgacgtgccccgtctgccggtgcaacctcgatcccgaggagccggccggtgaggcgacgggggaggggcggcagcaggaccatgtggcgatcgacgcgagccacgatggcgccggagaggagggggaggaggacaggaggcgggatgaggcgatggagctggagcggatcgggagccagcgccgcgcggtgcggtcccggtcggggcggccggcaccgctcgtcccgcggtcgcattcgacgggccactccctcgccaccacgcgcctcgacggcgacgtggagcggttcacgctccggctgccggaactcgtgcgcagggagatggtcgccgcggccggcgaggagagcctgcgccgcacgggcctgcgcgagcgcggcggcgcccggagcgcgcggctcgggaggtcggaccggtggccgtcgttcatcacccggacgttgtcgtcgcgggtcccgttctggtccgcgtcgaggagggcgcccgacctggaggcgtcgtccatgaccacgggaggggcggccgcgaggaccaggcgtgagaagatgggcggcgcgtcagacggctcggtgacccctgctaaaggcagcgtgcgcttcgactgcctcggcgtcgcccccgccgtgacgggcgcgagagtcggcgccgcgtcctgcgacaacgagatggaggaggaggacgacgaggaggacgaggagaaggcgatcgcccggcaccggcaggct

SEQ ID NO: 1962 - protein, 421 aa, Zea mays
  GRMZM2G329195_T01
MTTPRHNASPPPLPVLTLLWLLLLDAPAAAQQSPSRDKDNGGGGGGGGMPAQTPSFSAPMVVLLVALIAAFFFIGFFSVYMRRCGRGASAGPVIPAAALLALSRQEERNQQRGLDPAVVASFPTMRYADARELRVGGKDAALECAVCLSEFEDDEELRLLPSCSHAFHPDCIGEWLAGHVTCPVCRCNLDPEEPAGEATGEGRQQDHVAIDASHDGAGEEGEEDRRRDEAMELERIGSQRRAVRSRSGRPAPLVPRSHSTGHSLATTRLDGDVERFTLRLPELVRREMVAAAGEESLRRTGLRERGGARSARLGRSDRWPSFITRTLSSRVPFWSASRRAPDLEASSMTTGGAAARTRREKMGGASDGSVTPAKGSVRFDCLGVAPAVTGARVGAASCDNEMEEEDDEEDEEKAIARHRQA

SEQ ID NO: 1963 - DNA, 1314 bp, Setaria italica
  Si006452m
atgacgacgcctcgccaccatgccgcgccgccgccgctactcgccgcgctcatcctactactactgctcgtcgggcccgccgccgcgcaggggccgtcgcgggacaaggacaacggcggcggaggaggcggagggtacagcaggcagacgcagccgccggggttcagcgcgcccatggttgtgctcctcgtggcgctcatcgcggccttcttcttcatcggcttcttctccgtgtacatgcggcggtgcgggcggggcgcctcctcgggcggcccggccatcccagcctccgcgctgctcgcgctgtcgcggcaggaggagcggaaccggcagcgcgggctcgaccccaccgtggtcgcgtcgttcccgaccatgaggtacgcggaggccaaggagctccgggtcgggggcaaggacgccgcgctcgagtgcgcggtctgcctcagcgagttcgaggacgacgaggagctccggctgctgccccggtgcagccacgccttccatccggactgcatcggcgagtggctcgccggccacgtcacctgccccgtctgccggtgcagcctcgacccccaggagctcgccgcggccgaggcgaacagctccggcgagctggctggggaggaccagcaggcggattcggtggctatcgacgtgagctgcgacggcgccgaggaggaggacaggaggagggaggaggcgatggagctggagcggatcgggagccagcgccgcgcggtgcggtcgcggtcggggcggccgccgctgccgccgccgctcgtcccgcggtcgcactccacgggccactccctcgccacgcgcctcgacggtgacctcgagcgcttcacgctgcggctgccggagcacgtgcgcagggagatggtcgccgctggcgaggagagcctgcgccgcacggggccggcggagcgggaccgggaccgggacggcagcgccggcgccgcccgaagcgcgcggctcgggcggtcggaccggtggccgtcgttcatcgcgcggacgctctcgtcaagggtcccgttctggtccgcgtcgaggagggtgccggtgcccgacgcgggggagcccgccgtggcggcagggacgacgacggaagcgtccccgaggaccaccaagcgtgagaaaacggccaacgcggcggacggcggcgccgtgaccccgcccaaggggagcgtccgcttcgactgcctcggcggcgccgccactgccgtctccggcgcgagggtcggcgccgcggccggcgacagcgagaccgaggacgacgacgaggagaaggcgatcgcccggcagcggcaggcc

SEQ ID NO: 1964 - protein, 438 aa, Setaria italica
  Si006452m
MTTPRHHAAPPPLLAALILLLLLVGPAAAQGPSRDKDNGGGGGGGYSRQTQPPGFSAPMVVLLVALIAAFFFIGFFSVYMRRCGRGASSGGPAIPASALLALSRQEERNRQRGLDPTVVASFPTMRYAEAKELRVGGKDAALECAVCLSEFEDDEELRLLPRCSHAFHPDCIGEWLAGHVTCPVCRCSLDPQELAAAEANSSGELAGEDQQADSVAIDVSCDGAEEEDRRREEAMELERIGSQRRAVRSRSGRPPLPPPLVPRSHSTGHSLATRLDGDLERFTLRLPEHVRREMVAAGEESLRRTGPAERDRDRDGSAGAARSARLGRSDRWPSFIARTLSSRVPFWSASRRVPVPDAGEPAVAAGTTTEASPRTTKREKTANAADGGAVTPPKGSVRFDCLGGAATAVSGARVGAAAGDSETEDDDEEKAIARQRQA

SEQ ID NO: 1965 - DNA, 1146 bp, Brachypodium distachyon
  Bradi4g32634.1
atggtcgcgctcgctgccgcggacctcgcggcggcgcagcagaagagctcgcctccgctgccaggggacccgcgctacgcgacccaattcagcccgtccatggccatcgtgatcgtcgtcctcatcgccgccttcttcttcctcggcttcttctccgtgtacatccgccactgctacggcgaccgctccggctactccgtgaacccgctccccgcaggcaacgcggcccggtcgcggcggcagcagcgcgggctcgacaaggccgtcctggagacgttccccaccatggcgtacgcggacgtgaaggagcacaagtccgtcaagggcgcgctggagtgcgccgtgtgcctcagcgagttcgacgacgacgagacgctccgcctcctgcccaagtgctcccacgtcttccacccggactgcatcgacacgtggctcgcgtcccacgtcacctgccccgtctgccgcgccgttctcgacgtccccgatgacgatcctgctgctgctccggccggcgatgacgtgtccgttgaggcggctgagctctcggccccaccagtacccgctccgccgccgcaggaatcaccagcggcggccgtggtgattgacgtggcggaggaggagacggaggaggagaggatcatcagggaagagacggacgagctgacgcgcatcggcagcctgaagcgcgcgctgcgctccaagtcgagccgccgcgcgccgttcccgcgctcgcactcgacggggcactcgctcgccgcggccggcggcacccgggccggcaccggcgccgagaggttcacgctgcggctgccggagcatgtgctgaaggaggtcgtggcggcggggaagctgcggcgtacgaagagcctcgtcgcgttccccgcgagccggcagctgggcagcacgcgccgcggcgtgttgttcagagccgggggcggcggcgatggaagcagccgcgacggaaggagcgtccggctgggacagtccgggcggtggccgtcgttcctgtcgcggacgttctccgcggcgtgggggtcgaggtccacgcggcgggccgccgagtcggacgggtcgagcaagggcggcaaggcggccggcaggggtgcgtgttccattccaatttttgttcttgcagaaacatgtata

SEQ ID NO: 1966 - protein, 382 aa, Brachypodium distachyon
  Bradi4g32634.1
MVALAAADLAAAQQKSSPPLPGDPRYATQFSPSMAIVIVVLIAAFFFLGFFSVYIRHCYGDRSGYSVNPLPAGNAARSRRQQRGLDKAVLETFPTMAYADVKEHKSVKGALECAVCLSEFDDDETLRLLPKCSHVFHPDCIDTWLASHVTCPVCRAVLDVPDDDPAAAPAGDDVSVEAAELSAPPVPAPPPQESPAAAVVIDVAEEETEEERIIREETDELTRIGSLKRALRSKSSRRAPFPRSHSTGHSLAAAGGTRAGTGAERFTLRLPEHVLKEVVAAGKLRRTKSLVAFPASRQLGSTRRGVLFRAGGGGDGSSRDGRSVRLGQSGRWPSFLSRTFSAAWGSRSTRRAAESDGSSKGGKAAGRGACSIPIFVLAETCI

SEQ ID NO: 1967 - DNA, 1176 bp, Oryza sativa
  LOC_Os09g29310.1
atggcgccagctcgagtccacagcaatggccgcctcctcatgcttctcctcctgctcgccgtcgccggctttgcggcggcgcagccgagccaggacaatcctccggcgggctactacgcgaccaacttcagcccgtccatggccatcgtcatcgtcgtcctcatcgccgccttcttcttcctcggcttcttctccatctacgtccgccactgctacggcggccgcggcgactactcgaccaccccgctgccccggtccggcgccgcgcggtcgcggcggcagcgcgggctcgaccagtccgtgctcgcgacgttcccgaccatggcgtacgccgacgtgaaggcgcacaagtccgtcaagggcgcgctcgagtgcgccgtctgcatcagcgagttcgacgacgacgagacgctgcggctgctgcccaagtgctcccacgtcttccaccaggactgcatcgacacgtggctcgcgtcgcacgccacctgcccggtctgccgcgccaacctcgtcgacggcgcgtccgagccggcgagcgatgtcgccgccgagctaccgacggcgcccgctccgcgcccggaaggcgcgacgccgtccgaggcagcagcgccagggggggaggcgccggcggcggcggcggcggcggcggtggtgatcgacgtggaggagaccgaggaagagaggatcataagagaggaggcggccgagctaacgcgcatcggcagcctgaagcgcgcgctgcgctcgaagtccggccgcgcgcccgccgcgcgtttcccgcgctcgcattcgacggggcactcgctctcctcctccgccgcggcgagcgccggcgccgagaggttcacgctgcggctgcccgagcacgtgctccgggaggtcatcgcggcggggcagctccagcgaacgacgagcctcgtggcgttccgcgccggccgccaggggagcacgcgccgtggcctcaggtcgggaggcggcggcggcggcggtgaaggcagcagccgcgccgggagaagcgtccggctcggccagtctggacggtggccgtcgttcctgccgcggacgttctcggcgaggctgccggcgtggggatcaaggtcgacgcggaggggcgacggcgacgggtccagcaagggcggcaggactgccggctccggcgccggcgccggcggcaag

SEQ ID NO: 1968 - protein, 392 aa, Oryza sativa
  LOC_Os09g29310.1
MAPARVHSNGRLLMLLLLLAVAGFAAAQPSQDNPPAGYYATNFSPSMAIVIVVLIAAFFFLGFFSIYVRHCYGGRGDYSTTPLPRSGAARSRRQRGLDQSVLATFPTMAYADVKAHKSVKGALECAVCISEFDDDETLRLLPKCSHVFHQDCIDTWLASHATCPVCRANLVDGASEPASDVAAELPTAPAPRPEGATPSEAAAPGGEAPAAAAAAAVVIDVEETEEERIIREEAAELTRIGSLKRALRSKSGRAPAARFPRSHSTGHSLSSSAAASAGAERFTLRLPEHVLREVIAAGQLQRTTSLVAFRAGRQGSTRRGLRSGGGGGGGEGSSRAGRSVRLGQSGRWPSFLPRTFSARLPAWGSRSTRRGDGDGSSKGGRTAGSGAGAGGK

SEQ ID NO: 1969 - DNA, 1179 bp, Zea mays
  GRMZM2G015753_T01
atggatacgacactcctccggagcaatggccgcctcctgcccttgttccttctcctgcttgccgccgccgatttcacggcggtgcagggccagggggggcagcagcagcagcctggaccagctgggggggcatactactcgcaaagcttcagcccgtccatggccatcgtcatcgtcgtgctcatcgccgccttcttcttcctcggcttcttctccatctacgtccgccactgctacggcgacggctccagcggctactccgcgaaccggccgccggcccccggcggcgccgccgcgcgctcgcggcgccagcgcgggctcgacgaggccgtgctggagtccttccccaccatggcgtacgccgacgtgaaggcgcacaaggcgggcaagggcgcgctcgagtgcgccgtctgcctcagcgagttcgacgacgacgagacgctgcgcctgctgcccaagtgctcccacgtcttccacccggattgcatcgacacgtggctcgcctcgcacgtcacctgccctgtctgccgcgccaacctcgtcccggacgccaacgccccgccgccgccgccgccggccgacgacgacgcgcccgagctgctgccgccaccacccgtgtccgcgccgcctgccgccgccgccgctgcggtggtcattgacgtggacgagacagaggaggagaggatcatcagagaggaggccaacgagctggtgcgcatcggcagcgtgaagcgcgcgctgcgctccaagtccggccgcgcgcccgcacggttcccgcgctcgcactcgacgggccactcgctcgcagcgtccgccaccaccggcaccggcgccggcgccggcgccagcaccgagaggttcacgctgcgtctgcccgaacacgtgctccgggacctcgccgcggccgggaagctccagcgcaccacgagcctagtcgcgttccgctccagccgcggcggcagcacgcgccgtggcgtcagcgtccggaccggcggcggcgaaggcagcagccgcgccgggaggagcatccggctgggccagtcagggcggtggccgtcgttcctgtcgcgaacgttctccgccaggcttcccgcgtgggggtcacggtcgacgcgcaggggcgtcgaggctgacgggtccagcaagggcggtagggcggccggcgccggcgccgccggc

SEQ ID NO: 1970 - protein, 393 aa, Zea mays
  GRMZM2G015753_T01
MDTTLLRSNGRLLPLFLLLLAAADFTAVQGQGGQQQQPGPAGGAYYSQSFSPSMAIVIVVLIAAFFFLGFFSIYVRHCYGDGSSGYSANRPPAPGGAAARSRRQRGLDEAVLESFPTMAYADVKAHKAGKGALECAVCLSEFDDDETLRLLPKCSHVFHPDCIDTWLASHVTCPVCRANLVPDANAPPPPPPADDDAPELLPPPPVSAPPAAAAAAVVIDVDETEEERIIREEANELVRIGSVKRALRSKSGRAPARFPRSHSTGHSLAASATTGTGAGAGASTERFTLRLPEHVLRDLAAAGKLQRTTSLVAFRSSRGGSTRRGVSVRTGGGEGSSRAGRSIRLGQSGRWPSFLSRTFSARLPAWGSRSTRRGVEADGSSKGGRAAGAGAAG

SEQ ID NO: 1971 - DNA, 1212 bp, Zea mays
  GRMZM2G082653_T01
atggaaacaacactccccatggtccggggcaatggccgcctcctgcccttgtcccttctcttgctcgctgccgccgatttcacaacggtgcatggccaggggcagcagcctgaagggccgtactactcgcgaagcttcaacccatccatggccatcgtcatcgtcgtgctcatcgccgccttcttcttcctcggcttcttctccgtctacgtccgccactgctacggcgacggctctagcggctactccgcgagcccggcccccggcggtgccgccgcgcgatcgcggcgccagcagcgcgggctcgactcggcggtgctggagtccttcccgaccatggcgtacgccgacgtgaaggcgcacaaggccggcaagggcgcgctcgagtgcgccgtctgcctcagcgagttcgacgacgacgagacgctgcgcctgctgcccaagtgctcccacgtcttccacccggactgcatcgacacgtggctcgcctcgcacgtcacctgccccgtctgccgcaccaacctcgccctcggccccgacgccaacgccccgccgcccgacgacgacacgcctgagctgctgccggctccagaagcgcaggagctaccgtcgcccacgtccgcaccgcctccttctgctgcggtggtcatcgacgtggaggagacagaggaggagaggatcatcagagcggaggccgacgagctgatgcgcatcggcagcgtgaagcgcgcgctgcgctccaagtccggccgcgcgcccgcacggttcccgcgatcgcactcgacagggcactcgctcgcagcgtctgcctgtgccaccaccggcaccgaaaggttcacgctgcgtctgcccgaccacgtgctccgagacctcaccgcggcggggaagctccagcgcaccacgagcttagtcgcgttccgctccagccgcgggggcagcacgcgccgtggcgtcagcgtcaggacaggcgggggaggcggcgaaggcaccagccgtgccgggaggagcatccggctgggccagtcaggacggtggccgtcgttcctggcgcggacgttatccgcgaggcttcccgcctggggatcgcggtcgacgcggaggagcgtccagactgacgggtcgagcaagggcggtaggacagttggcgacgccggcgcaggcgccaagtcttctgaacatgacgaccaggcgtgcgcgcctggacagcgtgtt

SEQ ID NO: 1972 - protein, 404 aa, Zea mays
  GRMZM2G082653_T01
METTLPMVRGNGRLLPLSLLLLAAADFTTVHGQGQQPEGPYYSRSFNPSMAIVIVVLIAAFFFLGFFSVYVRHCYGDGSSGYSASPAPGGAAARSRRQQRGLDSAVLESFPTMAYADVKAHKAGKGALECAVCLSEFDDDETLRLLPKCSHVFHPDCIDTWLASHVTCPVCRTNLALGPDANAPPPDDDTPELLPAPEAQELPSPTSAPPPSAAVVIDVEETEEERIIRAEADELMRIGSVKRALRSKSGRAPARFPRSHSTGHSLAASACATTGTERFTLRLPDHVLRDLTAAGKLQRTTSLVAFRSSRGGSTRRGVSVRTGGGGGEGTSRAGRSIRLGQSGRWPSFLARTLSARLPAWGSRSTRRSVQTDGSSKGGRTVGDAGAGAKSSEHDDQACAPGQRV

SEQ ID NO: 1973 - DNA, 1185 bp, Setaria italica
  Si030093m
atggaaacgacactcctccgtagcaatggccgcctccttcccctcttccttcttttgctcgcggtcgctgatttcacggcggcgcaggggccgcagcagacgaacggacagacgccctacaccaacttcagcccgtccatggccatcgtcatcgtggtgctgatcgcggccttcttcttcctcggcttcttctccatctacgtccgccactgctacggcgacggctcgagcggctactccgcgagccctgccccgaacggcgccgccgcgcggtcgcggcgccagcgcgggctcgacgcggcggtgctcgagaccttccccaccatggcgtacgccgacgtgaaggcgcacaaggccggcaagggcgcgctcgagtgcgcggtgtgcctcagcgagttcgacgacgacgagacgctgcgcctgctgcccaagtgctcccacgtgttccacccggactgcatcgacacctggctcgcctcccacgtcacctgccccgtctgccgcgccaacctcgtcccggaccccaacgaaccggccgacgacgacgcgccggcagagctgccgccagctcccgctcaagaattgccgtcgcccgcgtccgcgccggctgctcccgcggcggtggtcattgatgtggaggagacggaggagcagaggattatcagagaggaggccgacgagttgatgcgcatcggcagcgtcaagcgcgcgctgcgctccaagtccggccgcgcgccagcgcggttcccgcgctcgcactcgacggggcactcgctcgccgcggcggcgtccgccaccggcagcgctgccgccgagaggttcacgctgcggctgcccgaccacgtgctccgggacctcgccgcggcggggaagctgcagcgcaccacgagcctcgtcgcgttccgcgccagccggggcggtagcacgcgccgtggcgccagcgtcaggaccatcggcggcgaaggcggcagcagccgcggcgggaggagcatccggctgggccagtccgggcggtggccgtcgttcctggcgcggacgttctccgcgaggctccccgcgtgggggtcgcggtcgacgcggaggggcgtcgaggccgacgggtcggccaagggcggcagggcggccggcgcaggcgcgaagtcagtggaatacgacgaccaggcgtgcgcggcggggcaacgtgtt

SEQ ID NO: 1974 - protein, 395 aa, Setaria italica
  Si030093m
METTLLRSNGRLLPLFLLLLAVADFTAAQGPQQTNGQTPYTNFSPSMAIVIVVLIAAFFFLGFFSIYVRHCYGDGSSGYSASPAPNGAAARSRRQRGLDAAVLETFPTMAYADVKAHKAGKGALECAVCLSEFDDDETLRLLPKCSHVFHPDCIDTWLASHVTCPVCRANLVPDPNEPADDDAPAELPPAPAQELPSPASAPAAPAAVVIDVEETEEQRIIREEADELMRIGSVKRALRSKSGRAPARFPRSHSTGHSLAAAASATGSAAAERFTLRLPDHVLRDLAAAGKLQRTTSLVAFRASRGGSTRRGASVRTIGGEGGSSRGGRSIRLGQSGRWPSFLARTFSARLPAWGSRSTRRGVEADGSAKGGRAAGAGAKSVEYDDQACAAGQRV

SEQ ID NO: 1975 - DNA, 1239 bp, Oryza sativa
  LOC_Os08g37760.1
atggggtcgccgcgaggacgccgccgcggcgacaatggccgcctcctcctcctcgccgccgccgccgtcgtcattgcctcgctggtcggcggcggcgcggcgcagccgacgacgtccgggcccggcccgaactacttcaaccccaagagcttcaacccgtccatggccgtcgtgatcgtggtcttggtcaccgccttcttcttcctcgggttcttctcgatctacatccggcgatgcgccggcgggccgttgggtgggcccggggggtatggcgtcggcggcggcggcggtggacgtgtgggtggtgggttcacgtttgcggcggcgcggtcgaggagggtgagggggcttgaccccgccgtgctgggcgcgttcccgaccatggcgtacgccgacgtgaaggcgcacaaggccggcaagggcgcgctcgagtgcgccgtgtgcctcagcgagttcgacgacgacgagacgctccggctgctgcccaggtgctcccacgcgttccacgccgactgcatcgacgcgtggctggcgtcccacgtcacgtgccccgtctgccgcgccaacctcgccttcgacgccggcgtcccgccgccgccgctggcgccgccgcatgcgttgaccaccgggcaagatgttgcggctgcgccgccgcagccggcggcgccagagcaggtgacggtggacgtcgtcgtcgcggatgccgaggagacggaggagaggatcaggagggaggaggcggccgagctgatgcggatcggaagcgtgaagcgcgcgctgcggagcaagtccggccgccggccgccgcagttcccgcggtcgcacaccacggggcactcgctcgccgccgccgccgccgtgcccgccaccgccgacgacgccgcggagcggtacacgctgaggctccccgatcacgtgctccgggaaatcgtcacctcggcgaggctacgccgcacgacgagcctccaatcgttccgcaccaccgccgccgccggcggcggcgcccgcgccgggaggagcgtccggctcggccagtccgggaggtggtccaacgtgtcgtcgctgatgcgcacgttctcggccaggctgccggcgtggggctccgctcgacgcggcgccgaagccgactctccggggaaggacggcgccaaggtcgccggcgactgcaccgcctccgtggagcaacactgcgacggcggcggcggcggcgcgtgcccacgtccacttggtgaccatgta

SEQ ID NO: 1976 - protein, 413 aa, Oryza sativa
  LOC_Os08g37760.1
MGSPRGRRRGDNGRLLLLAAAAVVIASLVGGGAAQPTTSGPGPNYFNPKSFNPSMAVVIVVLVTAFFFLGFFSIYIRRCAGGPLGGPGGYGVGGGGGGRVGGGFTFAAARSRRVRGLDPAVLGAFPTMAYADVKAHKAGKGALECAVCLSEFDDDETLRLLPRCSHAFHADCIDAWLASHVTCPVCRANLAFDAGVPPPPLAPPHALTTGQDVAAAPPQPAAPEQVTVDVVVADAEETEERIRREEAAELMRIGSVKRALRSKSGRRPPQFPRSHTTGHSLAAAAAVPATADDAAERYTLRLPDHVLREIVTSARLRRTTSLQSFRTTAAAGGGARAGRSVRLGQSGRWSNVSSLMRTFSARLPAWGSARRGAEADSPGKDGAKVAGDCTASVEQHCDGGGGGACPRPLGDHV

SEQ ID NO: 1977 - DNA, 1131 bp, Zea mays
  GRMZM2G467187_T01
atgggcccgatcaatggccgccgccgccgccgtctcctgctcctcgccgcggttgctctcgccggcgccgccgtggacgcgcagcccgactacttcaaccccaagaatttcaacccgtccatggcgattgtcatggtcgtgctggtcacggccttcttcctgctcggcttcttctccatctacctccgccgatgcgcggggcccccgctgggcgggcccgacgaccactaccatgcgaggcagctgggtctggggctcggcaacaacagctacgcgccgccgcccagcaggaggatgcgcggcctcgaccgggccgtgctcgactccttcccgaccatggcctacgccgacgtcagggcgcacaagggcgcgctcgagtgcgccgtctgcctcagcgagttcgacgacggcgacacgctccggctgctgcccaggtgcgcccacgcgttccacaccgactgcatcgacgcctggctcgcgtcgcacgtcacctgccccgtctgccgcgccatcctcctcgtccccgacgctgccgagcccaccgcgttggctgctgcccctgtcactgcagcgccggatgatgaccatgccgtggtggtcgacgccgcagccgctgccggggagaccgaggaccagaggctcaggagggaggaggccgccgagctgctgcggatcgccagcgccaagcgcgcgctgcgaagcaacaagtcgcagttcccgcgctcgcacaccacgggccactcgctcgccgcgccgtcgcccgccggctcgcctagttccacctcggacgcggagcgctacacgctgaggctgcccgaccacgttctccgggaagccgtcgccgcggccaaccttcgccggtctgcgagcgtccagacgggcgctgacgggaccaccacgcgccgcggcttcgccatcgccggccgcgctggaactggaaggagcgtccgcctcggcaactcctccggccggtggcccagtatgtccctcctcctggcgcgcaccttctccgccaggcgcccagtgacgcggcgcggtgaggccgacgccgacgcaccagacaagttcgcaggctacgacggcaaaaccatcgtggagcagtgccacgacggcggagcttgctcgcttgtt

SEQ ID NO: 1978 - protein, 377 aa, Zea mays
  GRMZM2G467187_T01
MGPINGRRRRRLLLLAAVALAGAAVDAQPDYFNPKNFNPSMAIVMVVLVTAFFLLGFFSIYLRRCAGPPLGGPDDHYHARQLGLGLGNNSYAPPPSRRMRGLDRAVLDSFPTMAYADVRAHKGALECAVCLSEFDDGDTLRLLPRCAHAFHTDCIDAWLASHVTCPVCRAILLVPDAAEPTALAAAPVTAAPDDDHAVVVDAAAAAGETEDQRLRREEAAELLRIASAKRALRSNKSQFPRSHTTGHSLAAPSPAGSPSSTSDAERYTLRLPDHVLREAVAAANLRRSASVQTGADGTTTRRGFAIAGRAGTGRSVRLGNSSGRWPSMSLLLARTFSARRPVTRRGEADADAPDKFAGYDGKTIVEQCHDGGACSLV

SEQ ID NO: 1979 - DNA, 1191 bp, Setaria italica
  Si013878m
atgggcccgagcaatggccgacgcctccggctggtcctcgtcgcggtcgcgctggccggcgcggccgtggacgccgtgacggcgcagcagggcccgcggacggggccggggccggggccgagctacttcgaccccaagaacttcaacccgtcgatggcgatcgtcatggtggtgctcgtcacggcgttcttcctgctcggcttcttctccatctacctccgccgctgcgcggggcccccgctgggcgggcccgacgacgacgggtacccggcgggcgggcgccggccgctagggatcgcgagggcggcgcgcgggctggaccgcgccgtgctggagtcgttcccgaccatggcctacgccgacgtcaaggcgcacaaggtcgggaagggcgcgctcgagtgcgccgtgtgcctcagcgagttcgacgacgacgagacgctccggctcctgccccggtgctcccacgcgttccatgccgactgcatcgacgcctggctcgcgtcgcacgtcacctgccccgtctgccgcgccgtcctcgcccccgactactacgaggcggcaccggcgccaccgctggctccggcgagtgccgtgtccgccgcggagcaagacgccccgcggcagcaggcgccggaaacagccacggcgccggagcaggcggcagcggcggtcgtcgtcgtcgttgacgcagaggagacggaggaggagaggaacaggagggaggaggccgccgagctgatgcggatcggcagcgtcaagcgcgcgctgcggagcaagtcgggccggcagcccgcgcagttcccgcgctcgcacaccacggggcactcgctcgccggggccgcgcccgccgaggcctcggagcggtacacgctgcggctgccggagcacgttctccgggaggtggtcgcggcgagcagccttcggcggtccgcgagcgtccaggcgggcggcgacgggagcgcgcgccgcggattcggaggcgcccgcgccgggaggagcgtccggctcggcagctccggccggtggcccaacatgtcgatgctggcgcgcaccttctccgcgaggctgccggcgtggggctccgcgcggcgcggcgaggccgatgctccggccaagggcgcgaaggtcgctggcgacggcaaggctgaagagcagtgcgacggtggggcgtgcccacttggcgcccacgtt

SEQ ID NO: 1980 - protein, 397 aa, Setaria italica
  Si013878m
MGPSNGRRLRLVLVAVALAGAAVDAVTAQQGPRTGPGPGPSYFDPKNFNPSMAIVMVVLVTAFFLLGFFSIYLRRCAGPPLGGPDDDGYPAGGRRPLGIARAARGLDRAVLESFPTMAYADVKAHKVGKGALECAVCLSEFDDDETLRLLPRCSHAFHADCIDAWLASHVTCPVCRAVLAPDYYEAAPAPPLAPASAVSAAEQDAPRQQAPETATAPEQAAAAVVVVVDAEETEEERNRREEAAELMRIGSVKRALRSKSGRQPAQFPRSHTTGHSLAGAAPAEASERYTLRLPEHVLREVVAASSLRRSASVQAGGDGSARRGFGGARAGRSVRLGSSGRWPNMSMLARTFSARLPAWGSARRGEADAPAKGAKVAGDGKAEEQCDGGACPLGAHV

SEQ ID NO: 1981 - DNA, 1059 bp, Oryza sativa
  LOC_Os03g08920.1
atggctcaccgccggatcgcgctcgccgtcctcgtgacgctgctcttgtcggcgttccgcccttgcctggcgcaacagagcaacgacgacacgagcaaacaccaccggagcgccacggccggcgggttcacgccgaccaccgtcgtcgtgctcgtggctctcatcaccgccttcgtcctcctcaccgtgttctccgtcctcatcaaccgctgcgcccaggcgcgcgctcccccgcgccgggcgttccgcagcacggcgtcccatcagcccgtcggcggcgccgccgccgcgtcccgcgcctcgcgtggcctcgacaaggaggtcgtggaggcgttccccacggcggtctacggcgacgtgaaggcgcgcatggcggcgaagtcggggccgctcgagtgcgccgtgtgcctcgccgagttcgcggacagcgacgagctacgggtgctcccggcgtgctgtcacgtgttccacccggactgcatcgacccctggctcgccgccgccgtcacgtgcccgctctgccgcgccaacctcacggcgccaccggtgtcgctcgccgccgccgagagctccgacctgacggcgccggaggaggcggtgcaggaggaagagtcggaggagctcgacgaggcgtccctgatggccaccttcacgccggaatccgtcatcgacttcggcgcgacgcacgaccatgaattcgacagagcagggtaccctcactaccggaggacgcagtcggccatggacgccgcgccggaccggcacacgctgaggctaccggagcacgtcatgaaggagctcgccgccgaccgcaggcaccggcgcgccgcgagcctcgccgggtacccggacagcgtggagaggacgccgaggtggctgacgtcgctctggcgatcggtgtcgtggcagaggcagagccgggcggactgggacgccggagaggagcacggcggcagcaaaagggttcacccggtcgccggagctcaggacgagacacccagcgggtccggctccgatgggagcaaggagaactccgattctgacgcgttaaaccgagtt

SEQ ID NO: 1982 - protein, 353 aa, Oryza sativa
  LOC_Os03g08920.1
MAHRRIALAVLVTLLLSAFRPCLAQQSNDDTSKHHRSATAGGFTPTTVVVLVALITAFVLLTVFSVLINRCAQARAPPRRAFRSTASHQPVGGAAAASRASRGLDKEVVEAFPTAVYGDVKARMAAKSGPLECAVCLAEFADSDELRVLPACCHVFHPDCIDPWLAAAVTCPLCRANLTAPPVSLAAAESSDLTAPEEAVQEEESEELDEASLMATFTPESVIDFGATHDHEFDRAGYPHYRRTQSAMDAAPDRHTLRLPEHVMKELAADRRHRRAASLAGYPDSVERTPRWLTSLWRSVSWQRQSRADWDAGEEHGGSKRVHPVAGAQDETPSGSGSDGSKENSDSDALNRV

SEQ ID NO: 1983 - DNA, 1257 bp, Brachypodium distachyon
  Bradi1g60690.1
atggctcccgcgccgccgaccaccacgtggactcatctccaccgtccattcctccgtcctctagcgcttgtgctcgccactagtgtcttccggcccgcctcgtcgcagctcatcttcacgccgcccacggccggcgccaccttcgccggggcgttgacgcctccaccaccaccgccaaccgacggggggctcggaggcggcaccttcaacgtggccacttcgatcctgttcgtgggcgtcatcgtcgcgctcttcctggtcggcttcttgtccgcgtacctccggcgctgcgccgacgccgccacggccgcgcaacgcggcggggacgcgaacgcggcagtggctgccgccgcggccgccgcattctcttcggccgcgagccgcggcagcaggaggagaggggcggctggtctcggcactgccgcgatggaggcgctgccggtgctgacgtacgccagggcgagggcggtcaaggccgggcgcggcgctctcgagtgcgccgtgtgcctggcagagttcacggacgacggggagaagctccgcctcctgccgggctgctgccacgtcttccacgcggcctgcatcgacgtctggctcgcggcgcacgccacgtgccccgtgtgccgcgccgacctggcggacccggccgtcgccgccgcgggacgcgtcctctccgctgacctcgctgctgatcaggcggtggaaacggcgtccgccgatcacaccgtggtcaacgtcgagacgccggcgtcaacgcccgcagctggagaacagcaggaagaagagatcacggcggaggagcgggcggaccggtacacgctgcggctgccggagaggctgaggagggagatcgaggacgcaaagcggctccgcagggccgtgagcgcggtgaccgcggcgagcgcgtcgtcgtcaagcgggcgatgggggttaccatcggcgctacggacaatgtcggcggcacgccctagccggcgatggtcggcgttgttccgggcgctgtcggggccacaccggagccggagcgacctggacggaagggtggcgccgctgcaaacccatcccgccggggacaacgtggaggtggtggtggtgcggcggagcgacgatgtggggtcggaaacagagaagcaatacgcccacagcctcaccttcgcggggttcgtcatcgacggcgacgtcgcgtcaggcgactggaacccggaggtcttccaggtctcgtccgcagtcctggccccagcgccgccgtcacagcca

SEQ ID NO: 1984 - protein, 419 aa, Brachypodium distachyon
  Bradi1g60690.1
MAPAPPTTTWTHLHRPFLRPLALVLATSVFRPASSQLIFTPPTAGATFAGALTPPPPPPTDGGLGGGTFNVATSILFVGVIVALFLVGFLSAYLRRCADAATAAQRGGDANAAVAAAAAAAFSSAASRGSRRRGAAGLGTAAMEALPVLTYARARAVKAGRGALECAVCLAEFTDDGEKLRLLPGCCHVFHAACIDVWLAAHATCPVCRADLADPAVAAAGRVLSADLAADQAVETASADHTVVNVETPASTPAAGEQQEEEITAEERADRYTLRLPERLRREIEDAKRLRRAVSAVTAASASSSSGRWGLPSALRTMSAARPSRRWSALFRALSGPHRSRSDLDGRVAPLQTHPAGDNVEVVVVRRSDDVGSETEKQYAHSLTFAGFVIDGDVASGDWNPEVFQVSSAVLAPAPPSQP

SEQ ID NO: 1985 - DNA, 1251 bp, Oryza sativa
  LOC_Os03g27360.1
atggcgcccaccaccacatgccaacgcatcctcctcctcctcctcctcctcctcctcctcgccattgctcggcctgcctcgtcgcagctcttcacgccggcgccgccgccaccggtacaggctgcggatggcggcgggagcgcgggctttaacgtggcgacgtcgctcctcttcgtcggggttgtcatcgcgctcttcttgctcggcttcttctccgcgtacctccgccgctgctccgaggccgccaccgccgcgcaccgtctccgtgggggcgggggcggcggcgcggtgcacgccagcgcggccgtggcggccgccgccgcggcggcgttcgcggggagcgccgggaggaggagggggcgcgcggggctcgacgtcgccgcgatggaggcgctgccggtgctgacgtacgcgacggcgagggcggtgaaggccgggcgcggggcgctcgagtgcgcggtctgcctcgccgagttcgccgacggcggcgagaagctccgcctcctccccgggtgctgccacgtgttccacgccgcctgcatcgacgtctggctcgccgcgcacgtcacctgccccgtctgccgcgccgacctcgccgacccggccgtcgccgccgccggccacgtccttgccgctgacctcgccgcgcaggcagaggcgcccaaccacacggtggtcaacgtcgacacaccggagtcaacgatcggaaaggactcgccgtccgatcagcagccgccggagtcgttgacggcggaggagcgggtggaccggtacacgctgcggctgccggagaggctgaagagggagatcgaggaggccaagctgctccgccggtcggtgagcgcggtcaccgcgcccgcggccgcgtcgagcgggcggtgggcgtcggcggcgtcgcggacaatgtcggcggcgcgtccgagccggcgttggtcggcgctgctccgtgcattgtccgggccgcgatacagcgacatggacggcggcggcggcggcggccggagggtggcgccgctgcaaacccacggcgccaccggcacgagccatggcgaaggggaggacgtcgaggtggtggtggtgcacggcgacgccgggacggacgtggagaagtactacgcgcacagcctcacgttcgcgggattcgtgatcgacggcgacgtcgccgccggcgactggaaccccgaggtgttccaggtgtccaccgccgttccagccgccgccggcgccacagcgatgaaatgcaactcatat

SEQ ID NO: 1986 - protein, 417 aa, Oryza sativa
  LOC_Os03g27360.1
MAPTTTCQRILLLLLLLLLLAIARPASSQLFTPAPPPPVQAADGGGSAGFNVATSLLFVGVVIALFLLGFFSAYLRRCSEAATAAHRLRGGGGGGAVHASAAVAAAAAAAFAGSAGRRRGRAGLDVAAMEALPVLTYATARAVKAGRGALECAVCLAEFADGGEKLRLLPGCCHVFHAACIDVWLAAHVTCPVCRADLADPAVAAAGHVLAADLAAQAEAPNHTVVNVDTPESTIGKDSPSDQQPPESLTAEERVDRYTLRLPERLKREIEEAKLLRRSVSAVTAPAAASSGRWASAASRTMSAARPSRRWSALLRALSGPRYSDMDGGGGGGRRVAPLQTHGATGTSHGEGEDVEVVVVHGDAGTDVEKYYAHSLTFAGFVIDGDVAAGDWNPEVFQVSTAVPAAAGATAMKCNSY

SEQ ID NO: 1987 - DNA, 1149 bp, Zea mays
  GRMZM2G056151_T01
atggcacccacgccgccgaccagcacgaggcctcgccgccaccacacgatcctccgcccgccgctggcactcgcgctcgcgctcgccattgtccgccccgcctcgccgcagctcctccagccgccgcccggcgccaccgtctccagcgcattctcgccaccgccgtcgccacccgtggacggcgtcggcggtaggtttgccgtcaccacctcgctcctcttcgtcggcctgatcgtcgcgctcttcctgctcggcttcttctcggccttcctccgccgccgctgcggcgccggagccgacacgcgcggccgcgggggagggggcggtgtcggttccctggccgccagcgccggcgccgccgcgggcgcggggctcgacgccgcagcgatggaggcgctgccggtgctcacgtacgcgacggcgcgggcggtgagggccggccgcggggcgctcgagtgcgcggtctgcctctccgcgttcgacgccgccggcgagaagctccgcctcctccccgggtgctgccacgtgttccacgccgcgtgcgtcgacgcgtggctcgcggcgcacgtcacctgccccgtctgccgcgccgatctctccgacccggccgtcgccgccgccggccacgtcctggccgctgacctcgccgccgacacggtcgttgtcgtcaacgtggtggacgggccagctgctcctgccgcagaagctgcgggacaggacgccacgccgtcggagacggccgaggaccggttcacgctgcgcctgccggagaggctcaggcgggagatcgacgaggccaggcgcctccgcagagcgctgagcgcgtcgaccgcgctgccgagcggtgggccgttggcgtcgtcggcagcagcgccgcgcacaatgtcggcggcacgcccgagccggcgatggtcggggctgctccgggcgttgtcgggatctcggcgggtgagcgagcccgacggccattggagggtggtgccgttgcctaccggtgctggcaacggggaggtggtgcaggagcaagacgacgtggacaagtacttcagcctcacgttcgctggcttcgtcatcgacggcgacgtggcggctgtcgactggcatccggaggtttttcacgtctcgactggcgttccggccgcgcagcgg

SEQ ID NO: 1988 - protein, 383 aa, Zea mays
  GRMZM2G056151_T01
MAPTPPTSTRPRRHHTILRPPLALALALAIVRPASPQLLQPPPGATVSSAFSPPPSPPVDGVGGRFAVTTSLLFVGLIVALFLLGFFSAFLRRRCGAGADTRGRGGGGGVGSLAASAGAAAGAGLDAAAMEALPVLTYATARAVRAGRGALECAVCLSAFDAAGEKLRLLPGCCHVFHAACVDAWLAAHVTCPVCRADLSDPAVAAAGHVLAADLAADTVVVVNVVDGPAAPAAEAAGQDATPSETAEDRFTLRLPERLRREIDEARRLRRALSASTALPSGGPLASSAAAPRTMSAARPSRRWSGLLRALSGSRRVSEPDGHWRVVPLPTGAGNGEVVQEQDDVDKYFSLTFAGFVIDGDVAAVDWHPEVFHVSTGVPAAQR

SEQ ID NO: 1989 - DNA, 1071 bp, Setaria italica
  Si039752m
ggcggcggcggagggggaaggttcagcctcaccacgtcgctcctcttcgtcagcctcatcgccgcgctcttcctactcgccttcttctcggcctacctccgccgctgctccgacgccgccacggccacggacgccgcgcggcgacgcgccctgagcgccaacgcggccgtcgcggcagcggcggcggcagctttcgcgtcggcggccagcgtcggcggcggcaggaggcgcgccgccgtggggctcgacgccgcggcgatggaggcgctccccgtgctcacgtacgcgacggcgcgggcggtcaaggccggccgcggggcgctcgagtgcgcggtctgcctctccgagttcgacgacgccggcgagaagctccgcctcctccccgggtgctgccacgtgttccacgccgcctgcatcgacgtgtggctcgccgcgcacgtcacctgccccgtctgccgcgccgacctctccgacccggccgtcgcggacgccggccacgtcctggccgctgacctcgcagcccaggcagaagcgcccaccgacacgattatcaacatcgacatcgagccgtccgagtcaacgccagaacggggccccacatcgtccgacgagcagccagcggagacggcggaggagcgggtggaccggtacacgctgcggctgccggagaggctcagacgggagatcgacgaggcgaggcggctccgccgggcaatgagcgcggtgaccgcttcgaccgcgttgccgagcgcctcaagcgggcggttgacgccggcggcggcactacggacaatgtcgaccgcgcgccagagccggcggtggtcggggctgttccgggctctgtcggggtcgcggcggcggagcgagccggagggccaccggagggtggtgccattgcataccggcgacggggaggtggaggtggtggtggtgcaggacggtaacgtggagaagtactacgcgcacagcctcacgttcgctgggttcgtcatcgacggcgacgtcgcggccggcgactggaacccggaggtcttccaggtctcgacggccggcgcggcgacgtcgcagcgg

SEQ ID NO: 1990 - protein, 357 aa, Setaria italica
  Si039752m
GGGGGGRFSLTTSLLFVSLIAALFLLAFFSAYLRRCSDAATATDAARRRALSANAAVAAAAAAAFASAASVGGGRRRAAVGLDAAAMEALPVLTYATARAVKAGRGALECAVCLSEFDDAGEKLRLLPGCCHVFHAACIDVWLAAHVTCPVCRADLSDPAVADAGHVLAADLAAQAEAPTDTIINIDIEPSESTPERGPTSSDEQPAETAEERVDRYTLRLPERLRREIDEARRLRRAMSAVTASTALPSASSGRLTPAAALRTMSTARQSRRWSGLFRALSGSRRRSEPEGHRRVVPLHTGDGEVEVVVVQDGNVEKYYAHSLTFAGFVIDGDVAAGDWNPEVFQVSTAGAATSQR

SEQ ID NO: 1991 - DNA, 1230 bp, Citrus clementina
  clementine0.9_030155m
atgaggttcgaaaacttcaatcccagccgttggatcatccacgtcacatggctgctgctcctctggccgacgttgtacgattacgccagcgcacagacagtcacgcaaccgccggcgaaccctgacggtctttacacaacccttgatccttcaatggcaatcatcatcttggttctcatatccaccttctttatcgtcgccatgttttccatctacgtacgtcactgctctgattcacgcgcccaaggcggcgtcctcccttcacgcgccctcgccgggctctccagaaaccgcggcctcgatccttccgtcatcgagtctttccctatcttcgtctactctgcggtgaaggatctgaaaatcgggaagggtgctctggaatgtgccgtgtgtttaagcgagtttgaggacgacgaaacgctgcgtttacttccaaaatgtgatcacgtgttccatcctcattgcatcgatgtctggttagcctctcacgtgacgtgcccggtttgtagggccaaccttactccagaatcaaacaaaaaggttaaattatgcgattcaaacaacgagtcgaatcagactcacaacaactccgcttctgaactcagtggagagcaaagtcgcgctgtgatcgacatcaacgacgagcaaagcaacagtgacgcgcaagtgcttgaaattactaacgcggcgagtcacgtgacgccgatgaggaaccgaccgccgagattgggaatgccagagaggtttccgaggtcacattcgacaggacattcgcttgttctagctggagtaagcgttgagaggtacacactaagatttccagacgaggttaggaaaaagctaatgacgagaggtaaacttaagcgaacggcgagtttcaatgccgctctggcaatggaaggcagttccagaaagggtggtggaggagaagggagtagtagaggaagaaattatgtggaccggcaaattggccggtccgaccgctgggttttttcaatgactccgccgtttgtttcgaagatggggttcgttaaagttggtggtgagggtatgggattgggcgatggttggaattcgaacggaaggaacctgttgacagcagttaaatcgccgttaaattgtcttaacgtgaagattgggcaaggtggcgaatcctcctcggcaaggccccagcactactcaaagagaaatcattctttgatgagtagtgctacaaagagagaaccacga

SEQ ID NO: 1992 - protein, 410 aa, Citrus clementina
  clementine0.9_030155m
MRFENFNPSRWIIHVTWLLLLWPTLYDYASAQTVTQPPANPDGLYTTLDPSMAIIILVLISTFFIVAMFSIYVRHCSDSRAQGGVLPSRALAGLSRNRGLDPSVIESFPIFVYSAVKDLKIGKGALECAVCLSEFEDDETLRLLPKCDHVFHPHCIDVWLASHVTCPVCRANLTPESNKKVKLCDSNNESNQTHNNSASELSGEQSRAVIDINDEQSNSDAQVLEITNAASHVTPMRNRPPRLGMPERFPRSHSTGHSLVLAGVSVERYTLRFPDEVRKKLMTRGKLKRTASFNAALAMEGSSRKGGGGEGSSRGRNYVDRQIGRSDRWVFSMTPPFVSKMGFVKVGGEGMGLGDGWNSNGRNLLTAVKSPLNCLNVKIGQGGESSSARPQHYSKRNHSLMSSATKREPR

SEQ ID NO: 1993 - DNA, 1152 bp, Citrus clementina
  clementine0.9_012790m
atggggtcacgactcttaccctactccgcgaaacatgggaccaatcccctttctctcctcctcctcatgctcctcgtcgccaacgcgctccccctctcgctcgcccagcgcagccccgagtccccgggctccgtcgacccctactccaacatgaaattcagcccctcactcgccataataatcgtcgtgttgatttcggctctcttcttcatgggcttcttctccatctacatccgccactgctccgactccagcaactccgtcatccgcccctccggcgccggaggcaaccgctccaggcgcggcgccgcccgtggcctcgaccgcgaggtcatcgacactttcccgaccttcgtctactccgacgtcaagacgctgaaggtcggcaaaggcgcgctcgagtgcgccgtctgcctgaacgagttcgaggacgacgaaacgctgcgtttgatcccgaaatgcgaccacgtcttccaccccgagtgtatcgacgcctggcttgaatcgcacaccacgtgtcccgtttgccgctcgaatttggcctctgaacccggtgagacaactcctcaacccagtgagctgggctcatccgaggtggatctcgaggcccaaaacgacgccgcggtagcagcagagactccacaagaaacacaaccacaggcacaatgttcacaaccaccggaacctcaagttatcagcggcaactttgctaatcaaacgcttaataggaaccgtacacgcggctcaagatccgggaggccacgaaaattcccccggtctcactcaaccgggcattccttggtccaaccaggtgaagataccgagcggttcactttgagactaccggttgatgtgaggaaacagataatgaaccgggagctgaaccggtccaatagcttggtggttttgcccagggaagctagttcaaggaggggttaccgaccaggcggaggaggtgaaggtagtagtagagggagaaatactcggtggctggaccggtctttcaaatcagaccggtgggtgtttagcatggcaccgccatttttccaaagagcatcatcgcttaagactacaaaagtagcggccgatgatgcgcaaagtagttcggttcaaccggctggttcgtcgggtgagtcgagtcgaccgcccgtt

SEQ ID NO: 1994 - protein, 384 aa, Citrus clementina
  clementine0.9_012790m
MGSRLLPYSAKHGTNPLSLLLLMLLVANALPLSLAQRSPESPGSVDPYSNMKFSPSLAIIIVVLISALFFMGFFSIYIRHCSDSSNSVIRPSGAGGNRSRRGAARGLDREVIDTFPTFVYSDVKTLKVGKGALECAVCLNEFEDDETLRLIPKCDHVFHPECIDAWLESHTTCPVCRSNLASEPGETTPQPSELGSSEVDLEAQNDAAVAAETPQETQPQAQCSQPPEPQVISGNFANQTLNRNRTRGSRSGRPRKFPRSHSTGHSLVQPGEDTERFTLRLPVDVRKQIMNRELNRSNSLVVLPREASSRRGYRPGGGGEGSSRGRNTRWLDRSFKSDRWVFSMAPPFFQRASSLKTTKVAADDAQSSSVQPAGSSGESSRPPV

SEQ ID NO: 1995 - DNA, 1233 bp, Eucalyptus grandis
  Eucgr.B01999.1
atgagctcctccgggaatctgtccccctcgcggtcgtccctcgcgctcctgctcctgctgtggtcgtgcgcttcttccgcgccgttcgccgccgcgcaggccaaccctccgcccgacagcgagaacccgtacaactacacgcgcttcagcccctccatggcggtgatcatcgtcgtcctcatcgccgccctcttcttcatggccttcttctccatctacatccgccactgctccgacgccaactccgccagcatccgcaccggcggcggggtggtcgggacgggccggtcgcggcgcggcggcgcctcccgcggcctcgacccggccgtcatcgcgacgttcccgacgctcgtctacgccgacgtgaagggcctcaagatcgggaagggcgcgctggagtgcgcggtgtgcctgaacgagttccaggacgacgagacgctccggctgatccccaagtgcgaccacgtgttccacccggagtgcgtcgacgcgtggctggcctctcacacgacctgcccggtgtgccgcgcgaatttggtgccgcagcccggcgagggtccgttcgagctacctgagttgactcgccggtcagagctcgccggagaagacgaagagaatcagaatcgggacggggatctggagcgagcgatcgcaacgttggagcgcgaagacgccgacgaagtcgaagtcgaagtcgcggttgaccgtcaagcggccgagccgccacccgaagcggaggatccgagcaagacgctgaaccggaaccgtacgcgcggcgggtcgcgatccagcaggatggcgtggaggctcctcttcccgcggtctcactcgaccgggcactcgctggtccaaccgggggaagacacggagcggttcaagctgaggttgccggccgaggtgaggaagcagatcatgaaccggcagctgaaccgggcgatgagcatggtggtgttgccccgggaaagcagctcgcggcggggctatcgggccggagctggagaagggagcagtaggttcggcaggcacttcagcttccggcggttggaccggtccgagcctggagctaagtcggaccggtggttcttcgggatggtcccgccgctgttctcgagagcatcgtcattgaggtcgccaagggtggcggcagccagtgacgacggaggaagcgtgggttctcggcggagcaggatggaggccgctgaatcgagcggtgcgccacttcgcccgccggtt

SEQ ID NO: 1996 - protein, 411 aa, Eucalyptus grandis
  Eucgr.B01999.1
MSSSGNLSPSRSSLALLLLLWSCASSAPFAAAQANPPPDSENPYNYTRFSPSMAVIIVVLIAALFFMAFFSIYIRHCSDANSASIRTGGGVVGTGRSRRGGASRGLDPAVIATFPTLVYADVKGLKIGKGALECAVCLNEFQDDETLRLIPKCDHVFHPECVDAWLASHTTCPVCRANLVPQPGEGPFELPELTRRSELAGEDEENQNRDGDLERAIATLEREDADEVEVEVAVDRQAAEPPPEAEDPSKTLNRNRTRGGSRSSRMAWRLLFPRSHSTGHSLVQPGEDTERFKLRLPAEVRKQIMNRQLNRAMSMVVLPRESSSRRGYRAGAGEGSSRFGRHFSFRRLDRSEPGAKSDRWFFGMVPPLFSRASSLRSPRVAAASDDGGSVGSRRSRMEAAESSGAPLRPPV

SEQ ID NO: 1997 - DNA, 1206 bp, Eucalyptus grandis
  Eucgr.E00679.1
atgagctcctccgggaatctgtccccctcgcggtcgtccctcgcgctcctgctcctgctgtggtcgtgcgcttcttccgcgccgttcgccgccgcgcaggccaaccctccgcccgacagcgagaacccgtacaactacacgcgcttcagcccctccatggcggtgatcatcgtcgtcctcatcgccgccctcttcttcatggccttcttctccatctacatccgccactgctccgacgccaactccgccagcatccgcaccggcggcggggtggtcgggacgggccggtcgcggcgcggcggcgcctcccgcggcctcgacccggccgtcatcgcgacgttcccgacgctcgtctacgccgacgtgaagggcctcaagatcgggaagggcgcgctggagtgcgcggtgtgcctgaacgagttccaggacgacgagacgctccggctgatccccaagtgcgaccacgtgttccacccggagtgcgtcgacgcgtggctggcctctcacacgacctgcccggtgtgccgcgcgaatttggtgccacagcccggcgagggtccgttcgagctacctgagttgactcgccggtcagagctcgccggagaagacgaagagaatcagaatcgggacggggatctggagcgagcgatcgcaacgttggaacgcgaagacgaccacgaagtcgaagtcgaagtagcggtggaccgtcaagcggccgagccgctgcccgaagcggtggatccgagcaagacgctgaaccggaaccgtacgcgcggcgggtcgcgatccagcaggatggcgtggaggctcctcttcccgcggtctcactcgaccgggcactcgctggtccaaccgggggaagacacggagcggttcaagctgaggttgccggccgaggtgaggaagcagatcatgaaccggcagctgaaccgggcgatgagcatggtggtgttgccccgggaaagcagctcgcggcggggctatcgggccggagctggagaagggagcagtaggttcggcaggcacttcagcttccggcggttggaccggtccgagcctggagctaagtcggaccggtggttcttcgggagggtcccgccgctgttctcgagagcatcgtcattgaggtccccaagggtggcggcagccagtgacgacggaggaagcgtgggttctcggcggagcaggatggaggccgctgaatcg

SEQ ID NO: 1998 - protein, 403 aa, Eucalyptus grandis
  Eucgr.E00679.1
MSSSGNLSPSRSSLALLLLLWSCASSAPFAAAQANPPPDSENPYNYTRFSPSMAVIIVVLIAALFFMAFFSIYIRHCSDANSASIRTGGGVVGTGRSRRGGASRGLDPAVIATFPTLVYADVKGLKIGKGALECAVCLNEFQDDETLRLIPKCDHVFHPECVDAWLASHTTCPVCRANLVPQPGEGPFELPELTRRSELAGEDEENQNRDGDLERAIATLEREDDHEVEVEVAVDRQAAEPLPEAVDPSKTLNRNRTRGGSRSSRMAWRLLFPRSHSTGHSLVQPGEDTERFKLRLPAEVRKQIMNRQLNRAMSMVVLPRESSSRRGYRAGAGEGSSRFGRHFSFRRLDRSEPGAKSDRWFFGRVPPLFSRASSLRSPRVAAASDDGGSVGSRRSRMEAAESS

SEQ ID NO: 1999 - DNA, 1089 bp, Glycine max
  Glyma03g39970.1
atgaagacagtcctattcctccttctggtgtcagcgttaatccccatcgccgtcgcgcagcccaatgacttctccgacgcaaacctcaacgagttcaactcctccgtagccataatcataatcatattagtagtcgcgtttttcctcatggcctttttctccatctacgtgcgccactgcgctgattccccttccaacaccgtcaggcctctcaccaccgcacgctccaggagggccgcgcgtggccttgaccccgctctgattcaaacattccctatcctcgaatactccgttgttaagatccacaaaatcggaaaagaagctttggaatgcgctgtgtgtttgtgcgagttcgaggacaccgaaacgctgcgtttgctccccaagtgcgaccacgttttccaccccgagtgcatcgacgagtggttgagctcccacaccacgtgccccgtgtgccgcgccaacctccttcccaccgagtccgaggatgctattgctaacgccaacgccaacggtgttgttccagttccggaaacgttaacgcgagacatcgaatcccaaaacgacgccgtgcaagccgcgccagagcagcagaacgcggaggctgacccagttttacccgaaccggaagttgtttccctggacaaaacgctaaaccggaaccgcacgcgagggtcgcggtcgaaccggccgcggaggtttcccaggtcacactcgactgggcactcgctggtccaaccgggagaaaacactgaccggttcactttaaagttgcctttggaggtgaggaagcaattaataaaccgccaattacaacgtgcgagtagcttgatcgtgttaccgagggaaggtagttcgagacagggttaccgaaccgggggagaagggagtagtagaggcaaaatctcgaggcggttggaccggagtttgaaatcggaccggtggattttctcaatgactgcgcccttttttgcaagggcgttgtctattagatcgcctagggttcgaaacaacgatgttgaaggagcggcaatttgtaaactgtgtataattaataaggtatcatgttttttttttgtaggccggttt

SEQ ID NO: 2000 - protein, 363 aa, Glycine max
  Glyma03g39970.1
MKTVLFLLLVSALIPIAVAQPNDFSDANLNEFNSSVAIIIIILVVAFFLMAFFSIYVRHCADSPSNTVRPLTTARSRRAARGLDPALIQTFPILEYSVVKIHKIGKEALECAVCLCEFEDTETLRLLPKCDHVFHPECIDEWLSSHTTCPVCRANLLPTESEDAIANANANGVVPVPETLTRDIESQNDAVQAAPEQQNAEADPVLPEPEVVSLDKTLNRNRTRGSRSNRPRRFPRSHSTGHSLVQPGENTDRFTLKLPLEVRKQLINRQLQRASSLIVLPREGSSRQGYRTGGEGSSRGKISRRLDRSLKSDRWIFSMTAPFFARALSIRSPRVRNNDVEGAAICKLCIINKVSCFFFVGRF

SEQ ID NO: 2001 - DNA, 1125 bp, Glycine max
  Glyma19g42510.1
atgaagaagcacattcacatagccctattcctccttctggtgtcaccgttaatccccatcgccgtcgcgcaggcccaatcccagcccaatgacttctccgacgcaaacctcaaccagttcagcccctccatagccataatcatagtcatacttgtcgccgcgcttttcctcatggcttttttctccatctacgtacgccactgcgccgattccccttccaccaccgttagccctctcactaccgcacgctcccggagggccgcgcgtgggcttgacccagctgtgatccaaacattcccaatcctcgaatactccgaggttaagatccacaaaatcggaaaagaagcgttggaatgcgcggtgtgtttgtgcgagttcgaggacaccgaaacgctgcgtttgatccccaagtgcgatcacgttttccaccccgagtgcatcgacgagtggttgggctcccacaccacgtgtcccgtgtgccgcgccaacctcgttcccaccgactccgaggatgctattgctaacggtaacgctaacggcgttgttccagttccggagacgtttacgcgagacattgaagcccaaaacgacgccgtggaagcggcgccagagcagcagaacgcggaggctgacccagtcttacctgaaccggaagtagtttccctggacaaaacactgaaccggaaccgcacgcgagggtctcggtcgaaccggcctcggaggtttccaaggtcgcactcgaccgggcactcgctggtccaaccgggagaaaacactgaccggttcactttgaggttgcctttggaggtgaggaagcaattaataaaccgccaattgcaacgtgcgagtagcttgatcgtgttacccagggaaggtagtttgcggcagggttaccgaaccggaggagaagggagtagtagggggaagatttcgaggcggttggaccggagtttgaaatcggaccggtggattttctcgatggctgcgcccttttttgcaagggcgttgtctattagatcgcctagggttcgaaacaatgatgttgaaggaacggcgtcgtcgtcgtcgtcttccaccgcgcctatcttgccgccgacggccgttgactcggcgaggcctctggtc

SEQ ID NO: 2002 - protein, 375 aa, Glycine max
  Glyma19g42510.1
MKKHIHIALFLLLVSPLIPIAVAQAQSQPNDFSDANLNQFSPSIAIIIVILVAALFLMAFFSIYVRHCADSPSTTVSPLTTARSRRAARGLDPAVIQTFPILEYSEVKIHKIGKEALECAVCLCEFEDTETLRLIPKCDHVFHPECIDEWLGSHTTCPVCRANLVPTDSEDAIANGNANGVVPVPETFTRDIEAQNDAVEAAPEQQNAEADPVLPEPEVVSLDKTLNRNRTRGSRSNRPRRFPRSHSTGHSLVQPGENTDRFTLRLPLEVRKQLINRQLQRASSLIVLPREGSLRQGYRTGGEGSSRGKISRRLDRSLKSDRWIFSMAAPFFARALSIRSPRVRNNDVEGTASSSSSSTAPILPPTAVDSARPLV

SEQ ID NO: 2003 - DNA, 1077 bp, Glycine max
  Glyma10g29750.1
atgaataacccaaatggaggaatctgtttccttctctttctcttcctctttccttttgcggcggcgcaacctgccaccaaccaaaaccaatcctattacaacaagttcagcccttccatggccatcataatcgtcatcctcatcgccgccctctttctaatgggcttcttctccatctacatccgccactgctccgactccccctccgccagcatccgcaatctcgccgccgccactggacgctcacggcgcggcacccgcggcctcgagcaggcggtgatcgacaccttcccgacgctggagtactcggcggtgaagatccacaagctgggaaagggaactctggagtgcgctgtgtgcttgaacgagttcgaggacaccgaaacgctgcgtttaatccccaagtgtgaccacgtgttccaccccgagtgcatcgacgagtggctagcttcccacaccacttgccccgtttgccgcgccaacctcgtccctcagcccggcgagtccgtccacggaatcccaatcctcaacgctcctgaggacatcgaggcccaacacgaagcccaaaacgacctcgtcgagcccgaacagcaacagcaagaccccaagcctcccgttcccactgaacctcaagtgctgtcattaaaccagacgctgaaccggaaccgcaccagaggctcccggtcgggccggccgcggcgattcccgcggtctcactcgaccggtcattctttagtcctgccgggcgaagacactgaacggttcactttgcggcttcccgaggaagttagaaagcagatattgcagaacccgcaactgcatcgcgcgagaagcctcgttatcttaccgagagaaggtagttcgcggcgggggtatcgaaccggtgaaggaagtagcagagggagatcgtcgaggcggttggaccgggggtttaagtcggaccggtgggttttcaccatggcgccgccttttttggtgagagcgtcgtcgattaggtcgcccagggtggccaataacggtggcgaaggaacttccgctgctgcgtctttgcctccgccgcctgctgtggagtctgtt

SEQ ID NO: 2004 - protein, 359 aa, Glycine max
  Glyma10g29750.1
MNNPNGGICFLLFLFLFPFAAAQPATNQNQSYYNKFSPSMAIIIVILIAALFLMGFFSIYIRHCSDSPSASIRNLAAATGRSRRGTRGLEQAVIDTFPTLEYSAVKIHKLGKGTLECAVCLNEFEDTETLRLIPKCDHVFHPECIDEWLASHTTCPVCRANLVPQPGESVHGIPILNAPEDIEAQHEAQNDLVEPEQQQQDPKPPVPTEPQVLSLNQTLNRNRTRGSRSGRPRRFPRSHSTGHSLVLPGEDTERFTLRLPEEVRKQILQNPQLHRARSLVILPREGSSRRGYRTGEGSSRGRSSRRLDRGFKSDRWVFTMAPPFLVRASSIRSPRVANNGGEGTSAAASLPPPPAVESV

SEQ ID NO: 2005 - DNA, 878 bp, Glycine max
  Glyma20g37560.1
ggaatttgtatccttctctttctcttcctccttccttttgctgcggcacaacatggcaaccaaaacgaatcgtattacaacaagttcagcccttccatggcgatcataatcgtgatcctcatcgccgcgctgtttctaatgggcttcttctccatctacatccgccactgctccggctccccctccgccagcatccgcaacctccctgccgcctccgggaggtcgcggcgcggctcgcgcgggctcgaccaggcggtgatcgacacgttcccgacgctggagtactcgacggtgaatatccacaagctgggaaaggggacgctggagtgtgcggtgtgcttgaacgagtttgaggacaccgaaacgctgcgtttgatccccaagtgcgaccacgtgttccaccccgagtgcatcgacgagtggctagcttcccacaccacttgccccgtgtgccgcgccaacctcgtcccccagcccggcgactccacgctgaaccggaaccgcaccagaggctcccagtcgggccggccccggcggttcccgcgctcacactcgaccggccattctttggtccaacctggcgaggatactgaacggttcactctgaggcttccccagaaagttagaaagcagatactgcagaagccggaactgcatcgcgcgagaagcttggttatcttaccgagagaaggtagttcgcggcggggatatcgaaccggtgagggaagtagcagagggaggtcctcgaggcggttggaccggtgggttttcagcatggcgccggctttctttgtgagagcgtcgtcgattaggtcgcccagggtggccaataacggcgccgacggaacttccgctactgcgcctttgccgcctgctgt

SEQ ID NO: 2006 - protein, 294 aa, Glycine max
  misc_feature (294)..(294): Xaa can be any naturally occurring amino acid
  Glyma20g37560.1
GICILLFLFLLPFAAAQHGNQNESYYNKFSPSMAIIIVILIAALFLMGFFSIYIRHCSGSPSASIRNLPAASGRSRRGSRGLDQAVIDTFPTLEYSTVNIHKLGKGTLECAVCLNEFEDTETLRLIPKCDHVFHPECIDEWLASHTTCPVCRANLVPQPGDSTLNRNRTRGSQSGRPRRFPRSHSTGHSLVQPGEDTERFTLRLPQKVRKQILQKPELHRARSLVILPREGSSRRGYRTGEGSSRGRSSRRLDRWVFSMAPAFFVRASSIRSPRVANNGADGTSATAPLPPAVX

SEQ ID NO: 2007 - DNA, 1011 bp, Eucalyptus grandis
  Eucgr.H04469.1
ccggcgcccaccccgcccagcgacgagtcctcccccgccccgggctacggcgccttcagcaactccatcggcctcgtcctggtcgccctcgtcatcgtcatcttcctcctcgccaccttctccgcctacatcctccgctgctccccggcccccgagggctccatcggccgcgccgtccgctccctccgccgcctcggcgccccgccccgcggcctcgaccccgccgtcgtcgagaccttcacgaccgtcgcgtacgccgcggtgaaggggcacaggatcggcgagaggtcgctggagtgcgcggtgtgcctgaacgacttcgaggacgacgacaccctccgcctgatccccaagtgcgaccacgcgttccacccggactgcatcggcgagtggctcgcctcccacaccacctgccccgtctgccgcgccgacctcgcctcgcagccggccgacgacccggagagcccgcaggccgagccgccgtcggtcgaggcggctccgcccgatggcggcgcgccggagaggagcccgcgggagggagggccagagcggatccagccgccagatccatgggacaagaaggagagcggcggcaccaccaatcgcaaccggacacgtggctcgagcagtaggatcggaaggtttccccgatcccactcgaccggccactcgctggtccgaccgggcgacgacacggagcggttcaccctgaggctgcccgccgatgtgaggaagcgattgatgatggaccggcccgggccggccctgccccaggaaggttgctcgaggcgaggataccggtacggcgaagggagcagccgagggcggtactacaggaggctggaccggttggactcggcacccgcgtcggaaggctgggctttcaataggatgccatccttcttggtgcgcatgtcgtcggccctctcacctagagtggccgccgctgctgccgccaggagcggtggagggtccttccgtggtccagcgcaacaggcccgaccgcccatt

SEQ ID NO: 2008 - protein, 337 aa, Eucalyptus grandis
  Eucgr.H04469.1
PAPTPPSDESSPAPGYGAFSNSIGLVLVALVIVIFLLATFSAYILRCSPAPEGSIGRAVRSLRRLGAPPRGLDPAVVETFTTVAYAAVKGHRIGERSLECAVCLNDFEDDDTLRLIPKCDHAFHPDCIGEWLASHTTCPVCRADLASQPADDPESPQAEPPSVEAAPPDGGAPERSPREGGPERIQPPDPWDKKESGGTTNRNRTRGSSSRIGRFPRSHSTGHSLVRPGDDTERFTLRLPADVRKRLMMDRPGPALPQEGCSRRGYRYGEGSSRGRYYRRLDRLDSAPASEGWAFNRMPSFLVRMSSALSPRVAAAAAARSGGGSFRGPAQQARPPI

SEQ ID NO: 2009 - DNA, 1155 bp, Populus trichocarpa
  POPTR_0005s03900.1
atgtacaccatggattcttacaggttcacacacatgatcctccccctcttagttctcttcatcttgtcaacacctcatggtgtcgtttcccaaaccaccaacacgaacgacgggcagccgtacaactacgcgcgggtgactccatcgatggccataatcattgtcgttttgatagccgtactcttcatcatggggttcttttcaatctacatccgccattgcaacgaagccaacggcaacgggagtatccggccgctgggtatgggcggactctctcgacgggtcgccgcctcgcgtgggcttgatcctgccgttatcgagacgtttcccacgttaatttactcggtcgtgaaaggcttgaagattggtaaaggcgcgttagaatgcgccgtttgtttaaacgaatttgaagaggatgaaacgctgcgtttgattcctaattgtgaccacgtgttccatcctgattgcatcggtgcttggttggagtctcacactacctgtcctgtctgcagagctgatttgaccaagccagctgactcggtccctcaactcggtgagtcgcacgaccccgagctggacctggaggcccaaaatggggcagtgatggacgagccagaaaatgggaatgctaatgtggaagtggttggaccggagcctgaggttatgggtgcgagtgtggttaaaactttgaacaggaaccggacacgtgggtcgagatcgggtaggccattgaggtttactaggtcacattcgaccggacattctgtggttcaaccaggagagaataccgatcggtttactttgagattgccggttgaggttaggaaacaagtgatgaaccggaagttgaaccgggcgatgagcatggtggtgttgtccagacaaggaagttcagtgaaggggaacaagaacggagttggtgaagggagtcctaggaaggtgtttaattataagcgacttgagaaactggaccaagaagcaaggtcggaccggtgggtttttagtcggaacccgtcattgctagcaagagcgtcgtcattcctatcgagagcttcgtcatcggttaggtcaccaaaagtggctgctaatggcaaccaaggggattcacctagacaggttggaccgaatgcgggtgaatcgagcagaccgctggtt

SEQ ID NO: 2010 - protein, 385 aa, Populus trichocarpa
  POPTR_0005s03900.1
MYTMDSYRFTHMILPLLVLFILSTPHGVVSQTTNTNDGQPYNYARVTPSMAIIIVVLIAVLFIMGFFSIYIRHCNEANGNGSIRPLGMGGLSRRVAASRGLDPAVIETFPTLIYSVVKGLKIGKGALECAVCLNEFEEDETLRLIPNCDHVFHPDCIGAWLESHTTCPVCRADLTKPADSVPQLGESHDPELDLEAQNGAVMDEPENGNANVEVVGPEPEVMGASVVKTLNRNRTRGSRSGRPLRFTRSHSTGHSVVQPGENTDRFTLRLPVEVRKQVMNRKLNRAMSMVVLSRQGSSVKGNKNGVGEGSPRKVFNYKRLEKLDQEARSDRWVFSRNPSLLARASSFLSRASSSVRSPKVAANGNQGDSPRQVGPNAGESSRPLV

SEQ ID NO: 2011 - DNA, 1158 bp, Populus trichocarpa
  POPTR_0013s02670.1
atggattcttacacgttcatacacaggatccttcctctcttgattctcttcttccttgcaactccttgcggtgtcgtttcgcaaaacaacagctcgaacgacaggggaatgtacaacaactacgcgcaggtgacaccgtcgatggcgattatcattgtcgttttggtagctgctctcttctccatgggcttcttctcaatctacatccgccactgcaacgaagccagcgcaaacgggagtatcagggcattgggtgtagtcggactctctcgacgggccgccgcatcgcgtgggcttgatcctggcgttatcgagacgtttccgactttaatctactcggttgtgaaaggcttgaagattggtaacggcgcgttagaatgcgccgtttgtttaaacgaattcgaagacgatgaaacgctgcgtttgattccgaattgtgaccacgtcttccatcctgattgcattgatgcttggctggagtctcacactacctgtcctgtttgtagagctgatttgaccaaacccgccgacacggtatcccaactcagtgaattgcacagccccgagttggacctcgaggcccaaaacggcgcccttgggatcgagccagaaaacgggaatgctaatgtggaagtgcaagtggttggacctgagcctgacgatgtgagtgtgaatgtgaataaaactttgaataggaaccggacacgtgggtcaagatcgggtaggccaccgaggtttcctcggtcacattcgaccgggcattctttggttcaaccgggagagaacaccgatcgctttactttgagattgccggttgaggttaggaaacaggtgatgaaccggaagttgaaccggtctacgagtatggtggtgctgcctagacaaggaagttcaaggaagggttataggaccggagttggtgaagggagttcaagaaaggtgttaaattataagagacttgagaaattggacctagaaccgaggtcagaccggtgggtttttggtaggaacccgtcattcttagcaagagcgtcgtcgtttctatcgagagcttcatcgtcggttaggtcaccaaaagtggtggctgctagtgaaaaccaagggggttcgtctagactcggtggatcagacggaggtgaatctagcagaccaccggtt

SEQ ID NO: 2012 - protein, 386 aa, Populus trichocarpa
  POPTR_0013s02670.1
MDSYTFIHRILPLLILFFLATPCGVVSQNNSSNDRGMYNNYAQVTPSMAIIIVVLVAALFSMGFFSIYIRHCNEASANGSIRALGVVGLSRRAAASRGLDPGVIETFPTLIYSVVKGLKIGNGALECAVCLNEFEDDETLRLIPNCDHVFHPDCIDAWLESHTTCPVCRADLTKPADTVSQLSELHSPELDLEAQNGALGIEPENGNANVEVQVVGPEPDDVSVNVNKTLNRNRTRGSRSGRPPRFPRSHSTGHSLVQPGENTDRFTLRLPVEVRKQVMNRKLNRSTSMVVLPRQGSSRKGYRTGVGEGSSRKVLNYKRLEKLDLEPRSDRWVFGRNPSFLARASSFLSRASSSVRSPKVVAASENQGGSSRLGGSDGGESSRPPV

SEQ ID NO: 2013 - DNA, 1329 bp, Vitis vinifera
  GSVIVT01000015001
atgggaaggtgtgtctgttgtgggtccattctaaagtcagagcttagaacagagtctataaaaagaaaaaattataccgaggcgatgatcagcggttcagtttcccaggcgaacaggaatggtgccactctcgtttgtgggctgcttcgctttggtggcttttctcagcatggcacggtgtctctctggattctcttgctcttgctgcctttcgccggagctcagtccgacacgtccaacgatccgtaccagcagcagcggttcagttcatccatggcaattattatcgtaatccttgtagctgcgctcttcttgatgggattcttctccgtatacatccgtcactgctccgactcgcgtaacggcgggagtattcgcgcggccgccggagccgctcttggtcggtcgcgacgcggtacgcgtggtctggatcaggcggtgctcgaaacatttcccacgtttgagtattctgtcgtgaaagggctcaagatcgggaaaggcgtgctggagtgcgccgtgtgcctgaatgagtttgaggataatgaaactctgcgtttgattccgaagtgcgatcacgtgttccatccggagtgcatcgatgcttggctggcttcgcacgttacgtgcccggtatgccgcgcgaacctgactgagccggcggtgcccaccgactattccgctgctgtggaagcggcggaatcagccggtgaatccgatcatgacggtgaggataggagatcggagatcaacgcttttcctcggtcgcactctaccggtcactcgctcatccaaccaggcgagaactgcgagcggttcactctgaagctgccggaggacgtgcgcaaacagataatgaagcgagctctaaaccgcacgacgagtctcttggtgttgccaagggatgggagctcgcggcagggataccgaaccgccggcgaaggaagcagccgaggaaaaaacttccgccgttttgaccgtttggagcggtcggggaagtcggatcggtggactttctccataactccgccgttcttctccagagcatcgtcgttaaaatcgccgaaggtggctgccgacggcgaggcaacatcctcaacttcaccgcgcaagcctacattgactcccaaggcgtcttttggtgccaaacgcgatcccgccggaacaccaccggtcggctcccctcgacaacctgtcggctccccgcgaccaccgctgtcagaatcttattatagacgaatgacagttggttttttcacaaaattggaaatgaaaaacaaagagcgtgaattttattttcatgtttggatgagcaaagaaaatttatattta

SEQ ID NO: 2014 - protein, 443 aa, Vitis vinifera
  GSVIVT01000015001
MGRCVCCGSILKSELRTESIKRKNYTEAMISGSVSQANRNGATLVCGLLRFGGFSQHGTVSLWILLLLLPFAGAQSDTSNDPYQQQRFSSSMAIIIVILVAALFLMGFFSVYIRHCSDSRNGGSIRAAAGAALGRSRRGTRGLDQAVLETFPTFEYSVVKGLKIGKGVLECAVCLNEFEDNETLRLIPKCDHVFHPECIDAWLASHVTCPVCRANLTEPAVPTDYSAAVEAAESAGESDHDGEDRRSEINAFPRSHSTGHSLIQPGENCERFTLKLPEDVRKQIMKRALNRTTSLLVLPRDGSSRQGYRTAGEGSSRGKNFRRFDRLERSGKSDRWTFSITPPFFSRASSLKSPKVAADGEATSSTSPRKPTLTPKASFGAKRDPAGTPPVGSPRQPVGSPRPPLSESYYRRMTVGFFTKLEMKNKEREFYFHVWMSKENLYL

SEQ ID NO: 2015 - DNA, 1194 bp, Solanum lycopersicum
  Solyc03g112340.1.1
atggttaattttaaagctctttccgttaatctcctcctattagtattactatgtccggcgtcagctcagccatcaaattcccctgattccgagaatcggttcgagtacccgagtgtcagtcctgctatggcaattatcatagtgatacttattgctgctctttttttcattgccttcttctcaatttacatacgcaaccgcggtgcagttaacggaagcatcggtcaaaccttctccatgcgacggcgtactgctgctgctactcgaggacttgaagattccgtcatcgagacttttcctacctttacttacgtcgaagtaaaggatcatcatattgggaagggagctttggagtgtgccgtgtgtctgaacgaatttgaagatgatgaaatgttgcgtttgatccctaagtgtgatcacgtttttcatcctgaatgcatcgatgcttggctcaaatctcatgtaacttgccctgtttgccgagctgatcttactcctaaacctgatgaaccggtgccggttcaaactcctgaggtgaaccgggaattggggcaagaacaggagaatacacagcaaaataacgaagttacgattcaaatagatgtagatgagaatttgatgtcacagcaagaggagacctctgtaaaaccagaagttaaacgaaatttgagtttcaacgcggtgaaccggccgccgaggtctttttctctgaagagaccaaagatgttaagcaaattcaggtcacattcgaccggtcactcattagtggtaccaggggagaatttagaccggtatactcttagattgccggagaaggtgaggaaagatgtaatggaccgggctctactaaaccggacaaggagctgtgcagtcacgctaccaagacacggtagcaccacaagaggatacagagccggtccaggagagggaagcaacagaggtgcaaggtcattcaagcgaatcgaccggttcgatccggaaacaaaatcagaccggtggtttctcaagattgcaccgccattctttaccagaggttcatcaatgaagtcaccaaaagtaagagctgataacgaagaagcatccacatcacgcagcaatatgaaagtagcagtaaaattgccgtccttccaatgcctggagccgaaaggtgatgaaccgggtttaatggcaaatgactcggctcgatctccggtt

SEQ ID NO: 2016 - protein, 398 aa, Solanum lycopersicum
  Solyc03g112340.1.1
MVNFKALSVNLLLLVLLCPASAQPSNSPDSENRFEYPSVSPAMAIIIVILIAALFFIAFFSIYIRNRGAVNGSIGQTFSMRRRTAAATRGLEDSVIETFPTFTYVEVKDHHIGKGALECAVCLNEFEDDEMLRLIPKCDHVFHPECIDAWLKSHVTCPVCRADLTPKPDEPVPVQTPEVNRELGQEQENTQQNNEVTIQIDVDENLMSQQEETSVKPEVKRNLSFNAVNRPPRSFSLKRPKMLSKFRSHSTGHSLVVPGENLDRYTLRLPEKVRKDVMDRALLNRTRSCAVTLPRHGSTTRGYRAGPGEGSNRGARSFKRIDRFDPETKSDRWFLKIAPPFFTRGSSMKSPKVRADNEEASTSRSNMKVAVKLPSFQCLEPKGDEPGLMANDSARSPV

SEQ ID NO: 2017 - DNA, 1224 bp, Citrus clementina
  clementine0.9_011752m
atgactgttctaacgcttaatccgagccgttcaattttcaatcctatgatatgcgatcatggcgtggtcaactttctttttctctttctctatctccacgccttaccgtatgtcaccgcacaaactccaccgccgccaccggacgcgttttctgttacggggccgaaattcaacggtactatggccatagtaaccgtaatattggtcagcgttttcttcatcttgggcttcttctccgtttacatccgtcagtgcactgaaaggggccgaaacagccctgacgcttttgctactataattggagggatcaaccaacggtcccgcagaggggcgcgcgggcttgacgattctgttatcaacacttttcccaccttcctctactcggcggtcagagagcttaaaatcggcaagggttctttagaatgcgcggtttgcttgaacgagtttggagatgaggaaacgctgcgtttgataccaaagtgtagccacgtgtttcacatggattgcatcgacgcttggttgtctgctcataacacgtgtcccgtctgccgcgcaaatttggtgccacaacctggcgaaactccctccagcttcattccagttcttaacccggatgttggctcgagtcgattggaacaaggttcagataatattcaagagatttcatcgactgatgtgcagaggagagatgaagaagctcctgacgtgatcctgaccaatcagaataggccacctagatcgagatcgatagggtggaggaggccgtccggttggtttccacgttcacactccaccggtcactcagtggtccaaccgggtcaagattgtgagaggtttacgctaaggttaccggcggaggtacggagtcaactaatgaactcttctttgagtagaagcaagagttgcgtggcgtttcctagtgtgaggagttcgagaaggggttttagaagtgggagcggaggatttgtgcttggaaggaaccacaatcaccatttgtacgagcggttcggtccaccgtctcgatccggcaactgggggcttggtttggctccgccttttatttcaagaaccggttcggttcggactccaagaacaacgggtgatggtgttgaggtatcttgtcttccatcaaagaatttatttagttctgcaaaatcatcatcgttcgaagatgacagagaaggggaacgatcatctgataggctccgacctgataatcaagtt

SEQ ID NO: 2018 - protein, 408 aa, Citrus clementina
  clementine0.9_011752m
MTVLTLNPSRSIFNPMICDHGVVNFLFLFLYLHALPYVTAQTPPPPPDAFSVTGPKFNGTMAIVTVILVSVFFILGFFSVYIRQCTERGRNSPDAFATIIGGINQRSRRGARGLDDSVINTFPTFLYSAVRELKIGKGSLECAVCLNEFGDEETLRLIPKCSHVFHMDCIDAWLSAHNTCPVCRANLVPQPGETPSSFIPVLNPDVGSSRLEQGSDNIQEISSTDVQRRDEEAPDVILTNQNRPPRSRSIGWRRPSGWFPRSHSTGHSVVQPGQDCERFTLRLPAEVRSQLMNSSLSRSKSCVAFPSVRSSRRGFRSGSGGFVLGRNHNHHLYERFGPPSRSGNWGLGLAPPFISRTGSVRTPRTTGDGVEVSCLPSKNLFSSAKSSSFEDDREGERSSDRLRPDNQV

SEQ ID NO: 2019 - DNA, 1260 bp, Eucalyptus grandis
  Eucgr.F00384.1
atgagggatcctccacttcatggccgccctcgcgcgctccagctcctccccctcctcctcttgctcctgtccgttcgcgccgcttcccagaacaaccccgcggcggtagacggaccccctactccgccggcccccctccaggacggccagaggttcaactcctccatggccgtaatcatggtggtcctggtcagcgccttcttcgtcatgggcttcttctccgtctacgtccgccagtgcgccgcccggcggaacggccgcggcgatcccgcggggtcctacgccttcgggcggcggtcgctgcggggggcggcgcgcgggctcgacccctcggtcatcgacgccttccccacgttcctgtactcgtcggtgaaggggctcaagatcgggaaaggggcgctggagtgcgcggtgtgcctgaacgagttccaggacgacgagacgctccgcctgatccccaagtgcagccacgcgttccacccggactgcatcgactcctggctctcgtcgcacaccacctgtcctgtctgccgggccgacctcgcgctcaaacccggcgaggtcctccctccggccgtgcagctactcgaccaggacccggcacccgacgccggcggttcccagggtcacgtcagcgtccatgtcagtccccaccacgatgagccgcgaccgccgagtgaaggagtcaagccatcgcccaggcgggacgcgaattctacagccgatgagggcgcgccgcgtcggtcgagctccaccgggatgcgcctcgcgaggatgttccgtttcccgcggtcgcactccacgggccactcgctgtggctggtccgaccgggcgacgactgcgagcggttcacgctgaggctgcccgaggacgtgcggacccggatcatcaacgacgcgcggctggagagggcgaggagctgcgtcgcgttcccccgggcgagcagcccgaggaccgcttaccggagcgggagcagccggcgcggcgggagggacccgccgctgatcaacgagcggttcgaccgggaaggccggtacgccaagtgggcgttctccatgacgccgccgttcatctccaaaactggttcggcaagggcgggggcgaggcaagccgccgccgccgtcgaggtgggtaggagcccgctgaggagctcttcgaagccggataagtcgccgccgttcgaccggtggttcgtggggagggacgtggaggcgggcgagcggtcgaccgattggcttcggcagccgagcagtcaaact

SEQ ID NO: 2020 - protein, 420 aa, Eucalyptus grandis
  Eucgr.F00384.1
MRDPPLHGRPRALQLLPLLLLLLSVRAASQNNPAAVDGPPTPPAPLQDGQRFNSSMAVIMVVLVSAFFVMGFFSVYVRQCAARRNGRGDPAGSYAFGRRSLRGAARGLDPSVIDAFPTFLYSSVKGLKIGKGALECAVCLNEFQDDETLRLIPKCSHAFHPDCIDSWLSSHTTCPVCRADLALKPGEVLPPAVQLLDQDPAPDAGGSQGHVSVHVSPHHDEPRPPSEGVKPSPRRDANSTADEGAPRRSSSTGMRLARMFRFPRSHSTGHSLWLVRPGDDCERFTLRLPEDVRTRIINDARLERARSCVAFPRASSPRTAYRSGSSRRGGRDPPLINERFDREGRYAKWAFSMTPPFISKTGSARAGARQAAAAVEVGRSPLRSSSKPDKSPPFDRWFVGRDVEAGERSTDWLRQPSSQT

SEQ ID NO: 2021 - DNA, 1020 bp, Glycine max
  Glyma04g10610.1
atgaccactttcacacactccattttccaccatgaccttctttttcttttctatttctttctcctcacggaatttccgccgcaggccaccgcgcagcctccgaacacgctgacgccgccgccgcagcaggaccgctttacgaggctgaagttcgacaaatccatggccatcgttctgctgatcctggtggtggtgttcttcatcctagggttcctctccgtgtacacgcgccagtgcgcggagcgcaggatgggagggaggttcgacctctccatcttgatctcgcgccggcaacgcggcctcggccgcgaagtcatcgaaacgttcccgacgttcgtgtactccaccgtgaagagcctcaagatagggcgcgccacgctagaatgcgccgtgtgcctaaacgagttcgaggaggatgaaacgctacgtttcatccccaactgcagccacgtgttccactccgactgcatcgacgcgtggctcgcaaaccactccacttgccccgtctgtcgcgccaatcttacttccaaacccgatgaccggtgttctgctcctatccaaaacccggatccggagcagcccgttttaacctcatcaacccgacccgaaaccgtgggtgctgatttgcttagtcagaaccgtacaccgccgcgaccatggtcaacgggtcttagtatcgcgagttggtttccgcggtctcactcgacggggcactcgctggttcaacccggggagaattgtgaacggtttacgctgcgtttgcctgaggaagtgcggaacgagcttatgctgagtcgcaccaagagttgcggcgtgagcgtgacgttcacgcgcgagaatagtggaaggaggggttacagggcaaggagccttggtagcagcctcagccctcacgtgacaagaaacagcaccagtcctcacgtgaggtggtggttttctcggccacgctcgattaaggatgatgtcggggaacggtcttcggatcggttattctccacgacaagggatattagtgaggtt

SEQ ID NO: 2022 - protein, 340 aa, Glycine max
  Glyma04g10610.1
MTTFTHSIFHHDLLFLFYFFLLTEFPPQATAQPPNTLTPPPQQDRFTRLKFDKSMAIVLLILVVVFFILGFLSVYTRQCAERRMGGRFDLSILISRRQRGLGREVIETFPTFVYSTVKSLKIGRATLECAVCLNEFEEDETLRFIPNCSHVFHSDCIDAWLANHSTCPVCRANLTSKPDDRCSAPIQNPDPEQPVLTSSTRPETVGADLLSQNRTPPRPWSTGLSIASWFPRSHSTGHSLVQPGENCERFTLRLPEEVRNELMLSRTKSCGVSVTFTRENSGRRGYRARSLGSSLSPHVTRNSTSPHVRWWFSRPRSIKDDVGERSSDRLFSTTRDISEV

SEQ ID NO: 2023 - DNA, 1038 bp, Vitis vinifera
  GSVIVT01009098001
atgtttccaattttcaatttcaatggcgtcgcttgcctgctcaacatctctcttctgctgcccctgttatcctgcgcaaccgctcagaccgccgcagagcagtctcccccgccctccgaactcatgtcgttagcgcagaagttcaacccctccatggctattgtaatgatcgccatcgtaagcgccttcttctttatggggtttttctcagtttacctccgccagtgtatcgaacgccgcgtccgcggacgattcaacacggaaatcgttggaattggcggacatcgctcgtggatggcggctcgtggtctgaacagctcggatatcgagaggtttcccactttcgtatactcggcggtaaaggcgcacaagatagggaaagaggggctggaatgcgcggtgtgcctaaacgagttcgaagacgatgaaacgctgcgtttgctccccaagtgcaatcacgtgtttcactccgactgtatcgatctttggttggcctctcacgtcacttgtcctgtttgtcgtgccaaccttactcccaaaccaggtgaaaaattctgcgctcccgtacccatttttgggccggaaactgaatccgatgaatcggacaccagagtagagatcgttgagacgccaaaccaaaatcgcgagaggtttacgctcagattaccggaggagataagaaatcagatcatgaatacgagtttaagtcgtacaaagagttgggtagcattgccgggtgtgcagagctcgaaaaggggatacagggccaatagtgtgggaagtcttcggggaaagacctattttaactacgagcaattcaacggggaggtcagggcggaacggttgggtttttccatgacgccacctttcgtcccaaggacaggttcctcccacgcccgctcgccccagggctgcgagggatctttgactcctaagactctcttcaggtccctaaaatcccccttcgatcgtctttttcttccgggaggcagcgttggtgaacgcctatctgatagaccccgctccgatagtcccgtt

SEQ ID NO: 2024 - protein, 346 aa, Vitis vinifera
  GSVIVT01009098001
MFPIFNFNGVACLLNISLLLPLLSCATAQTAAEQSPPPSELMSLAQKFNPSMAIVMIAIVSAFFFMGFFSVYLRQCIERRVRGRFNTEIVGIGGHRSWMAARGLNSSDIERFPTFVYSAVKAHKIGKEGLECAVCLNEFEDDETLRLLPKCNHVFHSDCIDLWLASHVTCPVCRANLTPKPGEKFCAPVPIFGPETESDESDTRVEIVETPNQNRERFTLRLPEEIRNQIMNTSLSRTKSWVALPGVQSSKRGYRANSVGSLRGKTYFNYEQFNGEVRAERLGFSMTPPFVPRTGSSHARSPQGCEGSLTPKTLFRSLKSPFDRLFLPGGSVGERLSDRPRSDSPV

SEQ ID NO: 2025 - DNA, 1179 bp, Solanum lycopersicum
  Solyc04g074820.1.1
atgaagatgataatcgagctaagccatggtttctgctcgatttccctttgtttattcctgctcgcgatgcatgttatatcgcaatcagaaataacaccatcaccaccatcaccaccaccattttcatttgatacgaaaataaaaatcaacccacctacggctatcattttagttacacttatcagtgttttcttcgctatgggaattgtttcagtctacgtccgtcaatgcgccgaccgccgcttcatcggcgacttcgaattagcagacgaagattctggacgacgcggcgctcgatcgcatggactagacccagtcgtaattacctctttccctatgtttttttactctgatgttaaacatcacaaaattgggaaatcagtgttagaatgtgcgatttgtttaaacgaattcgaagatgctgaagctcttcgacttcttcctaaatgctctcatgtttttcatccaaattgcatcgacgcttggttattttctcatattacctgccctgtttgtcgtgccaatttactccctgaccccagcgatttcgataaaatcgctactccggtttattactcgaattccgggtcacctgacctggaattcggtaactcggtaactatagatatcaacaatattgcttcacctgaagtgataaatgtagcacaaacacctgtacataatcgtccaccaaggacgaattcgaaaattacaggaaaatttccaaggtctcactcgacgggtcactcaccggttcgacccgatgaagatcgcgagcggtttacgttaaggttaccggaggaggttcgagagaaattgattaattcaggttcgagtcgagcacaaaccaactcgatatttccaagtgaaagaagtatgccaaaaggttacagaagtagtagcgtgggaaccggttcaacacgtattaatcatgaaaattatgagcggtttaatgaggaaggccgggtagaccggtgggggtttataccggttccacctttcttctcgagaggcggttcaacccgctcgtctaaggatggtaacggaactggagatgatataacggcggtttctaagaatttgtttaagactgttaagtcgccgttcgatcgcatttttgagaaaaacagtagtggtgaaggatcgtttgataaacttaggtcaggtagtacaagtagt

SEQ ID NO: 2026 - protein, 393 aa, Solanum lycopersicum
  Solyc04g074820.1.1
MKMIIELSHGFCSISLCLFLLAMHVISQSEITPSPPSPPPFSFDTKIKINPPTAIILVTLISVFFAMGIVSVYVRQCADRRFIGDFELADEDSGRRGARSHGLDPVVITSFPMFFYSDVKHHKIGKSVLECAICLNEFEDAEALRLLPKCSHVFHPNCIDAWLFSHITCPVCRANLLPDPSDFDKIATPVYYSNSGSPDLEFGNSVTIDINNIASPEVINVAQTPVHNRPPRTNSKITGKFPRSHSTGHSPVRPDEDRERFTLRLPEEVREKLINSGSSRAQTNSIFPSERSMPKGYRSSSVGTGSTRINHENYERFNEEGRVDRWGFIPVPPFFSRGGSTRSSKDGNGTGDDITAVSKNLFKTVKSPFDRIFEKNSSGEGSFDKLRSGSTSS

SEQ ID NO: 2027 - DNA, 456 bp, Arabidopsis thaliana
  AT2G34450.2
atgacgaagagagctcccaagtcagggcctttgtctccgtcgtgcagcggaggctctagtcggaacttagagttggctgtgaagtcaagtgaaggtgcaaggaggtctacaagactgagacttcagcctttgagaaagccaaagacaagccccaagaagaaacccgttaaactccaaacgaagatgcccaagaaacctgccactgctttcttctttttcctggatgatttccggaagcaatatcaagaggagaatccagatgtcaagtccatgcgcgaggttattgggaagacatgtggagagaaatggaaaacaatgacttacgaggaaaaggtaaagtattatgatatagctactgagaagagggaagaatttcaccgagcaatgacagaatataccaagagaatggaatcaggtgcccacgatgaatcagagaccgactcagactattctgaa

SEQ ID NO: 2028 - protein, 152 aa, Arabidopsis thaliana
  AT2G34450.2
MTKRAPKSGPLSPSCSGGSSRNLELAVKSSEGARRSTRLRLQPLRKPKTSPKKKPVKLQTKMPKKPATAFFFFLDDFRKQYQEENPDVKSMREVIGKTCGEKWKTMTYEEKVKYYDIATEKREEFHRAMTEYTKRMESGAHDESETDSDYSE

SEQ ID NO: 2029 - DNA, 381 bp, Brachypodium distachyon
  Bradi2g45927.1
atgaagaccaggtcgcagacgggcccgaagcccctcaataccgtgcgactgccccccgtggcgagccccaggacgaagccgaggccggagccgcggaagaaggggacagtcggcgacccccgccgccccaagaagccccccaccgccttcttctatttcatggaggattttcgggacaaatttaaggcagaaaatccaagtgtaaaatcaatgcaggatatagggagggcatgtggcgagaaatggaataaaatggcatttgaggaaaaagtgaagtattatgatctagctactgagaggcgtgcagagtttgagaaggctatggctcaatataacaagaaaaagataagtggtgaactgtcggaggaatcagattatgag

SEQ ID NO: 2030 - protein, 127 aa, Brachypodium distachyon
  Bradi2g45927.1
MKTRSQTGPKPLNTVRLPPVASPRTKPRPEPRKKGTVGDPRRPKKPPTAFFYFMEDFRDKFKAENPSVKSMQDIGRACGEKWNKMAFEEKVKYYDLATERRAEFEKAMAQYNKKKISGELSEESDYE

SEQ ID NO: 2031 - DNA, 399 bp, Oryza sativa
  LOC_Os01g47600.1
atgaagacgaggtcgcagacggcgccgaagccgctgaaaacggtgcggctgcctcctgtcaagccgcggcccaagccgccgccgccgcagccgcagccgccgccgtcccggaagaaggggcagcccctcgtcgaccggcgccgccccaagaagccgcccaccgccttcttctacttcatggaggattttcggaaaacttacaaggaagaaaatccaagtgtaaaatcaatgcaagaagtagggaaggcatgtggcgagaaatggaatacaatgacatttgaggaaagagtgaagtattatgatatagcaaccgagaagcgtgcagagtatgagaaggcggtggctgaatttgacaagaaaaaggaaagcggtgaattgtccgaggaatcagattacgac

SEQ ID NO: 2032 - protein, 133 aa, Oryza sativa
  LOC_Os01g47600.1
MKTRSQTAPKPLKTVRLPPVKPRPKPPPPQPQPPPSRKKGQPLVDRRRPKKPPTAFFYFMEDFRKTYKEENPSVKSMQEVGKACGEKWNTMTFEERVKYYDIATEKRAEYEKAVAEFDKKKESGELSEESDYD

SEQ ID NO: 2033 - DNA, 345 bp, Zea mays
  GRMZM2G024247_T01
atgaagactaggtcgcagacgtcgccgaagcctctcaagacggtggcgatggctcccaggccgagcagcaccaagcggaagccgaggcccaagccggcggggaagggcgacccccgcgcacccaagaagccacccaccgccttcttctacttcatggaggattttcgcaagatctataagcaagaaaaaccaagtgtaaaatcaatgcaggaaatagggaaggcatgtggcgaaaaatggaatacaatgacatttgaggaaaaggtcaagtattatgatatagctactgagaaacgtgcagaatttgagaaggcgatgattgaatataacaagaaaaaggaaagc

SEQ ID NO: 2034 - protein, 115 aa, Zea mays
  GRMZM2G024247_T01
MKTRSQTSPKPLKTVAMAPRPSSTKRKPRPKPAGKGDPRAPKKPPTAFFYFMEDFRKIYKQEKPSVKSMQEIGKACGEKWNTMTFEEKVKYYDIATEKRAEFEKAMIEYNKKKES

SEQ ID NO: 2035 - DNA, 354 bp, Zea mays
  GRMZM2G024247_T02
atgaagactaggtcgcagacgtcgccgaagcctctcaagacggtggcgatggctcccaggccgagcagcaccaagcggaagccgaggcccaagccggcggggaagggcgacccccgcgcacccaagaagccacccaccgccttcttctacttcatggaggattttcgcaagatctataagcaagaaaaaccaagtgtaaaatcaatgcaggaaatagggaaggcatgtggcgaaaaatggaatacaatgacatttgaggtcagcattttctccttgcagcctgatagtcgtgttccattagttatttaccaccttatgctgcctgctgatgtaaattgcttgattccacaatgg

SEQ ID NO: 2036 - protein, 118 aa, Zea mays
  GRMZM2G024247_T02
MKTRSQTSPKPLKTVAMAPRPSSTKRKPRPKPAGKGDPRAPKKPPTAFFYFMEDFRKIYKQEKPSVKSMQEIGKACGEKWNTMTFEVSIFSLQPDSRVPLVIYHLMLPADVNCLIPQW

SEQ ID NO: 2037 - DNA, 573 bp, Setaria italica
  Si003021m
atgagaggttgcgaggctgagagctcagccagcgttcagtcgtcttctccagttctccccacctttccccgtgcgcctcttcccgttcgcctcttcctttcatctggctgccgttctccactcctcgagctccaaacctcgcgtaaaccccagcccccgcgtcgcggaggggaagggatttgcctccgcgggatgaagacgaggtcgcagacggcgccgaagcccctcaagatggtggcgctggcgcccaggcccggcagccccaagcggaggccgaggccgaggccgaagccggtggggaagggcgacccccgggcgcccaagaagccccccaccgccttcttctacttcatggaggattttcggaagacttacaagcaagaaaatccaagtgtaaagtcaatgcaggaaatagggaaggcatgtggtgaaaaatggaatacaatggcatttgaggaaaaggtgaagtattatgatatagctactgagaaacgtgcagaatttgagaaggcgatgattgaatataacaagaaaaaggaaagtggagaaatatttgaggattcagattcgggc

SEQ ID NO: 2038 - protein, 191 aa, Setaria italica
  Si003021m
MRGCEAESSASVQSSSPVLPTFPRAPLPVRLFLSSGCRSPLLELQTSRKPQPPRRGGEGICLRGMKTRSQTAPKPLKMVALAPRPGSPKRRPRPRPKPVGKGDPRAPKKPPTAFFYFMEDFRKTYKQENPSVKSMQEIGKACGEKWNTMAFEEKVKYYDIATEKRAEFEKAMIEYNKKKESGEIFEDSDSG

SEQ ID NO: 2039 - DNA, 471 bp, Citrus clementina
  clementine0.9_024276m
atggcgaagaaagcagcaaacgaatcgaaggaatcgcagtcttcatcagcttccaatctgaaaatggtattgagaaagaggccgacacgacagagtgtagttgctgctgttggtattgagaaagagcggaaatccatttcagcaaagagagtgacaacgaagctgaagaagaaacacgagaagcttgattctaagatgcccaagaaaccccccactgctttcttctacttcctggaggattttcgtaagggattccaagagcagaatccggacatcaagtcaatgcgtgctattggcaaggcttgtggagagaaatggaaaactatgacatatgaggaaaaagttaaatattatgatatagccactgagaaacgagctgagtttgacagagccatggctgactacatcaagagaaaggaaaatggcaaagttgagaacagtgaagaagactctgagtttgatgggtatgag

SEQ ID NO: 2040 - protein, 157 aa, Citrus clementina
  clementine0.9_024276m
MAKKAANESKESQSSSASNLKMVLRKRPTRQSVVAAVGIEKERKSISAKRVTTKLKKKHEKLDSKMPKKPPTAFFYFLEDFRKGFQEQNPDIKSMRAIGKACGEKWKTMTYEEKVKYYDIATEKRAEFDRAMADYIKRKENGKVENSEEDSEFDGYE

SEQ ID NO: 2041 - DNA, 408 bp, Citrus clementina
  clementine0.9_025101m
atggtattgagaaagaggccgacacgacagagtgtagttgctgctgttggtattgagaaagagcggaaatccatttcagcaaagagagtgacaacgaagctgaagaagaaacacgagaagcttgattctaagatgcccaagaaaccccccactgctttcttctacttcctggaggattttcgtaagggattccaagagcagaatccggacatcaagtcaatgcgtgctattggcaaggcttgtggagagaaatggaaaactatgacatatgaggaaaaagttaaatattatgatatagccactgagaaacgagctgagtttgacagagccatggctgactacatcaagagaaaggaaaatggcaaagttgagaacagtgaagaagactctgagtttgatgggtatgag

SEQ ID NO: 2042 - protein, 136 aa, Citrus clementina
  clementine0.9_025101m
MVLRKRPTRQSVVAAVGIEKERKSISAKRVTTKLKKKHEKLDSKMPKKPPTAFFYFLEDFRKGFQEQNPDIKSMRAIGKACGEKWKTMTYEEKVKYYDIATEKRAEFDRAMADYIKRKENGKVENSEEDSEFDGYE

SEQ ID NO: 2043 - DNA, 408 bp, Citrus clementina; identical to SEQ ID NO: 2041
  clementine0.9_025116m

SEQ ID NO: 2044 - protein, 136 aa, Citrus clementina; identical to SEQ ID NO: 2042
  clementine0.9_025116m

SEQ ID NO: 2045 - DNA, 495 bp, Eucalyptus grandis
  Eucgr.D00306.1
atgcccaagaagaaaccttccaagtccgagaaatcggtcccttcttctccgcccgtcagcgcagctcctaccgagaggagcgggatggtgttgagggtcaagtcgagcgagaagatgaagcggctggcgctgatgagcagggagagcgaggaggagtggaggcccaagtcggggaggagcgtcaagacggcggcgagagggaagaagaatgtcaagctcgacgcgaagatgcccaagaagccgcccaccgctttcttctacttcttggaggattttcgaaaggattatcaagagcagaacccagatgtcaaatcaatgcgggatattggtaaggcttgtggtgagaagtggaagacaatgacttatgaggaaaaggttcagtattatgacatagccactgagaaaaggagagaatttgacaaggccatggcagagtacgtcaaaagaaaggaaagcggtgaagatgaggaaacagaggatgactccaactttgaa

SEQ ID NO: 2046 - protein, 165 aa, Eucalyptus grandis
  Eucgr.D00306.1
MPKKKPSKSEKSVPSSPPVSAAPTERSGMVLRVKSSEKMKRLALMSRESEEEWRPKSGRSVKTAARGKKNVKLDAKMPKKPPTAFFYFLEDFRKDYQEQNPDVKSMRDIGKACGEKWKTMTYEEKVQYYDIATEKRREFDKAMAEYVKRKESGEDEETEDDSNFE

SEQ ID NO: 2047 - DNA, 531 bp, Glycine max
  Glyma05g25900.1
atgcgaaattacttctcacgccatcgtttgggtgaaattgcaagaccctgtccctgtgtagtgtgtagtcaccaaacaaacatggcgaaaaaggcaaaagggtctcactctgcttcttctgcctctgcatcttcttcgtccgacaaactagtgctgaggattaaatcaaatgaggggaccaagagatcagtgcggcaaactaattcaagaaagaaacttaaagcaaagcaaaagaagaacaaacaaaagtttgatgctatgaaacccaggaaacctcctacagctttcttctacttcttggaggattttcgtaaagaatttcaagagcagaatccagatgtaaagtcaatgcgtgatattggcaaggcatgtggagagaagtggaaaacaatgacttatgaggagaaggtacaatactatgatatagcaacaaaaaaacgtgaagaatttgatagcgcaatggcagaatttaacaagaaaatggaaaatggcgagtttgacgaaactgatgatgaatcagagtttgatgag

SEQ ID NO: 2048 - protein, 177 aa, Glycine max
  Glyma05g25900.1
MRNYFSRHRLGEIARPCPCVVCSHQTNMAKKAKGSHSASSASASSSSDKLVLRIKSNEGTKRSVRQTNSRKKLKAKQKKNKQKFDAMKPRKPPTAFFYFLEDFRKEFQEQNPDVKSMRDIGKACGEKWKTMTYEEKVQYYDIATKKREEFDSAMAEFNKKMENGEFDETDDESEFDE

SEQ ID NO: 2049 - DNA, 444 bp, Glycine max
  Glyma08g08840.1
atggcgaaaaaggcaaaagggtctcactctgcttcttctgcctctgcatcttcccgcaaactagtgctgaggattaaatcaaacgagggaatcaagagatcagtgcggcagactaattcaagaaagaaacccaaagcaaagcaaaagaagaacaaacaaatgtttgatgctatgaaacccaagaaacctccgacagctttcttctacttcttggaggattttcgtaaagaatttcaagagcagaatccagatgtaaagtcaatgcgtgatattggcaaggcatgtggagagaagtggaaaacaatgacttatgaggagaaggttcaatactatgatatagcaacaaaaaaacgtgaagaatttgataacgcaatggctgaatttaataagaaaatggaaaatggcgagtttgacgaaactgatgatgaatcagagtttgatgag

SEQ ID NO: 2050 - protein, 148 aa, Glycine max
  Glyma08g08840.1
MAKKAKGSHSASSASASSRKLVLRIKSNEGIKRSVRQTNSRKKPKAKQKKNKQMFDAMKPKKPPTAFFYFLEDFRKEFQEQNPDVKSMRDIGKACGEKWKTMTYEEKVQYYDIATKKREEFDNAMAEFNKKMENGEFDETDDESEFDE

SEQ ID NO: 2051 - DNA, 495 bp, Populus trichocarpa
  POPTR_0004s13630.1
atggcaaagaaagcttcaaaatccaagaaatgtcgctcttcttcttcctcttccttagcttcctcgacctcttctaaaagagtctctaaagagggaaaaatggtgttgaggataaggtccaatgagatcacaaagaggtctacacggcaacagagagtggttaggagtgagaatgagaggagaccaaagtcgaagaccaagaaaaataagaaatttgatgctaaaaagcccaagaaacctccaactgctttcttttacttcttagaggatttccgcaaggaattccaagagcagaatccagatgtcaagtcaatgcgtgaggttggcaaggcatgtggagaaaagtggaaaacaatgacctatgaggaaaaggttaaatattatgatatagccacagaaaagagggcggagtttgatagagccacgtcagaatatatcaagagaaaggaaagcggtgaagatgaagaccctgaggatgcctctgagtttgacgag

SEQ ID NO: 2052 - protein, 165 aa, Populus trichocarpa
  POPTR_0004s13630.1
MAKKASKSKKCRSSSSSSLASSTSSKRVSKEGKMVLRIRSNEITKRSTRQQRVVRSENERRPKSKTKKNKKFDAKKPKKPPTAFFYFLEDFRKEFQEQNPDVKSMREVGKACGEKWKTMTYEEKVKYYDIATEKRAEFDRATSEYIKRKESGEDEDPEDASEFDE

SEQ ID NO: 2053 - DNA, 525 bp, Vitis vinifera
  GSVIVT01021424001
atggtgaagaaagctaagaaacgctccccagcttcttcttcagtctcatctcctgctacaaaccctaatacaatgaccaaagagaagatggcgttgagagtaacatcaacggagaggatggtgctgagggtaagatcaaccgagaagattaagagggcggtcatggagagcagagttagtgagaaagagaagaaacctagatcaggaaataaggccaaagcgaagacgaagaagagatcccagagagtagactccaagaaaccaaagaaaccgcccactgcgttcttctacttcttggaggattttcgcaaggagtttcaggaacagaatccagatgtcaagtcaatgcgtgatattggcaaggcatgtggagagaaatggaaaacaatgacatatgaggaaaaggttcaatactacgatatagctactgaaaagagagcagagtttgatagagccatggcagattatatcaagagacaggaaagtggagaggatgaagaaattgaggactcggaagcttacgag

SEQ ID NO: 2054 - protein, 175 aa, Vitis vinifera
  GSVIVT01021424001
MVKKAKKRSPASSSVSSPATNPNTMTKEKMALRVTSTERMVLRVRSTEKIKRAVMESRVSEKEKKPRSGNKAKAKTKKRSQRVDSKKPKKPPTAFFYFLEDFRKEFQEQNPDVKSMRDIGKACGEKWKTMTYEEKVQYYDIATEKRAEFDRAMADYIKRQESGEDEEIEDSEAYE

SEQ ID NO: 2055 - DNA, 360 bp, Arabidopsis thaliana
  AT5G26930.1
atggatccaaggaagctactatcttgttcatcctcttacgtgtcagtgagaatgaaagaagagaaggggacaattaggtgttgcagtgagtgtaagaccaccaagacaccaatgtggagaggtggaccaactggtcctaagtcactttgcaatgcatgtggaattagacacagaaaacagagacgatcagagttattgggtattcatattattcgcagccacaaaagcttagcctccaagaagataaacctattatcatcatcacacggtggcgtggcggtgaagaaacgaaggagtctaaaggaggaagaacaagctgctttgtgtctattgttattgtcttgtagctctgttttggcc

SEQ ID NO: 2056 - protein, 120 aa, Arabidopsis thaliana
  AT5G26930.1
MDPRKLLSCSSSYVSVRMKEEKGTIRCCSECKTTKTPMWRGGPTGPKSLCNACGIRHRKQRRSELLGIHIIRSHKSLASKKINLLSSSHGGVAVKKRRSLKEEEQAALCLLLLSCSSVLA

SEQ ID NO: 2057 - DNA, 408 bp, Oryza sativa
  LOC_Os03g61570.2
atggattcctcgtcggtcgagaaggggagtgggtcgatagatccggacgagcgcacggcctccggcgagcccaaggcgtgcaccgactgccacaccaccaagactccgctctggcgcggcggcccctccggccccaagtcgctgtgcaacgcgtgcgggatccggtaccggaagaagagacgggaggcgctggggctcgacgccggcgagggcggcgcggagcggcaggagaagaagaagagcaagagggagagaggggaggaggtgaccatggagctccgcatggtggggttcgggaaggaggtggtcctgaagcagcggcggcggatgcggcggaggagacgcctcggcgaggaggagaaggcggccatcctcctcatggccctctcctccggagtcatctacgcc

SEQ ID NO: 2058 - protein, 136 aa, Oryza sativa
  LOC_Os03g61570.2
MDSSSVEKGSGSIDPDERTASGEPKACTDCHTTKTPLWRGGPSGPKSLCNACGIRYRKKRREALGLDAGEGGAERQEKKKSKRERGEEVTMELRMVGFGKEVVLKQRRRMRRRRRLGEEEKAAILLMALSSGVIYA

SEQ ID NO: 2059 - DNA, 381 bp, Zea mays
  GRMZM2G052616_T01
atgggctccgccgatcgcagtaagatcgacgggatcgtggtgccggagaaaggcgccaggagctgcgtcgaatgccgcgccaccaccacgcccatgtggcgcagcggccccaccgggcccaggtcactttgcaacgcttgcgggattcggtaccgaaagaagaggaggcaagagcttggcctagagcacaacaagcagcagcagcaacaacaaaataatggcgaggcgaagactggagtaaaagacagctctagcaacagcagtagcgggagcagcaactttcacgtggtgcagaaacggaggctcctaatggaagtggaggaggctgctctgctgctgatgaccctatcttcttcgcccgcatccacattgctacatggc

SEQ ID NO: 2060 - protein, 127 aa, Zea mays
  GRMZM2G052616_T01
MGSADRSKIDGIVVPEKGARSCVECRATTTPMWRSGPTGPRSLCNACGIRYRKKRRQELGLEHNKQQQQQQNNGEAKTGVKDSSSNSSSGSSNFHVVQKRRLLMEVEEAALLLMTLSSSPASTLLHG

SEQ ID NO: 2061 - DNA, 417 bp, Zea mays
  GRMZM2G104390_T01
atgtcgtctgctgcgggccgcgcgccggcgccgacgccgatgggctccgccgatcgctgtaagatcgacgggatcgtggcggcggagaaagccaccaggagctgcgtcgaatgccgcgccaccaccacgcccatgtggcgcagcggcccgaccgggcccaggtcactttgcaacgcctgtgggatccggtaccgaaaaaagaggaggcaagagcttggcctagaccgcaagctgcagcaacaacaaaataatggcgaggcgaagacggatgaagcaaaagacagctctagcaacagcagcagcgggagcagcaacttgcaggtggtgcagaaacggaggctgctaatgggagtggaggaggctgctctgctgctgatgaccctatcttcttcgcccacatccacgttgcttcatgga

SEQ ID NO: 2062 - protein, 139 aa, Zea mays
  GRMZM2G104390_T01
MSSAAGRAPAPTPMGSADRCKIDGIVAAEKATRSCVECRATTTPMWRSGPTGPRSLCNACGIRYRKKRRQELGLDRKLQQQQNNGEAKTDEAKDSSSNSSSGSSNLQVVQKRRLLMGVEEAALLLMTLSSSPTSTLLHG

SEQ ID NO: 2063 - DNA, 618 bp, Setaria italica
  Si004417m
cctcctcctcccccatccccaacccacagaattcattcatttctctatccccccttcccttccccgcaactactctctgctctctactacacgcttccaagaaacagagcaacccacgcagaccagaccgaaagccaaaattctccaagtgatccggtcgccaatccggccacggatcgaggctgccgtctgttcccgccgccgccgctgccgctgccgatgggctccgccgatcgcagtgagatcgatggggtcgtggtggcggagaaaggcgcgaggagctgcgtcgaatgccgcgccaccaccacgcccatgtggcgcagcggcccgacggggcccaggtcactttgcaatgcttgcgggatccggtatagaaagaagaggaggcaagagcttggcctagaccacaagcagcagcagcagcagaatcagcaacagcgacagcaacataatggtgaggcaaaaactgaagtaaaagacagtagtagcaacagtagtagcagtgggagcagcaacttgcaggcggtgcagaaacggaggctcctaatgggtgtggaggaggctgcgttgttgctcatgaccctgtcttcctcacccacatccacattgctacatggc

SEQ ID NO: 2064 - protein, 206 aa, Setaria italica
  Si004417m
PPPPPSPTHRIHSFLYPPFPSPQLLSALYYTLPRNRATHADQTESQNSPSDPVANPATDRGCRLFPPPPLPLPMGSADRSEIDGVVVAEKGARSCVECRATTTPMWRSGPTGPRSLCNACGIRYRKKRRQELGLDHKQQQQQNQQQRQQHNGEAKTEVKDSSSNSSSSGSSNLQAVQKRRLLMGVEEAALLLMTLSSSPTSTLLHG

SEQ ID NO: 2065 - DNA, 429 bp, Zea mays
  AC194965.4_FGT004
atgatgatggattccgcggagcatcagaaggtgatggggatcgcgccggcggcggcgcccgcagcggaggcggggagaccgtgctgcgtcgagtgccgcaccaccgcgacgcccatgtggcgcggcgggccgacagggcccaggtcgctctgcaacgcgtgtgggatccggtacaggaagaagcggaggcaagagctaggtctcgatagcgccaagaaaccacaacaaaaccagcggccgccgccgccacagcagcagcagcagcaagaggatcactgtccggcaacaagtgcagtcgctgtcagagacaacaccaaaagcagcaggctccaagtggtgaagaaacggagggtcctgatgggagtggaggaggccgcagtcctgctcatggccttgtcctcctcatccagatccacgctgctacatggc

SEQ ID NO: 2066 - protein, 143 aa, Zea mays
  AC194965.4_FGT004
MMMDSAEHQKVMGIAPAAAPAAEAGRPCCVECRTTATPMWRGGPTGPRSLCNACGIRYRKKRRQELGLDSAKKPQQNQRPPPPQQQQQQEDHCPATSAVAVRDNTKSSRLQVVKKRRVLMGVEEAAVLLMALSSSSRSTLLHG

SEQ ID NO: 2067 - DNA, 420 bp, Setaria italica
  Si011269m
atgatggattcctcagagcagaaggtgatcgggatcgcgccggcgccggcggtggcggaggcaggtaggccgtgctgcgtcgagtgccgcactaccgcgacgcccatgtggcgcggcgggccgacggggcccaggtcgctctgcaatgcgtgcgggatccggtacaggaagaagaggaggcaagagctaggtcttgacaacaaccagaagccacaacaaaaccaccagcagccgccgccacagcaacagccacagcagcaacaacatcaagatcacagtcaggcgccaaatgcagtcaaagataacaaaagtagcggcctgcaagtggtgaagaaacggagggtcctgatgggagtggaggaggctgcaatcctgctcatggccttgtcctcctcatccaggtccactctgctacatggc

SEQ ID NO: 2068 - protein, 140 aa, Setaria italica
  Si011269m
MMDSSEQKVIGIAPAPAVAEAGRPCCVECRTTATPMWRGGPTGPRSLCNACGIRYRKKRRQELGLDNNQKPQQNHQQPPPQQQPQQQQHQDHSQAPNAVKDNKSSGLQVVKKRRVLMGVEEAAILLMALSSSSRSTLLHG

SEQ ID NO: 2069 - DNA, 315 bp, Glycine max
  Glyma19g41780.1
attgatcaagtgaatataatattggtaatgatggatctgaaggaatggtcatcatcttctgaggaattgaatgtgaacaggaaatgttgcgctgattgcaaaaccaccaagaccccactctggagaggaggaccagctggacccaagactctatgcaacgcttgtggaattaggtatcggaagagaagggcatgttggaggaagggagagttgaagaaacagaaacagaaacagaaacagaggtggaagatgctgggggaagaggaacaagcggcggtgtgtttgatggccctgtcctgtggttttgttttcgct

SEQ ID NO: 2070 - protein, 105 aa, Glycine max
  Glyma19g41780.1
IDQVNIILVMMDLKEWSSSSEELNVNRKCCADCKTTKTPLWRGGPAGPKTLCNACGIRYRKRRACWRKGELKKQKQKQKQRWKMLGEEEQAAVCLMALSCGFVFA

SEQ ID NO: 2071 - DNA, 267 bp, Solanum lycopersicum
  Solyc09g075610.2.1
atgaaatcatgcagttattgtcataccacaacaacgcctctttggagaagtggtccatcaggtcccaagtcattgtgtaacgcatgtgggataaagtataataagaagaggagacagattttgggtgttgagaagaagaggagaatagagaaaaagagtatagaaatcggtaaattgatgggatttggaggaaaattaagagaagaagaacaagcggcgatattattgatggctctttcttgtggatctgttggaaaattactatgt

SEQ ID NO: 2072 - protein, 89 aa, Solanum lycopersicum
  Solyc09g075610.2.1
MKSCSYCHTTTTPLWRSGPSGPKSLCNACGIKYNKKRRQILGVEKKRRIEKKSIEIGKLMGFGGKLREEEQAAILLMALSCGSVGKLLC

SEQ ID NO: 2073 - DNA, 441 bp, Populus trichocarpa
  POPTR_0002s20080.1
atgatcatggatttgcgcacaaaaggaccagagtcagaggacatggataatactcatccaagcaagtgtaatgagatcaaaagaagatgcacagattgccaaacaacaagaaccccatgttggcgaggtggcccagctggtcccaggacactgtgcaatgcgtgtgggatcagacagaggaagaggaggagggctcttcttggcttggacaaaggaggaccggagcgcagcagagagaagatggctaagggtagcaatagtagcaagctaggagtttcattgaatctagatttgatggggtttaaaagagatgggatgtttcaggaagattggaagagaaaactgggagaggaagaacaggctgccatactcttgatggctttatcttgtgggtctgtctgtgcttggtacaagaaagatgaaggaaagcatttttatcca

SEQ ID NO: 2074 - protein, 147 aa, Populus trichocarpa
  POPTR_0002s20080.1
MIMDLRTKGPESEDMDNTHPSKCNEIKRRCTDCQTTRTPCWRGGPAGPRTLCNACGIRQRKRRRALLGLDKGGPERSREKMAKGSNSSKLGVSLNLDLMGFKRDGMFQEDWKRKLGEEEQAAILLMALSCGSVCAWYKKDEGKHFYP

SEQ ID NO: 2075 - DNA, 399 bp, Populus trichocarpa
  POPTR_0014s11940.1
atggatttcaacacaaaaggatcagagtcagaggacatggatagtactcaatcaagcaagggtaacgagatcaaaagaagatgcatggattgccaaactacaagaaccccatgttggcgaggcggtccggctggtcccaggacactgtgcaatgcatgtgggatcagacagaggaagaagaggagagcacttcatgggtcggacaaaggaggagcggagaggagtaaaaataagattgctaaaagtagcaatagtagtaagctaggagtttcattgaagctagatttgatgggttttagaagagatgggatattgcaggaagattggaagagaaaactgggagaggaagaacaggctgctatactcttgatggccttatcttgtggcttggtccgtgct

SEQ ID NO: 2076 - protein, 133 aa, Populus trichocarpa
  POPTR_0014s11940.1
MDFNTKGSESEDMDSTQSSKGNEIKRRCMDCQTTRTPCWRGGPAGPRTLCNACGIRQRKKRRALHGSDKGGAERSKNKIAKSSNSSKLGVSLKLDLMGFRRDGILQEDWKRKLGEEEQAAILLMALSCGLVRA

SEQ ID NO: 2077 - DNA, 441 bp, Citrus clementina
  clementine0.9_024707m
atgatggatccgagtgacaaaggatttgaatccgacgaagtgaacagcagcggcagcaagaggcttgatggggtttcttcggatgaaaatagtatcaaaaagacctgtgctgattgtgggaccaccaagaccccactgtggcgaggtggccccgctggccccaagtcactatgtaatgcatgcgggataaggagcaggaagaagaggagggcaatattgggaatcactaaagaggagaaaaaatcaaagagaggcaacagcaatagcagcagtaatagctcaagtaataagcttggggattcattaaagcaaagattgtacgcattgggaagagaagttttgatgcaaagatcaagcgtggagaagcaaagaaagacgcttggagaagaagagcaagctgctgttttgttaatggctttatcttatggttccgtttatgct

SEQ ID NO: 2078 - protein, 147 aa, Citrus clementina
  clementine0.9_024707m
MMDPSDKGFESDEVNSSGSKRLDGVSSDENSIKKTCADCGTTKTPLWRGGPAGPKSLCNACGIRSRKKRRAILGITKEEKKSKRGNSNSSSNSSSNKLGDSLKQRLYALGREVLMQRSSVEKQRKTLGEEEQAAVLLMALSYGSVYA

SEQ ID NO: 2079 - DNA, 477 bp, Eucalyptus grandis
  Eucgr.H04023.1
atggaaatgcaggacgcgagtgacaagggatcggagtcgccgggggtagcttcgtcggaggagagccacgtgacggagaccaagaaaacgtgtgctgattgcggcaccaccaaaacccctctctggcgtggcggtccggctggccccaagtctctgtgcaacgcgtgtgggatcaggagcaggaagaagaggagggaccttctgggcgtaagcaagaaacccacagaggacaagaagcgcaagaagatcaacagccacagcccgagcaacaacagcaccggcaaccgattcggcgattcgttgaagcagaagttgctggcttttctcagaaaagaagtgatgatgcagaagaaatccgctgtgccgtcatcgtcgtcctcatcgacatcgagcctcgagaggcagaggaagaagctgggcgaggaagagcaggcggctgtgctgttgatggccctgtcttacggctctgtttatgct

SEQ ID NO: 2080 - protein, 159 aa, Eucalyptus grandis
  Eucgr.H04023.1
MEMQDASDKGSESPGVASSEESHVTETKKTCADCGTTKTPLWRGGPAGPKSLCNACGIRSRKKRRDLLGVSKKPTEDKKRKKINSHSPSNNSTGNRFGDSLKQKLLAFLRKEVMMQKKSAVPSSSSSSTSSLERQRKKLGEEEQAAVLLMALSYGSVYA

SEQ ID NO: 2081 - DNA, 390 bp, Glycine max
  Glyma07g37190.2
atggtggatccaactggaaaaggatcggagattgaagtcgaggactcaaactcaaaccctaacgctccttcctcagggaacagtccaagcagcaacaatgagcagaagaaaacctgcgccgattgcggcaccaccaagactcctctctggaggggtggtcctgcaggacccaagtctctgtgcaacgcgtgcgggatcagaagcaggaagaagaagagagcgatcttgggaataaacaaggggagcaacgaggacggaaggaaaggaaagaggaccggcggcgctttggggaaggaggtgttgttgcaccgatcgcattggaagaagctcggagaggaagagaaagctgcggtcttgttgatgtcgctctcttatggatccgtttatgcc

SEQ ID NO: 2082 - protein, 130 aa, Glycine max
  Glyma07g37190.2
MVDPTGKGSEIEVEDSNSNPNAPSSGNSPSSNNEQKKTCADCGTTKTPLWRGGPAGPKSLCNACGIRSRKKKRAILGINKGSNEDGRKGKRTGGALGKEVLLHRSHWKKLGEEEKAAVLLMSLSYGSVYA

SEQ ID NO: 2083 - DNA, 414 bp, Populus trichocarpa
  POPTR_0008s22950.1
atgttggatccagctaacaaaggatcagagtctgaagaaatgagtagcaattcacaagaaacagagagcccactaaaaaagacttgtgctgattgtggtacttcaaagactccactttggagaggtggtccagctggtccaaagtcgctgtgtaatgcttgtgggattagaagcagaaagaagaagagggatattttagggttgaataaaggggcagcaaatgacaagagagcaaaaaagggaagcaataataatggctcaagcaataacaacaacaacaagcagttaggtgatggatcaaagcagagattattggcactgggcagagaagttttgatgcaaagaagaaagctgggtgaagaagagcaagctgcagtgttgttgatggcgttgtcttatgggtctgtttatgct

SEQ ID NO: 2084 - protein, 138 aa, Populus trichocarpa
  POPTR_0008s22950.1
MLDPANKGSESEEMSSNSQETESPLKKTCADCGTSKTPLWRGGPAGPKSLCNACGIRSRKKKRDILGLNKGAANDKRAKKGSNNNGSSNNNNNKQLGDGSKQRLLALGREVLMQRRKLGEEEQAAVLLMALSYGSVYA

SEQ ID NO: 2085 - DNA, 459 bp, Populus trichocarpa
  POPTR_0010s00360.1
atgctctcttccgtttctcttattgttttccagcagggatcagagtctgaagaaatgagtagcaaatcactagaaaccgagagcccacagaagaagacttgtgctgattgtggcacttcaaagactccactttggagaggtggtccagctggtcctaagtcactgtgtaatgcttgtgggattaggagcaggaagaagaagagggatatattagggttgaataagggaggggcagcagcaaatgacaagagagccaagaaagggagcactaacaatggctcaagtaattataataacaataacaagcaattaggtgatgggttaaagcagagattactggctctgggtagagaagtcttggttcaaggatcaacagtggagaggcgaaggaggaagctaggtgaagaagagcaagctgcagtgttattgatggccctatcttatggctctgtttatgct

SEQ ID NO: 2086 - protein, 153 aa, Populus trichocarpa
  POPTR_0010s00360.1
MLSSVSLIVFQQGSESEEMSSKSLETESPQKKTCADCGTSKTPLWRGGPAGPKSLCNACGIRSRKKKRDILGLNKGGAAANDKRAKKGSTNNGSSNYNNNNKQLGDGLKQRLLALGREVLVQGSTVERRRRKLGEEEQAAVLLMALSYGSVYA

SEQ ID NO: 2087 - DNA, 417 bp, Populus trichocarpa
  POPTR_0010s00360.3
atgctggatccatgtgagagacagggatcagagtctgaagaaatgagtagcaaatcactagaaaccgagagcccacagaagaagacttgtgctgattgtggcacttcaaagactccactttggagaggtggtccagctggtcctaagtcactgtgtaatgcttgtgggattaggagcaggaagaagaagagggatatattagggttgaataagggaggggcagcagcaaatgacaagagagccaagaaagggagcactaacaatggctcaagtgatgggttaaagcagagattactggctctgggtagagaagtcttggttcaaggatcaacagtggagaggcgaaggaggaagctaggtgaagaagagcaagctgcagtgttattgatggccctatcttatggctctgtttatgct

SEQ ID NO: 2088 - protein, 139 aa, Populus trichocarpa
  POPTR_0010s00360.3
MLDPCERQGSESEEMSSKSLETESPQKKTCADCGTSKTPLWRGGPAGPKSLCNACGIRSRKKKRDILGLNKGGAAANDKRAKKGSTNNGSSDGLKQRLLALGREVLVQGSTVERRRRKLGEEEQAAVLLMALSYGSVYA

SEQ ID NO: 2089 - DNA, 459 bp, Vitis vinifera
  GSVIVT01035048001
atggtggatctgagtgagaaagggtcagagtcggaagacatgaacaacaaaaacccagatgctgtttcgtcggctgagagccaggttaacgagccgaagaagacctgcgctgattgtggcaccaccaaaacccctctctggagaggcggtccagctgggcctaagtctctgtgcaatgcatgtggtatcagaagcaggaagaagagaagagccttcctggggttgaacaaaggatcaacagatgatagaaaagcaaagagaagcagcaaccactcccataacaatggtggcggcaacgggaacaataaattgggggactcgctgaagaggaggctcttcgcattgggaagagaggtgttgttgcagagatcaacagtggagaaacagaggaggaagctgggagaagaagagcaagcggccgtactgttaatggctctgtcttacggctacgtctatgct

SEQ ID NO: 2090 - protein, 153 aa, Vitis vinifera
  GSVIVT01035048001
MVDLSEKGSESEDMNNKNPDAVSSAESQVNEPKKTCADCGTTKTPLWRGGPAGPKSLCNACGIRSRKKRRAFLGLNKGSTDDRKAKRSSNHSHNNGGGNGNNKLGDSLKRRLFALGREVLLQRSTVEKQRRKLGEEEQAAVLLMALSYGYVYA

SEQ ID NO: 2091 - DNA, 552 bp, Arabidopsis thaliana
  AT4G20380.1
atgcaggaccagctggtgtgtcatggttgtaggaatttattgatgtatcctagaggagcatctaatgtgcgttgtgcgttatgtaacactatcaacatggttcctcctcctcctccacctcacgacatggcacacattatatgtggtggttgtagaacaatgcttatgtatacgcgtggggctagtagcgtaagatgctcttgctgtcaaactacgaaccttgtgccagcgcactccaatcaggttgcccatgctccttccagtcaggttgcgcagatcaattgtgggcattgtcggacgaccctcatgtatccttacggtgcatcatccgtcaaatgcgctgtttgtcaattcgtaactaacgttaatatgagcaatggaagggtacctctcccaactaaccggccaaatggaacagcttgtcccccctctacatcaacttcaacaccaccctctcagacccaaaccgttgttgtagaaaaccccatgtccgttgatgaaagcggaaagttggtgagcaatgttgttgttggagtgacaactgacaaaaag

SEQ ID NO: 2092 - protein, 184 aa, Arabidopsis thaliana
  AT4G20380.1
MQDQLVCHGCRNLLMYPRGASNVRCALCNTINMVPPPPPPHDMAHIICGGCRTMLMYTRGASSVRCSCCQTTNLVPAHSNQVAHAPSSQVAQINCGHCRTTLMYPYGASSVKCAVCQFVTNVNMSNGRVPLPTNRPNGTACPPSTSTSTPPSQTQTVVVENPMSVDESGKLVSNVVVGVTTDKK

SEQ ID NO: 2093 - DNA, 615 bp, Brachypodium distachyon
  Bradi1g13970.1
atgcacagccagatcgtgtgccatggctgtcggagagttctatgctacccgtcaggggcgcccagcgtgtgctgcggggcgtgccaagctatcaccatcgtgccacccccagcgctagaaatggctcagcttatatgtggtggttgccgaaccttgctgatgtatacccgcaatgcagacaccgtgagatgttcatgttgccgtacagtcaatcttgtgagatcagtgaataatattgcccacgtgaactgcggacagtgccggacaactttgatgtatccatatggagcaccttctgtcaaatgtgccttgtgcaattttgtcacaaatactggaataaataccatggcaccaacgccgtgtccagtgcctacaccaaatggatcttcatataatgtcccatctacttctgttgtatgtctatatccatgtattttgcagcctaacatatttttcttgaggactaagagtgatttatttcttttatgtttcatcttctggcagtctacaactcaaccccagaatgtaaccgttgttgtcgagaatcctatgacggttgacggaaagggtaaactggttagcaacgttgtagttggaattacacctgggaaacaa

SEQ ID NO: 2094 - protein, 205 aa, Brachypodium distachyon
  Bradi1g13970.1
MHSQIVCHGCRRVLCYPSGAPSVCCGACQAITIVPPPALEMAQLICGGCRTLLMYTRNADTVRCSCCRTVNLVRSVNNIAHVNCGQCRTTLMYPYGAPSVKCALCNFVTNTGINTMAPTPCPVPTPNGSSYNVPSTSVVCLYPCILQPNIFFLRTKSDLFLLCFIFWQSTTQPQNVTVVVENPMTVDGKGKLVSNVVVGITPGKQ

SEQ ID NO: 2095 - DNA, 603 bp, Brachypodium distachyon
  Bradi1g13970.2
atgcacagccagatcgtgtgccatggctgtcggagagttctatgctacccgtcaggggcgcccagcgtgtgctgcggggcgtgccaagctatcaccatcgtgccacccccagcgctagaaatggctcagcttatatgtggtggttgccgaaccttgctgatgtatacccgcaatgcagacaccgtgagatgttcatgttgccgtacagtcaatcttgtgagatcagtgaataatattgcccacgtgaactgcggacagtgccggacaactttgatgtatccatatggagcaccttctgtcaaatgtgccttgtgcaattttgtcacaaatactggaataaataccatggcaccaacgccgtgtccagtgcctacaccaaatggatcttcatataatgtcccatctacttctgttgtatgtctatatccatgtattttgcagcctaacatatttttcttgaggactaagagtgatttatttcttttatgtttcatcttctggcagtctacaactcaaccccagaatgtaaccgttgttgtcgagaatcctatgacggttgacggaaagggtaaactggtaagccccctatttttctgcctctac

SEQ ID NO: 2096 - protein, 201 aa, Brachypodium distachyon
  Bradi1g13970.2
MHSQIVCHGCRRVLCYPSGAPSVCCGACQAITIVPPPALEMAQLICGGCRTLLMYTRNADTVRCSCCRTVNLVRSVNNIAHVNCGQCRTTLMYPYGAPSVKCALCNFVTNTGINTMAPTPCPVPTPNGSSYNVPSTSVVCLYPCILQPNIFFLRTKSDLFLLCFIFWQSTTQPQNVTVVVENPMTVDGKGKLVSPLFFCLY

SEQ ID NO: 2097 - DNA, 525 bp, Brachypodium distachyon
  Bradi1g13970.4
atgcacagccagatcgtgtgccatggctgtcggagagttctatgctacccgtcaggggcgcccagcgtgtgctgcggggcgtgccaagctatcaccatcgtgccacccccagcgctagaaatggctcagcttatatgtggtggttgccgaaccttgctgatgtatacccgcaatgcagacaccgtgagatgttcatgttgccgtacagtcaatcttgtgagatcagtgaataatattgcccacgtgaactgcggacagtgccggacaactttgatgtatccatatggagcaccttctgtcaaatgtgccttgtgcaattttgtcacaaatactggaataaataccatggcaccaacgccgtgtccagtgcctacaccaaatggatcttcatataatgtcccatctacttctgtttctacaactcaaccccagaatgtaaccgttgttgtcgagaatcctatgacggttgacggaaagggtaaactggttagcaacgttgtagttggaattacacctgggaaacaa

SEQ ID NO: 2098 - protein, 175 aa, Brachypodium distachyon
  Bradi1g13970.4
MHSQIVCHGCRRVLCYPSGAPSVCCGACQAITIVPPPALEMAQLICGGCRTLLMYTRNADTVRCSCCRTVNLVRSVNNIAHVNCGQCRTTLMYPYGAPSVKCALCNFVTNTGINTMAPTPCPVPTPNGSSYNVPSTSVSTTQPQNVTVVVENPMTVDGKGKLVSNVVVGITPGKQ

SEQ ID NO: 2099 - DNA, 558 bp, Oryza sativa
  LOC_Os03g43840.1
atgcagagccagatcgtgtgccatggctgccggagcgtgctgcggtacccgagcggggcgcccagcgtgtgctgcgcgctctgccaggccatcaccaccgtgccgccccctgccccagtaatggaaatggctcatctaatatgtggtggttgccgaacattgctgatgtatactcgcaatgcggacactgtgagatgttcatgttgcagtacagtcaatcttgttagaccagtgaataatatagcacatgtgagctgtggccagtgccggacgactttgatgtatccatatggcgcaccttctgtcaaatgtgccatatgccattatatcacaaacaccggaatgaatactgtggcacccacgccatctccaatgcctacatcaagtggatcttcatataatgcccccccaagtggatcttcatataatgcccccccaccaacttcagctcccacatctcgaccccagaatgtaaccgttgttgtcgagaaccctatgactgttgatgaaaagggtaaactggttagcaatgttgtagttggagttacaactgggaaa

SEQ ID NO: 2100 - protein, 186 aa, Oryza sativa
  LOC_Os03g43840.1
MQSQIVCHGCRSVLRYPSGAPSVCCALCQAITTVPPPAPVMEMAHLICGGCRTLLMYTRNADTVRCSCCSTVNLVRPVNNIAHVSCGQCRTTLMYPYGAPSVKCAICHYITNTGMNTVAPTPSPMPTSSGSSYNAPPSGSSYNAPPPTSAPTSRPQNVTVVVENPMTVDEKGKLVSNVVVGVTTGK

SEQ ID NO: 2101 - DNA, 525 bp, Zea mays
  GRMZM2G173425_T01
atgcagaaccagatcatgtgccatgcttgccggacccttctgctctacccgcgtggcgcgtccagcgtctgctgcgcggtttgccaggccatcaccaccgtgccgccaccaggattggagatggctcagcttatatgtggtggctgtcgaactttgctgatgtatactcgcagtgcagacaccgtaaggtgttcatgttgcaacacagtgaaccttgttagaccagtgaataatatagctcatgtgaactgcggccagtgccggacaactttgatgtatccatacggcgcaccttcagtaaaatgtgccgtgtgcaattatgtcacagctactggagtaaatactgtggcacccaccccatctgcgaggccaacatcagatgggtcttcatatagtggctcatctacttctgctcctaaatctcaatctcagaatgtaactgttgttgttgagaaccctatgacagttgatgacaagggaaaacttgtcagcagcgttgtagttggagtcacagctgggaaagag

SEQ ID NO: 2102 - protein, 175 aa, Zea mays
  GRMZM2G173425_T01
MQNQIMCHACRTLLLYPRGASSVCCAVCQAITTVPPPGLEMAQLICGGCRTLLMYTRSADTVRCSCCNTVNLVRPVNNIAHVNCGQCRTTLMYPYGAPSVKCAVCNYVTATGVNTVAPTPSARPTSDGSSYSGSSTSAPKSQSQNVTVVVENPMTVDDKGKLVSSVVVGVTAGKE

SEQ ID NO: 2103 - DNA, 525 bp, Zea mays; identical to SEQ ID NO: 2101
  GRMZM2G173425_T02

SEQ ID NO: 2104 - protein, 175 aa, Zea mays; identical to SEQ ID NO: 2102
  GRMZM2G173425_T02

SEQ ID NO: 2105 - DNA, 744 bp, Setaria italica
  Si037185m
atggtgcaaaaattagtgcttgtacaaacatactccataaacacgcaggaagacaaatccaatccggaatcaactgcccccctcgctccgccggggagaggagagacaagcgacgccgcgctcgctcgccgccccgccgcgtcgacctctttctctttcttcccggagccccaccggaggcgtagacgggcgggcagtcatcccgcgcccgacgccgctatgcagaaccagatcgtgtgccacgcgtgccggaccgtcctgctctacccgcgaggggcgcccagcgtctgctgcgcgctgtgccaggccgtcaccaccgtgccgccaccaggactagatatggctcagcttatatgtggtggttgtcgaactttgctgatgtatactcgcagtgcagacactgtaaggtgttcgtgttgcaatacagtcaatcttgttagaccagtgaataatatagctcatgtaaactgcggccgctgccagacaactttgatgtatccatatggagcacattcagtaaaatgtgccatatgcaatcatgtcactgctactggagtaaatacagtggcacccacaacatccgcaaggccagcatccaatggaccttcatatagtacctcatctacttctgctcctaaatctcaaccccagaatgtaactgttgttgttgagaaccctatgacagttgatgataagggaaaacttgtgagcaacgttgtcgttggagtcacaactgggaaaaac

SEQ ID NO: 2106 - protein, 248 aa, Setaria italica
  Si037185m
MVQKLVLVQTYSINTQEDKSNPESTAPLAPPGRGETSDAALARRPAASTSFSFFPEPHRRRRRAGSHPAPDAAMQNQIVCHACRTVLLYPRGAPSVCCALCQAVTTVPPPGLDMAQLICGGCRTLLMYTRSADTVRCSCCNTVNLVRPVNNIAHVNCGRCQTTLMYPYGAHSVKCAICNHVTATGVNTVAPTTSARPASNGPSYSTSSTSAPKSQPQNVTVVVENPMTVDDKGKLVSNVVVGVTTGKN

SEQ ID NO: 2107 - DNA, 561 bp, Setaria italica
  Si037666m
atggtgcaaaaattagtgcttgtacaaacatactccataaacacgcaggaagacaaatccaatccggaatcaactgcccccctcgctccgccggggagaggagagacaagcgacgccgcgctcgctcgccgccccgccgcgtcgacctctttctctttcttcccggagccccaccggaggcgtagacgggcgggcagtcatcccgcgcccgacgccgctatgcagaaccagatcgtgtgccacgcgtgccggaccgtcctgctctacccgcgaggggcgcccagcgtctgctgcgcgctgtgccaggccgtcaccaccgtgccgccaccaggactagatatggctcagcttatatgtggtggttgtcgaactttgctgatgtatactcgcagtgcagacactgtaaggtgttcgtgttgcaatacagtcaatcttgttagaccagtgaataatatagctcatgtaaactgcggccgctgccagacaactttgatgtatccatatggagcacattcagtaaaatgtgccatatgcaatcatgtcactgctactggagtacgt

SEQ ID NO: 2108 - protein, 187 aa, Setaria italica
  Si037666m
MVQKLVLVQTYSINTQEDKSNPESTAPLAPPGRGETSDAALARRPAASTSFSFFPEPHRRRRRAGSHPAPDAAMQNQIVCHACRTVLLYPRGAPSVCCALCQAVTTVPPPGLDMAQLICGGCRTLLMYTRSADTVRCSCCNTVNLVRPVNNIAHVNCGRCQTTLMYPYGAHSVKCAICNHVTATGVR

SEQ ID NO: 2109 - DNA, 261 bp, Zea mays
  GRMZM2G173425_T03
atgcagaaccagatcatgtgccatgcttgccggacccttctgctctacccgcgtggcgcgtccagcgtctgctgcgcggtttgccaggccatcaccaccgtgccgccaccaggattggagatggctcagcttatatgtggtggctgtcgaactttgctgatgtatactcgcagtgcagacaccgtaaggtgttcatgttgcaacacagtgaaccttgttagaccaggtactattgacccccgccccctcctcctctgtctc

SEQ ID NO: 2110 - protein, 87 aa, Zea mays
  GRMZM2G173425_T03
MQNQIMCHACRTLLLYPRGASSVCCAVCQAITTVPPPGLEMAQLICGGCRTLLMYTRSADTVRCSCCNTVNLVRPGTIDPRPLLLCL

SEQ ID NO: 2111 - DNA, 450 bp, Setaria italica
  Si037902m
atggtgcaaaaattagtgcttgtacaaacatactccataaacacgcaggaagacaaatccaatccggaatcaactgcccccctcgctccgccggggagaggagagacaagcgacgccgcgctcgctcgccgccccgccgcgtcgacctctttctctttcttcccggagccccaccggaggcgtagacgggcgggcagtcatcccgcgcccgacgccgctatgcagaaccagatcgtgtgccacgcgtgccggaccgtcctgctctacccgcgaggggcgcccagcgtctgctgcgcgctgtgccaggccgtcaccaccgtgccgccaccaggtacgtgttggacgcttcgtttcctttcgtctgagcttgggaggttggcaatcatcacctctacggccagtcgtgcactggcagcgcgaaacagctggcgtgcaggggaacataaagct

SEQ ID NO: 2112 - protein, 150 aa, Setaria italica
  Si037902m
MVQKLVLVQTYSINTQEDKSNPESTAPLAPPGRGETSDAALARRPAASTSFSFFPEPHRRRRRAGSHPAPDAAMQNQIVCHACRTVLLYPRGAPSVCCALCQAVTTVPPPGTCWTLRFLSSELGRLAIITSTASRALAARNSWRAGEHKA

SEQ ID NO: 2113 - DNA, 537 bp, Brachypodium distachyon
  Bradi4g02040.1
atgcagagccagatcgtgtgccatgggtgcaggagcgttctactctaccccagaggcgccccgagcgtgtgctgcgcggtatgccacgccgtcaccagcgcccctcctccaggaatggagatggcccagcttatatgtggtggttgtcgaactttattgatgtatactcgcaatgcaactaccgttagatgctcatgttgtgatacagtcaatcttgtcagggcaggacctccagtgagtagtatagctcatgtgaactgcggccagtgccagacggtgttaatgtatccatatggagcgtcttctgtcaaatgtgctatctgcaattttattactactattggaatgaatactgtgagacctttgccacctacaatgcctgcaccaaatggatctcaatacagtgtcccatcgacttctgctccatccgccccatcgcagaatgtaactgtcgttgtagaaaatccaatgacggtagatgaaaagggaaaattggtgagcaacgtcgtagtcggggttacgaccggtgggaaaaag

SEQ ID NO: 2114 - protein, 179 aa, Brachypodium distachyon
  Bradi4g02040.1
MQSQIVCHGCRSVLLYPRGAPSVCCAVCHAVTSAPPPGMEMAQLICGGCRTLLMYTRNATTVRCSCCDTVNLVRAGPPVSSIAHVNCGQCQTVLMYPYGASSVKCAICNFITTIGMNTVRPLPPTMPAPNGSQYSVPSTSAPSAPSQNVTVVVENPMTVDEKGKLVSNVVVGVTTGGKK

SEQ ID NO: 2115 - DNA, 516 bp, Oryza sativa
  LOC_Os12g41700.1
atgcagagccagatcgtgtgccatgggtgcaggaacattctgctctacccgagaggggcaccgagcgtttgctgcgcggtgtgccatgccgtgtccagcacagcaccgtctccaggaatggatatagctcatcttatatgtggtggatgccgaactttattgatgtatactcgcaatgcgacatctgttagatgttcgtgctgcgatacagtcaatcttgtcagaccagtgagtagtatagctcacttgaactgtggccagtgccagacagtgttgatgtatccatacggagcaccttctgtcaagtgtgctatctgcaattttattacaaatactgggatgaatacaatgagacatttgccaccaaatggaacttcatatactgccccatcaacctctgctccaaccactcaatcacagaatgttactgttgttgttgaaaatcctatgacggtagatgcaaagggaaagttggtgagcaacgttgtagttggggttacaactggtggtaaaaag

SEQ ID NO: 2116 - protein, 172 aa, Oryza sativa
  LOC_Os12g41700.1
MQSQIVCHGCRNILLYPRGAPSVCCAVCHAVSSTAPSPGMDIAHLICGGCRTLLMYTRNATSVRCSCCDTVNLVRPVSSIAHLNCGQCQTVLMYPYGAPSVKCAICNFITNTGMNTMRHLPPNGTSYTAPSTSAPTTQSQNVTVVVENPMTVDAKGKLVSNVVVGVTTGGKK

SEQ ID NO: 2117 - DNA, 531 bp, miscanthus nuc.fasta
  AFC88835.1
atgcagagccagatcgtgtgccacgggtgcaggaccgttctgctctacccaagaggtgctccgagcgtgtgttgcgcagtatgccacgcggtcaccaatgtgccgcctccagcaatggagatggctcgacttatatgtggtggctgccagacattattgatgtatactcgcagtgcaacaactgtaagatgctcatgttgtgacacagtcaatcttgtcagaccagtcagtggcatagctcatgtgaactgtggccagtgccaaacagtgttgatgtatccatatggagcaccatctgtcaaatgtgctatttgcaacttcattacaaatgttggtggggtgactcccgtgagacctttgccacctgcactacccgcatcaagtggaaattcatacagcatcccgtcaacttctgcgccaacgaaccaatcgcagaatgtaactgttgttgttgaaaacccaatgacagtagatgacaagggaaaattggtgagcaacgttgtagtaggggttacaagtggtggtaaaaag

SEQ ID NO: 2118 - protein, 177 aa, miscanthus nuc.fasta
  AFC88835.1
MQSQIVCHGCRTVLLYPRGAPSVCCAVCHAVTNVPPPAMEMARLICGGCQTLLMYTRSATTVRCSCCDTVNLVRPVSGIAHVNCGQCQTVLMYPYGAPSVKCAICNFITNVGGVTPVRPLPPALPASSGNSYSIPSTSAPTNQSQNVTVVVENPMTVDDKGKLVSNVVVGVTSGGKK

SEQ ID NO: 2119 - DNA, 534 bp, Zea mays
  GRMZM2G114613_T01
atgcagagccagatagtgtgccacgggtgcaggacccttctgttctacccaagaggtgctccgagcgtgtgttgtgcggtatgccatgtggtcaccaatgtgccgcctccagcaatggagatggctcgacttatatgtggtggctgccagacattattgatgtatgctcgcagtgcaacaactgtaagatgctcatgttgtgacacagtcaatcttgtcagaccagtgagtagcatagctcatgtgaactgtggccagtgccaaacagtgttgatgtatccatacggagcaccgtctgtcaaatgtgctgtttgcaacttcattacaaatgttggcggggtgactcccatgatacctttgccaccaccagcactaactgcatcaagtggaacttcatatatcatcccgtcaatttccgtgccgacgaatcaaccgcggaatgtaactgttgtcgttgaaaacccaatgacagtagatgacaagggaaaattggtgagcaatgttgtagtaggggttacgagcggcgggaaaaag

SEQ ID NO: 2120 - protein, 178 aa, Zea mays
  GRMZM2G114613_T01
MQSQIVCHGCRTLLFYPRGAPSVCCAVCHVVTNVPPPAMEMARLICGGCQTLLMYARSATTVRCSCCDTVNLVRPVSSIAHVNCGQCQTVLMYPYGAPSVKCAVCNFITNVGGVTPMIPLPPPALTASSGTSYIIPSISVPTNQPRNVTVVVENPMTVDDKGKLVSNVVVGVTSGGKK

SEQ ID NO: 2121 - DNA, 534 bp, Zea mays; identical to SEQ ID NO: 2119
  GRMZM2G114613_T03

SEQ ID NO: 2122 - protein, 178 aa, Zea mays; identical to SEQ ID NO: 2120
  GRMZM2G114613_T03

SEQ ID NO: 2123 - DNA, 927 bp, Zea mays
  GRMZM2G114613_T02
atgttccgatgtcttgctggttggatgaggagggtacgacgctctgtggagagatctaatcgcgctggtaaactggggcgatcggtgtgggggaatcggatagcgtggatgggatttgggattggaagagaagctggaggatgccttttttcccctgtccccaagctttctgtggatgacggtgataatcgtggacgagctaagctcattgagtgtctggctgatgtgggattgggtggcatatgctggattgctaactgttccatctggtgcaccaagaattggactgcactggggttgggattgggattgggatgggattgctttgcctttgattgtgtatatgcttattatgtgctcatccgctgtggctttggccggaactttgcagacatgcagagccagatagtgtgccacgggtgcaggacccttctgttctacccaagaggtgctccgagcgtgtgttgtgcggtatgccatgtggtcaccaatgtgccgcctccagcaatggagatggctcgacttatatgtggtggctgccagacattattgatgtatgctcgcagtgcaacaactgtaagatgctcatgttgtgacacagtcaatcttgtcagaccagtgagtagcatagctcatgtgaactgtggccagtgccaaacagtgttgatgtatccatacggagcaccgtctgtcaaatgtgctgtttgcaacttcattacaaatgttggcggggtgactcccatgatacctttgccaccaccagcactaactgcatcaagtggaacttcatatatcatcccgtcaatttccgtgccgacgaatcaaccgcggaatgtaactgttgtcgttgaaaacccaatgacagtagatgacaagggaaaattggtgagcaatgttgtagtaggggttacgagcggcgggaaaaag

SEQ ID NO: 2124 - protein, 309 aa, Zea mays
  GRMZM2G114613_T02
MFRCLAGWMRRVRRSVERSNRAGKLGRSVWGNRIAWMGFGIGREAGGCLFSPVPKLSVDDGDNRGRAKLIECLADVGLGGICWIANCSIWCTKNWTALGLGLGLGWDCFAFDCVYAYYVLIRCGFGRNFADMQSQIVCHGCRTLLFYPRGAPSVCCAVCHVVTNVPPPAMEMARLICGGCQTLLMYARSATTVRCSCCDTVNLVRPVSSIAHVNCGQCQTVLMYPYGAPSVKCAVCNFITNVGGVTPMIPLPPPALTASSGTSYIIPSISVPTNQPRNVTVVVENPMTVDDKGKLVSNVVVGVTSGGKK

SEQ ID NO: 2125 - DNA, 603 bp, Zea mays
  GRMZM2G114613_T04
atgttccgatgtcttgctggttggatgaggagggtacgacgctctgtggagagatctaatcgcgctgacatgcagagccagatagtgtgccacgggtgcaggacccttctgttctacccaagaggtgctccgagcgtgtgttgtgcggtatgccatgtggtcaccaatgtgccgcctccagcaatggagatggctcgacttatatgtggtggctgccagacattattgatgtatgctcgcagtgcaacaactgtaagatgctcatgttgtgacacagtcaatcttgtcagaccagtgagtagcatagctcatgtgaactgtggccagtgccaaacagtgttgatgtatccatacggagcaccgtctgtcaaatgtgctgtttgcaacttcattacaaatgttggcggggtgactcccatgatacctttgccaccaccagcactaactgcatcaagtggaacttcatatatcatcccgtcaatttccgtgccgacgaatcaaccgcggaatgtaactgttgtcgttgaaaacccaatgacagtagatgacaagggaaaattggtgagcaatgttgtagtaggggttacgagcggcgggaaaaag

SEQ ID NO: 2126 - protein, 201 aa, Zea mays
  GRMZM2G114613_T04
MFRCLAGWMRRVRRSVERSNRADMQSQIVCHGCRTLLFYPRGAPSVCCAVCHVVTNVPPPAMEMARLICGGCQTLLMYARSATTVRCSCCDTVNLVRPVSSIAHVNCGQCQTVLMYPYGAPSVKCAVCNFITNVGGVTPMIPLPPPALTASSGTSYIIPSISVPTNQPRNVTVVVENPMTVDDKGKLVSNVVVGVTSGGKK

SEQ ID NO: 2127 - DNA, 420 bp, Zea mays
  GRMZM2G114613_T06
atggagatggctcgacttatatgtggtggctgccagacattattgatgtatgctcgcagtgcaacaactgtaagatgctcatgttgtgacacagtcaatcttgtcagaccagtgagtagcatagctcatgtgaactgtggccagtgccaaacagtgttgatgtatccatacggagcaccgtctgtcaaatgtgctgtttgcaacttcattacaaatgttggcggggtgactcccatgatacctttgccaccaccagcactaactgcatcaagtggaacttcatatatcatcccgtcaatttccgtgccgacgaatcaaccgcggaatgtaactgttgtcgttgaaaacccaatgacagtagatgacaagggaaaattggtgagcaatgttgtagtaggggttacgagcggcgggaaaaag

SEQ ID NO: 2128 - protein, 140 aa, Zea mays
  GRMZM2G114613_T06
MEMARLICGGCQTLLMYARSATTVRCSCCDTVNLVRPVSSIAHVNCGQCQTVLMYPYGAPSVKCAVCNFITNVGGVTPMIPLPPPALTASSGTSYIIPSISVPTNQPRNVTVVVENPMTVDDKGKLVSNVVVGVTSGGKK

SEQ ID NO: 2129 - DNA, 336 bp, Zea mays
  GRMZM2G114613_T05
atgttgacgatttttgttcatcctgcagtgagtagcatagctcatgtgaactgtggccagtgccaaacagtgttgatgtatccatacggagcaccgtctgtcaaatgtgctgtttgcaacttcattacaaatgttggcggggtgactcccatgatacctttgccaccaccagcactaactgcatcaagtggaacttcatatatcatcccgtcaatttccgtgccgacgaatcaaccgcggaatgtaactgttgtcgttgaaaacccaatgacagtagatgacaagggaaaattggtgagcaatgttgtagtaggggttacgagcggcgggaaaaag

SEQ ID NO: 2130 - protein, 112 aa, Zea mays
  GRMZM2G114613_T05
MLTIFVHPAVSSIAHVNCGQCQTVLMYPYGAPSVKCAVCNFITNVGGVTPMIPLPPPALTASSGTSYIIPSISVPTNQPRNVTVVVENPMTVDDKGKLVSNVVVGVTSGGKK

SEQ ID NO: 2131 - DNA, 537 bp, Setaria italica
  Si023407m
atgcagagccagatcgtgtgccacgggtgcaggaggcttctactctaccccagaggcgctccgagcgtgtgctgcgcggtatgccgtgtggtcagcaacgtgccacctccaggaatggagatggctcgacttatttgtggtggctgccaaacattattgatgtatacttgcaatgcaacaactgtaagatgctcatgttgtgacacagtcaatcttgtcagaccagtgagtagcatagctcatgtgaactgtggccggtgccaaacagtgttgatgtatccatatggagcaccatctgtcaaatgtgccatctgcaacttcattacaagtgttggtgggcatcaggtaccaactgtgagacctttgccacccacgctgcctgcatcaagtggaaattcatataacattccgtcaacttccgcgccaatgagtcaatcacagaacgtaactgttgttgttgaaaatccaatgacagtagatgacaagggaaaattggtgagcaatgttgtagttggggttacaactggtggaaaaaag

SEQ ID NO: 2132 - protein, 179 aa, Setaria italica
  Si023407m
MQSQIVCHGCRRLLLYPRGAPSVCCAVCRVVSNVPPPGMEMARLICGGCQTLLMYTCNATTVRCSCCDTVNLVRPVSSIAHVNCGRCQTVLMYPYGAPSVKCAICNFITSVGGHQVPTVRPLPPTLPASSGNSYNIPSTSAPMSQSQNVTVVVENPMTVDDKGKLVSNVVVGVTTGGKK

SEQ ID NO: 2133 - DNA, 531 bp, Setaria italica
  Si023412m
atgcagagccagatcgtgtgccacgggtgcaggaggcttctactctaccccagaggcgctccgagcgtgtgctgcgcggtatgccgtgtggtcagcaacgtgccacctccaggaatggagatggctcgacttatttgtggtggctgccaaacattattgatgtatacttgcaatgcaacaactgtaagatgctcatgttgtgacacagtcaatcttgtcagaccagtgagtagcatagctcatgtgaactgtggccggtgccaaacagtgttgatgtatccatatggagcaccatctgtcaaatgtgccatctgcaacttcattacaagtgttggtggggtaccaactgtgagacctttgccacccacgctgcctgcatcaagtggaaattcatataacattccgtcaacttccgcgccaatgagtcaatcacagaacgtaactgttgttgttgaaaatccaatgacagtagatgacaagggaaaattggtgagcaatgttgtagttggggttacaactggtggaaaaaag

SEQ ID NO: 2134 - protein, 177 aa, Setaria italica
  Si023412m
MQSQIVCHGCRRLLLYPRGAPSVCCAVCRVVSNVPPPGMEMARLICGGCQTLLMYTCNATTVRCSCCDTVNLVRPVSSIAHVNCGRCQTVLMYPYGAPSVKCAICNFITSVGGVPTVRPLPPTLPASSGNSYNIPSTSAPMSQSQNVTVVVENPMTVDDKGKLVSNVVVGVTTGGKK

SEQ ID NO: 2135 - DNA, 540 bp, Eucalyptus grandis
  Eucgr.A00512.1
atgcagagtcaacttgtctgtaatggctgtcgaagcattcttctttatccaagaggggctacaaatgtttgctgtgcattatgtaacacaataacctctgttccttctcctgcatatgtaggtgcagatatggcccagcttatatgtggaggttgcaggacactgcttatgtacacccgtggggcaaccagtgtgagatgctcctgctgtcacactgtcaaccttgcaccagttacacctgcttccaatcaatatgctcatgtaaattgcggaaactgtcggacgatgctgatgtatccatctggagctccatctgtgaagtgtgcgatctgtcaatttattactaacgttggtgcgggcaatccaagggtttctgttccaccacaaagaatcgatggaccaccgtcagggacaacaccgtctacttcaacgtcaatgccccaatctactcaaactgtagtggttgaaaaccccatgtccgttgacgagagtggcaaactggtgactaatgtcgtcgtcggcgtcacaacagagaaaagg

SEQ ID NO: 2136 - protein, 180 aa, Eucalyptus grandis
  Eucgr.A00512.1
MQSQLVCNGCRSILLYPRGATNVCCALCNTITSVPSPAYVGADMAQLICGGCRTLLMYTRGATSVRCSCCHTVNLAPVTPASNQYAHVNCGNCRTMLMYPSGAPSVKCAICQFITNVGAGNPRVSVPPQRIDGPPSGTTPSTSTSMPQSTQTVVVENPMSVDESGKLVTNVVVGVTTEKR

SEQ ID NO: 2137 - DNA, 531 bp, Glycine max
  Glyma05g30490.1
atgcagagccaagttgtgtgcaatggttgtaggagccttctgctttacccaagaggggcaaccaatgtttgttgtgcattgtgcaacacaattacctctgttcctccccctgggatggaaatgtctcaactttattgtggagggtgtaggacattgctaatgtacacacgtggagctacaagtgtgagatgttcctgctgtcacactgtaaaccttgttccaccagcatctaatcaagtagctcatgtccattgtgggaactgccggacaacactcatgtatccttatggagctccatcagtcaaatgtgctctttgtcactttattactaatgtcagtacgaacaatggaaggcttccaatccctgtccatagacccaatgggacaaccaatgctggaacattacctactacttcaacatcaatgccccaatctcaaagtcaaacagtagtggtagaaaatccaatgtctgttgattcaagtgggaaattggtgagcaatgttgttgttggggttacaacagataagaaa

SEQ ID NO: 2138 - protein, 177 aa, Glycine max
  Glyma05g30490.1
MQSQVVCNGCRSLLLYPRGATNVCCALCNTITSVPPPGMEMSQLYCGGCRTLLMYTRGATSVRCSCCHTVNLVPPASNQVAHVHCGNCRTTLMYPYGAPSVKCALCHFITNVSTNNGRLPIPVHRPNGTTNAGTLPTTSTSMPQSQSQTVVVENPMSVDSSGKLVSNVVVGVTTDKK

SEQ ID NO: 2139 - DNA, 525 bp, Glycine max
  Glyma05g30490.3
atgcagagccaagttgtgtgcaatggttgtaggagccttctgctttacccaagaggggcaaccaatgtttgttgtgcattgtgcaacacaattacctctgttcctccccctgggatggaaatgtctcaactttattgtggagggtgtaggacattgctaatgtacacacgtggagctacaagtgtgagatgttcctgctgtcacactgtaaaccttgttccaccagcatctaatcaagtagctcatgtccattgtgggaactgccggacaacactcatgtatccttatggagctccatcagtcaaatgtgctctttgtcactttattactaatacgaacaatggaaggcttccaatccctgtccatagacccaatgggacaaccaatgctggaacattacctactacttcaacatcaatgccccaatctcaaagtcaaacagtagtggtagaaaatccaatgtctgttgattcaagtgggaaattggtgagcaatgttgttgttggggttacaacagataagaaa

SEQ ID NO: 2140 - protein, 175 aa, Glycine max
  Glyma05g30490.3
MQSQVVCNGCRSLLLYPRGATNVCCALCNTITSVPPPGMEMSQLYCGGCRTLLMYTRGATSVRCSCCHTVNLVPPASNQVAHVHCGNCRTTLMYPYGAPSVKCALCHFITNTNNGRLPIPVHRPNGTTNAGTLPTTSTSMPQSQSQTVVVENPMSVDSSGKLVSNVVVGVTTDKK

SEQ ID NO: 2141 - DNA, 441 bp, Glycine max
  Glyma05g30490.2
atgcagagccaagttgtgtgcaatggttgtaggagccttctgctttacccaagaggggcaaccaatgtttgttgtgcattgtgcaacacaattacctctgttcctccccctgggatggaaatgtctcaactttattgtggagggtgtaggacattgctaatgtacacacgtggagctacaagtgtgagatgttcctgctgtcacactgtaaaccttgttccaccagcatctaatcaagtagctcatgtccattgtgggaactgccggacaacactcatgtatccttatggagctccatcagtcaaatgtgctctttgtcactttattactaatgtcagtacgaacaatggaaggcttccaatccctgtccatagacccaatgggacaaccaatgctggaacattacctactacttcaacagtatgcttttatttttatttt

SEQ ID NO: 2142 - protein, 147 aa, Glycine max
  Glyma05g30490.2
MQSQVVCNGCRSLLLYPRGATNVCCALCNTITSVPPPGMEMSQLYCGGCRTLLMYTRGATSVRCSCCHTVNLVPPASNQVAHVHCGNCRTTLMYPYGAPSVKCALCHFITNVSTNNGRLPIPVHRPNGTTNAGTLPTTSTVCFYFYF

SEQ ID NO: 2143 - DNA, 531 bp, Glycine max
  Glyma08g13630.1
atgcagagccaagttgtgtgcaatggttgtaggagccttctgctttacccaagaggagcaaccaatgtctgttgtgcattgtgcaacacaattacctctgttcctccacctgggatggaaatgtctcaactttattgtggaggttgtaggacattgctaatgtacacacgtggagctacaagtgtgagatgttcctgctgtcacactgtaaaccttgttccaccagcatctaatcaagtggctcatgtccattgtgggaactgccggacaacactcatgtatccttatggagctccctcagtcaaatgtgctctttgtcactttattactaatgtcagtacaaacaatggaaggcttccaatccctgtccatagacccaatgggacaaacaatgctggaacattaccttctacatcaacatcaatgccccaatctcaaagtcaaacggtagtggtagaaaatccaatgtctgttgattcaagtgggaaattggtgagcaatgttgttgttggcgttacaacggataagaaa

SEQ ID NO: 2144 - protein, 177 aa, Glycine max
  Glyma08g13630.1
MQSQVVCNGCRSLLLYPRGATNVCCALCNTITSVPPPGMEMSQLYCGGCRTLLMYTRGATSVRCSCCHTVNLVPPASNQVAHVHCGNCRTTLMYPYGAPSVKCALCHFITNVSTNNGRLPIPVHRPNGTNNAGTLPSTSTSMPQSQSQTVVVENPMSVDSSGKLVSNVVVGVTTDKK

SEQ ID NO: 2145 - DNA, 525 bp, Glycine max
  Glyma08g13630.2
atgcagagccaagttgtgtgcaatggttgtaggagccttctgctttacccaagaggagcaaccaatgtctgttgtgcattgtgcaacacaattacctctgttcctccacctgggatggaaatgtctcaactttattgtggaggttgtaggacattgctaatgtacacacgtggagctacaagtgtgagatgttcctgctgtcacactgtaaaccttgttccaccagcatctaatcaagtggctcatgtccattgtgggaactgccggacaacactcatgtatccttatggagctccctcagtcaaatgtgctctttgtcactttattactaatacaaacaatggaaggcttccaatccctgtccatagacccaatgggacaaacaatgctggaacattaccttctacatcaacatcaatgccccaatctcaaagtcaaacggtagtggtagaaaatccaatgtctgttgattcaagtgggaaattggtgagcaatgttgttgttggcgttacaacggataagaaa

SEQ ID NO: 2146 - protein, 175 aa, Glycine max
  Glyma08g13630.2
MQSQVVCNGCRSLLLYPRGATNVCCALCNTITSVPPPGMEMSQLYCGGCRTLLMYTRGATSVRCSCCHTVNLVPPASNQVAHVHCGNCRTTLMYPYGAPSVKCALCHFITNTNNGRLPIPVHRPNGTNNAGTLPSTSTSMPQSQSQTVVVENPMSVDSSGKLVSNVVVGVTTDKK

SEQ ID NO: 2147 - DNA, 522 bp, Glycine max
  Glyma09g10010.1
atgaggagccaacttgtgtgtaatgggtgtaggagcatcttggtttaccctagaggagcaaccaatgtttgctgtgcgttgtgcaacaccattacctctgttcctcctcctggaatggacatgtcacaactctattgtggaggctgtacgacattgctaatgtacacacgtggtgctacaagtgtgagatgttcctgctgtcacactattaaccttgtaccagaatctaatcaagtcattcattgtgcgaactgccggacaacactcatgtatccttatggagcttcctcagtcaaatgtgcaatttgttgctatattactaatatcagtatgaccaatggaaggctttcaattcctgtacagagaccaaatggaacagccaactctggaacagtatcttcaacttcatcgtcaatgccttattctcagagccaaactgtcgtagtagaaaatcctatgtctgttgattcgagtgggaaattggtgaggaatgtcgttgtgggcgttacaacagataagaaa

SEQ ID NO: 2148 - protein, 174 aa, Glycine max
  Glyma09g10010.1
MRSQLVCNGCRSILVYPRGATNVCCALCNTITSVPPPGMDMSQLYCGGCTTLLMYTRGATSVRCSCCHTINLVPESNQVIHCANCRTTLMYPYGASSVKCAICCYITNISMTNGRLSIPVQRPNGTANSGTVSSTSSSMPYSQSQTVVVENPMSVDSSGKLVRNVVVGVTTDKK

SEQ ID NO: 2149 - DNA, 540 bp, Glycine max
  Glyma15g22140.1
atgggaagccaacttgtgtgtaatgggtgtaggaacatcttggtttaccctagaggagcaaccaatgtttgctgtgcattgtgcaacaccgttacctctgttcctcctcctggaatggacatgtcacaactttattgtggaggctgtacgacattgctaatgtacacacgtggtgctacaagtgtgagatgttcctgctgtcacactattaaccttgtaccagtactagaatctaatcaagtcattcattgtacgaactgccggacaacactcatgtatccttatggagcttcctcagtaaaatgtgcaatttgtcgctatattactaatgtcagtatgacgaatggaaggcttccaattcctgtacagagaccaaatggaacagccaactctggaacagtatcttctacttcatcgtcaatgcctcattctcagagccaaactgtcgtagtagaaaatcccatgtctgttgattcgagtgggaaattggtaattactacatcttttgctttttggctagttttggatgcatgtttgact

SEQ ID NO: 2150 - protein, 180 aa, Glycine max
  Glyma15g22140.1
MGSQLVCNGCRNILVYPRGATNVCCALCNTVTSVPPPGMDMSQLYCGGCTTLLMYTRGATSVRCSCCHTINLVPVLESNQVIHCTNCRTTLMYPYGASSVKCAICRYITNVSMTNGRLPIPVQRPNGTANSGTVSSTSSSMPHSQSQTVVVENPMSVDSSGKLVITTSFAFWLVLDACLT

SEQ ID NO: 2151 - DNA, 528 bp, Glycine max
  Glyma15g22140.2
atgggaagccaacttgtgtgtaatgggtgtaggaacatcttggtttaccctagaggagcaaccaatgtttgctgtgcattgtgcaacaccgttacctctgttcctcctcctggaatggacatgtcacaactttattgtggaggctgtacgacattgctaatgtacacacgtggtgctacaagtgtgagatgttcctgctgtcacactattaaccttgtaccagtactagaatctaatcaagtcattcattgtacgaactgccggacaacactcatgtatccttatggagcttcctcagtaaaatgtgcaatttgtcgctatattactaatgtcagtatgacgaatggaaggcttccaattcctgtacagagaccaaatggaacagccaactctggaacagtatcttctacttcatcgtcaatgcctcattctcagagccaaactgtcgtagtagaaaatcccatgtctgttgattcgagtgggaaattggtgagcaatgttgttgtgggcgttacaacagagaagaaa

SEQ ID NO: 2152 - protein, 176 aa, Glycine max
  Glyma15g22140.2
MGSQLVCNGCRNILVYPRGATNVCCALCNTVTSVPPPGMDMSQLYCGGCTTLLMYTRGATSVRCSCCHTINLVPVLESNQVIHCTNCRTTLMYPYGASSVKCAICRYITNVSMTNGRLPIPVQRPNGTANSGTVSSTSSSMPHSQSQTVVVENPMSVDSSGKLVSNVVVGVTTEKK

SEQ ID NO: 2153 - DNA, 510 bp, Citrus clementina
  clementine0.9_023739m
atgcagagtcagcttgtgtgcagtggctgcaggagcgttcttctttatcctagaggagctacgaatgtttgttgtgcattatgtaatacaattacatctgtccctattccaggaatggaaatggctcagctaatttgtggaggttgcaggacattgctcatgtatacacgtggggcaacaagtgtgagatgctcttgttgtcacacagtgaatcttgcaccagcacccaaccagtttgctcacgtcatctgtggccattgccggacaacgcttatgtacccacatggagctccatcagttaaatgtgctgtctgtcagtatgttactaatgttaatatggcaaatgcgagggttccgcttccagcgaacagacccaatgggacagctatccctggtactttgccttctacttcaatgacacaaactgttgttgtcgaaaatcccatgtctgttgatgaaagtggaaaattggtgagcaatgttgttgtcggtgtctcaacagagaaaaaa

SEQ ID NO: 2154 - protein, 170 aa, Citrus clementina
  clementine0.9_023739m
MQSQLVCSGCRSVLLYPRGATNVCCALCNTITSVPIPGMEMAQLICGGCRTLLMYTRGATSVRCSCCHTVNLAPAPNQFAHVICGHCRTTLMYPHGAPSVKCAVCQYVTNVNMANARVPLPANRPNGTAIPGTLPSTSMTQTVVVENPMSVDESGKLVSNVVVGVSTEKK

SEQ ID NO: 2155 - DNA, 510 bp, Citrus clementina; identical to SEQ ID NO: 2153
  clementine0.9_023744m

SEQ ID NO: 2156 - protein, 170 aa, Citrus clementina; identical to SEQ ID NO: 2154
  clementine0.9_023744m

SEQ ID NO: 2157 - DNA, 399 bp, Citrus clementina
  clementine0.9_025222m
atgcagagtcagcttgtgtgcagtggctgcaggagcgttcttctttatcctagaggagctacgaatgtttgttgtgcattatgtaatacaattacatctgtccctattccagcacccaaccagtttgctcacgtcatctgtggccattgccggacaacgcttatgtacccacatggagctccatcagttaaatgtgctgtctgtcagtatgttactaatgttaatatggcaaatgcgagggttccgcttccagcgaacagacccaatgggacagctatccctggtactttgccttctacttcaatgacacaaactgttgttgtcgaaaatcccatgtctgttgatgaaagtggaaaattggtgagcaatgttgttgtcggtgtctcaacagagaaaaaa

SEQ ID NO: 2158 - protein, 133 aa, Citrus clementina
  clementine0.9_025222m
MQSQLVCSGCRSVLLYPRGATNVCCALCNTITSVPIPAPNQFAHVICGHCRTTLMYPHGAPSVKCAVCQYVTNVNMANARVPLPANRPNGTAIPGTLPSTSMTQTVVVENPMSVDESGKLVSNVVVGVSTEKK

SEQ ID NO: 2159 - DNA, 522 bp, Populus trichocarpa
  POPTR_0001s43300.1
atgcaaagccaggtggtgtgtagagggtgtgcaagtgtattgttatatccaagtggagcttctaacgtttgttgtgctttatgtagtactgttacttccattccttctcctgggatggacatggctcaactcatatgtagaggttgcaggtcattgctaatgtatccacatggggcaacaactgtgagatgctcctgctgccacgtagtgaacattgcaccaggatataaccaggccgctcatgtcaactgtgggaactgccggactgctcttatgtatccaaatggatctccatctgtcaagtgtcctgtctgtcactatgttactaatgttagtatggctaacatgagaattccgcttccagcaaacagacctaatggtataggtggaacagcaccatctacttcaatgccattgccccattctcagactcaaactgtcgttgtggaaaaccccatgtctgttgatgaaagtggcaaattggtcagcaatgttgttgtcggtgtcactacagaaaaaaaa

SEQ ID NO: 2160 - protein, 174 aa, Populus trichocarpa
  POPTR_0001s43300.1
MQSQVVCRGCASVLLYPSGASNVCCALCSTVTSIPSPGMDMAQLICRGCRSLLMYPHGATTVRCSCCHVVNIAPGYNQAAHVNCGNCRTALMYPNGSPSVKCPVCHYVTNVSMANMRIPLPANRPNGIGGTAPSTSMPLPHSQTQTVVVENPMSVDESGKLVSNVVVGVTTEKK

SEQ ID NO: 2161 - DNA, 537 bp, Populus trichocarpa
  POPTR_0011s15810.1
atgcagagccaggtggtgtgtagagggtgtagaagtttattgttatatccaagtggagctactaatgtttgttgtgctttatgtagtaccgttacctctattcctgctcctgggatggacttggctcaactcatatgtcgaggttgcaggacattgctaatgtatgcacggggggcaacaactgtgagatgctcctgctgccacatagtgaactttgcaccagtaggacctaaccaggttgctcatgtcaactgtgggaactgccagactacacttatgtatccgaatggtgctccatctgtcaagtgtgcggtctgtcactatgttactaacattagtacggctaatgtgagagttccgcttccagcaaacagacctagtggtataggtggaacaatgccgtctacttcaacagtaagtaactggacttacttttctttcctgactcaaactgtcgttgtggaaaaccctatgtctgttgatgaaagtggcaaattggtcagcaatgttgttgttggtgtcactacagaaaaaaaa

SEQ ID NO: 2162 - protein, 179 aa, Populus trichocarpa
  POPTR_0011s15810.1
MQSQVVCRGCRSLLLYPSGATNVCCALCSTVTSIPAPGMDLAQLICRGCRTLLMYARGATTVRCSCCHIVNFAPVGPNQVAHVNCGNCQTTLMYPNGAPSVKCAVCHYVTNISTANVRVPLPANRPSGIGGTMPSTSTVSNWTYFSFLTQTVVVENPMSVDESGKLVSNVVVGVTTEKK

SEQ ID NO: 2163 - DNA, 777 bp, Vitis vinifera
  GSVIVT01037958001
atgttatttaaatgtatttataatttttatttaaaaatattggtacattttgacacaaaatatttttatttaacaatattgataatttcatttatgattttatatttgaatttcaacgcgcaatatcctttcttaaatcttcaattctcaaaatctgattccaccaaatctacaaccttttcacaccgtattttcgcattcaattcatcgccttttccgttcaattgttcgagctcggagaggaaattcagttatcaatcagctatgcagagccatctcatgtgtaatgggtgtaggagcattcttgtttatcccagaggagctacaaatgtctgttgcgcattatgcaattcagttacctcagtcccacctcctgggttggaaatggctcaacttatatgtggaggatgtcggaccttgctaatgtacactcgtggtgcaacaagtgtgagatgctcctgctgtcatacggtgaaccttgcaccagcgccatccaaccaggttgcccatgtcaactgcgggaactgccgaacaacacttatgtatccatatggagctccatcagtcaaatgtgcagtttgccactatgttacaagtgttggtatggttaatgttagggttccaattcctgtgcacagacctaatgctgcagcaatctctgcatcaacaccctctacttcatcaagccaaactgtggtcgtcaagaaccctatgtctgttgatgaaagtggcaaattggttagcaatgttgttgttggagtcaccacagagaaaaaa

SEQ ID NO: 2164 - protein, 259 aa, Vitis vinifera
  GSVIVT01037958001
MLFKCIYNFYLKILVHFDTKYFYLTILIISFMILYLNFNAQYPFLNLQFSKSDSTKSTTFSHRIFAFNSSPFPFNCSSSERKFSYQSAMQSHLMCNGCRSILVYPRGATNVCCALCNSVTSVPPPGLEMAQLICGGCRTLLMYTRGATSVRCSCCHTVNLAPAPSNQVAHVNCGNCRTTLMYPYGAPSVKCAVCHYVTSVGMVNVRVPIPVHRPNAAAISASTPSTSSSQTVVVKNPMSVDESGKLVSNVVVGVTTEKK

SEQ ID NO: 2165 - DNA, 486 bp, Solanum lycopersicum
  Solyc02g069720.2.1
atgcttctttatcccagaggagcttctaatgtctgctgtgcagtgtgcaatgcactcacccctgtcccaccacctggaatggaaatggctcaattgatatgtggaggctgtcgtacattacttatgcatccacgtggagcgaacagtgtgagatgctcctgctgtcatacggtgaaccttgtcccaggtccaaaccagtttgctcatgtctactgcgggaactgccgtatgatgctgatgtatccatgtggagctccatcggttaaatgtgcagtatgccattatattaccaatgttaatgcaggagatggaagagcccatgcacctttgaaccctcctaacggcactgctactactgcttcaggatcctcttcaactgccaaggctcgttcacaaaatcaaactgttgtcgtccaaaacccaatgtctgtcgatgagagtggcaagttggtgagtaatgtagttgttggtgtaacaacaacatca

SEQ ID NO: 2166 - protein, 162 aa, Solanum lycopersicum
  Solyc02g069720.2.1
MLLYPRGASNVCCAVCNALTPVPPPGMEMAQLICGGCRTLLMHPRGANSVRCSCCHTVNLVPGPNQFAHVYCGNCRMMLMYPCGAPSVKCAVCHYITNVNAGDGRAHAPLNPPNGTATTASGSSSTAKARSQNQTVVVQNPMSVDESGKLVSNVVVGVTTTS

SEQ ID NO: 2167 - DNA, 417 bp, Arabidopsis thaliana
  AT1G09030.1
atgacagacgaagatagattgttgccaatagccaatgtagggagacttatgaagcaaatcctaccatcaaatgcaaagatctcaaaagaagcaaaacaaacagttcaagaatgtgcaacagagttcataagctttgttacatgcgaagcatcagagaagtgccacagggagaatcggaagacggtgaatggagacgacatctggtgggctctcagcactctcggcctcgataactatgctgacgccgtgggtaggcatcttcacaagtaccgtgaagccgagagagaaagaactgagcacaacaaaggtagcaatgatagtgggaatgagaaagaaaccaacactagaagtgatgtacagaaccaatcgacaaaatttattagagttgttgagaagggaagcagctcctcggcccgt

SEQ ID NO: 2168 - protein, 139 aa, Arabidopsis thaliana
  AT1G09030.1
MTDEDRLLPIANVGRLMKQILPSNAKISKEAKQTVQECATEFISFVTCEASEKCHRENRKTVNGDDIWWALSTLGLDNYADAVGRHLHKYREAERERTEHNKGSNDSGNEKETNTRSDVQNQSTKFIRVVEKGSSSSAR

SEQ ID NO: 2169 - DNA, 546 bp, Brachypodium distachyon
  Bradi2g60050.1
atggccgactaccatggcggcggcggcggaagcccggagcggcggctgctggaagcaggaggcggatcaggggagcagcaggatcaggggatggggatcaaggagcaagacaggctgctgccgatcgcgaacgtggggcggatcatgaagcagatcctgcccccgaacgccaagatctccaaggaggccaaggagacgatgcaggagtgcgtgtcggagttcatcagcttcgtgaccggggaggcttccgacaagtgccacaaggagaagcgcaagaccgtcaacggggacgacgtctgctgggccttctccgccctgggattcgacgactacgtcgaccccatgcgcaggtacctcctcaagttccgcgagctcgagggcgaccgcgccgccgccgccgcatcctcccgcggcgccgccgccggcttccaggccggcgccgaccaccctgctgcttcctcttccgccgccgccgccgccgcaggtcatttcatgttcgacgccatggataggcccgataataataacagcggctccaggcagttt

SEQ ID NO: 2170 - protein, 182 aa, Brachypodium distachyon
  Bradi2g60050.1
MADYHGGGGGSPERRLLEAGGGSGEQQDQGMGIKEQDRLLPIANVGRIMKQILPPNAKISKEAKETMQECVSEFISFVTGEASDKCHKEKRKTVNGDDVCWAFSALGFDDYVDPMRRYLLKFRELEGDRAAAAASSRGAAAGFQAGADHPAASSSAAAAAAGHFMFDAMDRPDNNNSGSRQF

SEQ ID NO: 2171 - DNA, 531 bp, Oryza sativa
  LOC_Os01g70890.1
atggccgaccaccatggcggccaccacgccgacgggcatcgccggcagcagcagctgcagggggaggcggcggatcaggcggcggcggagatcatcaaggagcaggacaggttgctgccaatcgcgaacgtggggcgaatcatgaagcagatcctcccccccaacgccaagatctccaaggaggccaaggagacgatgcaggagtgcgtctcggagttcatcagcttcgtcaccggcgaggcctccgacaagtgccacaaggagaagcgcaagacggtcaacggcgacgacgtctgctgggccttcggcgccctcggcttcgacgactacgtcgaccccatgcgcaggtacctcaacaagtaccgcgagctcgagggcgaccgcgccgccgccgccgccacctcccgctccggcgccggcgccgccgcgggccccgaccacccttcctcctcctcctccgccgccgccgccaccgccggtcatttcatgttcaacgccatggacaggtcgacggatagctccaggcagttc

SEQ ID NO: 2172 - protein, 177 aa, Oryza sativa
  LOC_Os01g70890.1
MADHHGGHHADGHRRQQQLQGEAADQAAAEIIKEQDRLLPIANVGRIMKQILPPNAKISKEAKETMQECVSEFISFVTGEASDKCHKEKRKTVNGDDVCWAFGALGFDDYVDPMRRYLNKYRELEGDRAAAAATSRSGAGAAAGPDHPSSSSSAAAATAGHFMFNAMDRSTDSSRQF

SEQ ID NO: 2173 - DNA, 537 bp, Zea mays
  GRMZM2G473152_T01
atggccgatcaccaccaccaccaccaccacgggcatccgccggacgggcccggcggcgcgggggaccagctggaggtaatcaaggagcaggaccggctgctgcccatcgccaacgtcggccgcatcatgaagcagatcctgccgcccaacgccaagatctccaaggaggccaaggagacgatgcaggagtgcgtgtccgagttcatcagcttcgtcacgggcgaggcctccgacaagtgccacaaggagaagcgcaagaccgtcaacggcgacgacgtctgctgcgccttcggcgcgctcggcttcgacgactacgtcgaccccatgcgcaggtacctgcacaagtaccgcgagctcgagggcgaccgcgccgcgtcctcccgcggaggcggaggcggaccggccggcgccgcagaccccgcgtccgcctcggccgccgccggtcccagccccagcgccgcatcagccggtcatttcatgttcggcgccgccatggaccggcccgacaacaactcatccgccggcgccaggcccttt

SEQ ID NO: 2174 - protein, 179 aa, Zea mays
  GRMZM2G473152_T01
MADHHHHHHHGHPPDGPGGAGDQLEVIKEQDRLLPIANVGRIMKQILPPNAKISKEAKETMQECVSEFISFVTGEASDKCHKEKRKTVNGDDVCCAFGALGFDDYVDPMRRYLHKYRELEGDRAASSRGGGGGPAGAADPASASAAAGPSPSAASAGHFMFGAAMDRPDNNSSAGARPF

SEQ ID NO: 2175 - DNA, 762 bp, Setaria italica
  Si004874m
cgaaccaatggcccggtgccgccgtgcagtgggcacgaccaccgcgggcagcgcgcgcgggtggtcaaggcgagctctgcctctctgggcagctcggccgcagccacgagcggagacaattcaacgaccccaactgcagaggaagagcgagagcgagcagcctatagcgatagcgacagccagcagcaagaacgcgcgcgcgcgcgggggcgagggagaaggccgggccgggaggaaagcgagctaggcatggccgaccaccacgggcagccgccgggcggcggcggcggtggggcggaggagatcaaggagcaggaccggctgctccccatcgccaacgtggggcgcatcatgaagcagatcctgccgcccaacgccaagatctccaaggaggccaaggagaccatgcaggagtgcgtctccgagttcatcagcttcgtcaccggcgaggcctccgacaagtgccacaaggagaagcgcaagaccgtcaacggcgacgacgtctgctgggccttcggcgcactcggcttcgacgactacgtcgaccccatgcgcaggtacctccacaagtaccgcgagctcgagggcgaccgcgccgccgccgccgcatcctcccgcgggggcgggcctcccggcccggaccacccctccacctcgggcggccccggcgccggggccggacccggacccagcggcggcggcggcggtcatttcatgttcggcgccatggacaggagcgataacaacagctccaggcccttt

SEQ ID NO: 2176 - protein, 254 aa, Setaria italica
  Si004874m
RTNGPVPPCSGHDHRGQRARVVKASSASLGSSAAATSGDNSTTPTAEEERERAAYSDSDSQQQERARARGRGRRPGREESELGMADHHGQPPGGGGGGAEEIKEQDRLLPIANVGRIMKQILPPNAKISKEAKETMQECVSEFISFVTGEASDKCHKEKRKTVNGDDVCWAFGALGFDDYVDPMRRYLHKYRELEGDRAAAAASSRGGGPPGPDHPSTSGGPGAGAGPGPSGGGGGHFMFGAMDRSDNNSSRPF

SEQ ID NO: 2177 - DNA, 531 bp, Citrus clementina
  clementine0.9_032915m
atggtcgataatacaggagcagctggagctggtgcttcaagtgatgatgggggtatcaaggagcaagaacggttgctgccgattgccaacgttggccggatcatgaagcaaattttgccggcgaatgcaaaaatctcaaaggaagcaaaagaaacgatgcaagaatgtgtttcggagttcataagcttcatcaccagtgaagcatcggaaaagtgtagaaaggaaaggcgaaagactgtcaacggtgacgatatttgctgggccctcggaaccctagggtttgatgattatgcagggccaataaggaggtacttgcataagtatagggagttagaaggagagagagctaatcagcaagacaaggcaagcaatagcaatagcaatattaatattaatgaagaaagggaggaaccggcgggatcttcgtatggagctgatgatgaacaaattacaaggaatcaagccctagcttcaatttcatttaagtccaatgtgaatgaaaggagtaatagcttcaactcaaggcgatat

SEQ ID NO: 2178 - protein, 177 aa, Citrus clementina
  clementine0.9_032915m
MVDNTGAAGAGASSDDGGIKEQERLLPIANVGRIMKQILPANAKISKEAKETMQECVSEFISFITSEASEKCRKERRKTVNGDDICWALGTLGFDDYAGPIRRYLHKYRELEGERANQQDKASNSNSNININEEREEPAGSSYGADDEQITRNQALASISFKSNVNERSNSFNSRRY

SEQ ID NO: 2179 - DNA, 360 bp, Eucalyptus grandis
  Eucgr.B01293.1
atggtggataacattggtgccaacgatggaagcatcaaggagcaagacaggctactcccaatagccaacgtggggcggatcatgaagcaaatcgtccctcccaacgcaaaaatctcaaaggaagcgaaagaaacgatgcaagactgtgtctcagagttcatcggcttcgtgaccagtgaagcgtctgagaagtgccggagggagaggaggaagaccgtgaatggcgatgatatttgctgcgctatggagacactgggtttcgacgattatgctggtatgctaagaaggtatttgcatagatatagggaattagaaggagaaaaggctaatcaagacaaggcgatgaacaacactgaaaag

SEQ ID NO: 2180 - protein, 120 aa, Eucalyptus grandis
  Eucgr.B01293.1
MVDNIGANDGSIKEQDRLLPIANVGRIMKQIVPPNAKISKEAKETMQDCVSEFIGFVTSEASEKCRRERRKTVNGDDICCAMETLGFDDYAGMLRRYLHRYRELEGEKANQDKAMNNTEK

SEQ ID NO: 2181 - DNA, 279 bp, Eucalyptus grandis
  Eucgr.B01299.1
atgaagcaagtcctgcctcccaacgcaaaaatctccaagcaaacgaaagaaacgatgcaagaatgtgtctcagagttcatcggcttcgtgaccagcgaagcatcggagaagtgccggaaggagaggaggaagaccgtgaacggtgatgatatttgctgcgctatggagacgatgggtttcgatgattatgctggtctgctaagaaggtatttgcatatatatagaggattagaaggggaaaaggctaatcaagtcaaggcgatgaataacactcaacag

SEQ ID NO: 2182 - protein, 93 aa, Eucalyptus grandis
  Eucgr.B01299.1
MKQVLPPNAKISKQTKETMQECVSEFIGFVTSEASEKCRKERRKTVNGDDICCAMETMGFDDYAGLLRRYLHIYRGLEGEKANQVKAMNNTQQ

SEQ ID NO: 2183 - DNA, 360 bp, Eucalyptus grandis
  Eucgr.B01300.1
atggaagataacatcggttctgacgaaggaagcatcaaggagcaagacaggttgcttccaatagccaacgtggggcggatcatgaagcaagtcctgcctcccaacgcaaaaatctcaaagcaaacgaaagaaacgatgcaagaatgtgtctcagagttcatcggcttcgtgaccagcgaagcatcggagaagtgccggaaggagaggaggaagaccgtgaacggtgatgatatttgctgcgctatggagacaatgggtttcgatgattatgctggtctgctaagaaggtatttgcatatatatagaggattagaaggggaaaaggctaatcaagtcaaggcgatgaacaacactcaacag

SEQ ID NO: 2184 - protein, 120 aa, Eucalyptus grandis
  Eucgr.B01300.1
MEDNIGSDEGSIKEQDRLLPIANVGRIMKQVLPPNAKISKQTKETMQECVSEFIGFVTSEASEKCRKERRKTVNGDDICCAMETMGFDDYAGLLRRYLHIYRGLEGEKANQVKAMNNTQQ

SEQ ID NO: 2185 - DNA, 342 bp, Eucalyptus grandis
  Eucgr.B01303.1
atggaagataacatcggttctaacgatggaagcatcaaggagcaagacaggttgctcccaatagccaacgtggggcggatcatgaagcaaatcctccctcccaatgcgaaaatctcgaaggaagcgaaagaaacgatgcaagaatgtgtctcagagttcatcggcttcgtgactggcgaagcgtccgagaagtgccggaaggagaggaggaagaccgtgaacggtgatgatatttgctgggctatggagactctgggtttcgacaattatgccggtccattaaggaggtatttgcatagatatagggacttagaaggagataaagctaatcaagacaggcag

SEQ ID NO: 2186 - protein, 114 aa, Eucalyptus grandis
  Eucgr.B01303.1
MEDNIGSNDGSIKEQDRLLPIANVGRIMKQILPPNAKISKEAKETMQECVSEFIGFVTGEASEKCRKERRKTVNGDDICWAMETLGFDNYAGPLRRYLHRYRDLEGDKANQDRQ

SEQ ID NO: 2187 - DNA, 549 bp, Eucalyptus grandis
  Eucgr.H03892.1
atggatgagagcaataacaaccctggggtggctgataatgccctgggcgacgacgggcagttcaaggagcaagaccggctgcttccgatagcgaatgttgggcggatcatgaagcagaacttgccgccgaatgccaagatctccaaggaggccaaggagacgatgcaggagtgcatgtcggagttcatcagcttcgtcacaagcgaggcgtccgataagtgccggaaggagaggaggaagactgtgaatggagacgacatctgctgggcgatgcaagccctaggcttcgacgactatgcgagtgctttgaggaggtacctgcatagatatagggaaatagaaggggaaagagtgaatcaagagaaggctgcaagcggcggtagtgaaggattagcaacagatcattatcgctggcacgagcaatcctcgcatgcgattattggtcatcagcatcctagcaatagtcgagcggaagaagcttcaacctcgctcttgagtttcgacgcatcagatcagaggaggaagagtggttcttcttcaaggccctat

SEQ ID NO: 2188 - protein, 183 aa, Eucalyptus grandis
  Eucgr.H03892.1
MDESNNNPGVADNALGDDGQFKEQDRLLPIANVGRIMKQNLPPNAKISKEAKETMQECMSEFISFVTSEASDKCRKERRKTVNGDDICWAMQALGFDDYASALRRYLHRYREIEGERVNQEKAASGGSEGLATDHYRWHEQSSHAIIGHQHPSNSRAEEASTSLLSFDASDQRRKSGSSSRPY

SEQ ID NO: 2189 - DNA, 450 bp, Populus trichocarpa
  POPTR_0008s22520.1
atggtcgataatgttggtgctggtgcttcaagtgacgacggcggcgtcaagctggagcaagacaggttgttgcctatagccaacgttggacggatcatgaagcaaattctgccggctaacgcgaaaatctccaaagaagccaaggaaacgatgcaagaatgtgcttcagagtttattagctttgtcaccggtgaagcatccgagaagtgtagaaaggaaaggcgcaaaaccgtgaatggagatgatgtctgctgggctatgggagccctaggttttgatgactacgccgggccactaagaaggtatcttcagagatatagagagatagaaggagatagagctaatcaagagaagcctgctaacgctaataatactagtattgctgatcaagaaaaagaagcaccaccgtcctcctcctcgtcatatagaaataatcaaggaatcaggatg

SEQ ID NO: 2190 - protein, 150 aa, Populus trichocarpa
  POPTR_0008s22520.1
MVDNVGAGASSDDGGVKLEQDRLLPIANVGRIMKQILPANAKISKEAKETMQECASEFISFVTGEASEKCRKERRKTVNGDDVCWAMGALGFDDYAGPLRRYLQRYREIEGDRANQEKPANANNTSIADQEKEAPPSSSSSYRNNQGIRM

SEQ ID NO: 2191 - DNA, 414 bp, Vitis vinifera
  GSVIVT01017741001
atggtcgataatcctggcgctagtgcttcaactgatgatggcagtatcaaggagcaagaccgtttgttgccaatcgcaaatgttagccggatcatgaagcaaactttgccgactaatgcaaaaatctctaaggaagccaaggagacgatgcaggagtgtgtgtcggagttcattagttttgtcacaggagaagcatccgagaagtgcaagaaggagagaaggaagacggtgaacggggacgacatctgctgggctctggcagcactaggctttgatgactatgccgggccattaaaaaggtacttacaaaggtatagagaattagaaggagatagagtactgaatcaagagaaggctggcaacactgaagaaaacgatgaaccatcctcatgtagaggtagccaaccaaggaat

SEQ ID NO: 2192 - protein, 138 aa, Vitis vinifera
  GSVIVT01017741001
MVDNPGASASTDDGSIKEQDRLLPIANVSRIMKQTLPTNAKISKEAKETMQECVSEFISFVTGEASEKCKKERRKTVNGDDICWALAALGFDDYAGPLKRYLQRYRELEGDRVLNQEKAGNTEENDEPSSCRGSQPRN

SEQ ID NO: 2193 - DNA, 414 bp, Solanum lycopersicum
  Solyc01g067130.2.1
atgtctcaacaaaacataggtggtgcaagctcttcaaacgatgaaggagcagcaggtagcagtagggaacaagaccgtttgttgcctatagctaacgttggtcgcataatgaaaaatattcttccaccaaatgcaaaaatatcaaaagaagcaaaagaaacaatgcaagaatgtgtgtctgagtttattggatttgtgactggtgaagcatcggataagtgtagaaaagagcgtcggaagacggtcaacggcgacgacatttgttgggctttaggaacattagggtttgatgattatagcggagctttgaagagatatttacatagatatagagagagtgaaggtgaaaaagttaatcaagaacaagcaggaggaggagcatcaggatctaatcaaccaagaaatttgcttgat

SEQ ID NO: 2194 - protein, 138 aa, Solanum lycopersicum
  Solyc01g067130.2.1
MSQQNIGGASSSNDEGAAGSSREQDRLLPIANVGRIMKNILPPNAKISKEAKETMQECVSEFIGFVTGEASDKCRKERRKTVNGDDICWALGTLGFDDYSGALKRYLHRYRESEGEKVNQEQAGGGASGSNQPRNLLD

SEQ ID NO: 2195 - DNA, 267 bp, Glycine max
  Glyma07g37840.1
atgaagcagattctacctccgaacgcaaaaatctccaaggaatcgaaggaaacaatgcaagagtgcgtgtcggagttcataagctttgtaacgagcgaggcgtcagagaagtgcaggaaggaaaggaggaagactgtgaacggggatgacatatgctgggccttgggttcgcttggttttgacgactatgcagagccattgagaaggtatttgcaaagatatagagaactagaagtcgatagaggaaatagcccccccaaaagagaa

SEQ ID NO: 2196 - protein, 89 aa, Glycine max
  Glyma07g37840.1
MKQILPPNAKISKESKETMQECVSEFISFVTSEASEKCRKERRKTVNGDDICWALGSLGFDDYAEPLRRYLQRYRELEVDRGNSPPKRE

SEQ ID NO: 2197 - DNA, 348 bp, Glycine max
  Glyma17g02810.1
agttcctctaatattgctgaaaatagtggcatcatcagggaacaggaccggttgttgccaatagccaatgttgggaagatcatgaagcagattctacctccgaacgcaaaaatctccaaggaatcgaaggaaacaatgcaagagtgcgtgtcggagttcataagctttgtaaccagcgaggcgtcggagaagtgcaggaaggaaaggaggaagacagtgaacggggatgacatatgctgggccttggggtcgcttggttttgacgactatgcagagccattgagaaggtatttgcaaagatatagagaacaagaactagatagagcaaataacccccccaaaagagga

SEQ ID NO: 2198 - protein, 116 aa, Glycine max
  Glyma17g02810.1
SSSNIAENSGIIREQDRLLPIANVGKIMKQILPPNAKISKESKETMQECVSEFISFVTSEASEKCRKERRKTVNGDDICWALGSLGFDDYAEPLRRYLQRYREQELDRANNPPKRG

SEQ ID NO: 2199 - DNA, 378 bp, Glycine max
  Glyma09g05150.1
atggaagatagcattggaggcagttcctcaaacgacaacaacatcatcaaggaacaggaccgattgctgccaatagccaatgttggtcggctcatgaagcagattcttcctcagaacgcgaaaatctcgaaggaggcgaaagaaacgatgcaggaatgtgtgtcggagttcataagcttcgtgaccagcgaggcttcggagaagtgcaggaaggagagaaggaagacagtgaatggtgatgacatttgttgggccttggcaacactaggctttgatgactatgctgaaccaatgagaaggtacttgcatagatatagagaggttgaggtagaccataataataagttgggaccacgtacaaattctaccccacttaat

SEQ ID NO: 2200 - protein, 126 aa, Glycine max
  Glyma09g05150.1
MEDSIGGSSSNDNNIIKEQDRLLPIANVGRLMKQILPQNAKISKEAKETMQECVSEFISFVTSEASEKCRKERRKTVNGDDICWALATLGFDDYAEPMRRYLHRYREVEVDHNNKLGPRTNSTPLN

SEQ ID NO: 2201 - DNA, 387 bp, Glycine max
  Glyma15g16460.1
gatattggaggcagttcctcaaacgacaacaacaacaatggtggcatcatcaaggaacaggaccggttgctgccaatagccaatgttggtcggctcatgaagcggattcttcctcagaacgccaaaatctcgaaggaggcgaaggagacgatgcaggaatgtgtgtcggagttcataagcttcgtgacgagtgaggcttcggagaagtgcaggaaggagaggaggaagacagtgaatggtgatgacatttgttgggccttggcaacactaggctttgataactatgctgaaccaatgagaaggtacttgcatagatatagagaggttgaggtagatcataataaggtcaatcttcaagaaaaagggaatagtcctgaagagaaggac

SEQ ID NO: 2202 - protein, 130 aa, Glycine max
  Glyma15g16460.1
DIGGSSSNDNNNNGGIIKEQDRLLPIANVGRLMKRILPQNAKISKEAKETMQECVSEFISFVTSEASEKCRKERRKTVNGDDICWALATLGFDNYAEPMRRYLHRYREVEVDHNKVNLQEKGNSPEEKDD

SEQ ID NO: 2203 - DNA, 471 bp, Citrus clementina
  clementine0.9_035455m
atggttgaagagcaagataagctactgccaattgccaacgtgggtaaaataatgaagcaaatcctaccaccgagagcaaagatttctaaagaagccaaacaaacaatgcaagaatgtgcaacggagtttataagttttgtaactggtgaggcatctgacaagtgtcacaaggagaatcgaaagacggttaacggagacgatatctgttgggctctcagtactctagggtttgataactatactgaggctatagtgagatacttgcataaatatagggaagctgaaagagagagagccaagaaccaaagtaaagtaactgctacaagcagcaacgaagaaaaagcaaaagaatcatcaagccataaaactagtaaacagacgacgtctgtgcagcaaattgatgaaacttcaagtgctccttcagagcttagagctcttaagaagggcaaaagctctctgacaaaccctcct

SEQ ID NO: 2204 - protein, 157 aa, Citrus clementina
  clementine0.9_035455m
MVEEQDKLLPIANVGKIMKQILPPRAKISKEAKQTMQECATEFISFVTGEASDKCHKENRKTVNGDDICWALSTLGFDNYTEAIVRYLHKYREAERERAKNQSKVTATSSNEEKAKESSSHKTSKQTTSVQQIDETSSAPSELRALKKGKSSLTNPP

SEQ ID NO: 2205 - DNA, 357 bp, Glycine max
  Glyma10g29440.1
atggatcaggatgagcaagatagagcattgccgattgcaaatgtgagtcgaatcatgaagcaaatccttccccctagtgcaaagatctccaaagaaggtaaacaagtaatgcaagagtgtgtgacagagttcataagttttgtgactggcgaggcatctgacaagtgtcacaaggagaatcgcaagaccgttaatggggatgacatctgttgggctctaagttcattagggtttgacaactatgctgaggccataggaaggtacttgcataaatacaggcaagctgaaagggagaaaatcaatcacgacaaaaaggttactcgtgacaaggggacttccccttctatatatctgctt

SEQ ID NO: 2206 - protein, 119 aa, Glycine max
  Glyma10g29440.1
MDQDEQDRALPIANVSRIMKQILPPSAKISKEGKQVMQECVTEFISFVTGEASDKCHKENRKTVNGDDICWALSSLGFDNYAEAIGRYLHKYRQAEREKINHDKKVTRDKGTSPSIYLL

SEQ ID NO: 2207 - DNA, 450 bp, Glycine max
  Glyma20g37870.1
atggatcaggatgtgcaagatagagcgttgccgattgcaaatgtgggtcgaatcatgaagcaaattcttccccccagtgcaaagatctctaaagaagggaaacaactaatgcaagagtgtgtgacagagttcataagtttcgtgactggtgaggcatctgacaagtgtcacaaggagaatcgcaagaccgttaatggggatgacatctgttgggctctaagttccttagggtttgacaactatgctgaggccattggaaggtacttgcatatatacaggcaaggtgaaagggagaaaatcaatcacaccaaaaagtatgaaaaccctcagaaccaaactcaaatcaaccgtgctccaccaccaccactacttctgtctaggagatcttatacacaaggactagtaactgaattcaacaaaccaataatggaatctagtaacagtggtaac

SEQ ID NO: 2208 - protein, 150 aa, Glycine max
  Glyma20g37870.1
MDQDVQDRALPIANVGRIMKQILPPSAKISKEGKQLMQECVTEFISFVTGEASDKCHKENRKTVNGDDICWALSSLGFDNYAEAIGRYLHIYRQGEREKINHTKKYENPQNQTQINRAPPPPLLLSRRSYTQGLVTEFNKPIMESSNSGN

SEQ ID NO: 2209 - DNA, 447 bp, Populus trichocarpa
  POPTR_0005s02750.1
atggatgatgagcaagatagattgttgcctattgccaatgtgggtcggatgatgaagaaaatcctgccaccaactgccaagatttccaaagaagcaaaacaaaccatgcaagaatgtgcgacagaatttgtaagttttgtaactggtgaggcatctgataagtgtcagaaagaaaaccgcaagacagtgaacggagatgacatctgttgggctctcatttctctagggtttgatgaccatgcagaggctatggtaaggtacttgcataaatatagagaggctgaaagagagagatccactaaccaacataaagcttctggcactgaccaaggtgaagaatccaaccatgaaagtaagcagccaaagcaaccaattgaagctcctaataacggagtagaatttagggttcttgagaagggcaacagcagctctttcacaaatccttcc

SEQ ID NO: 2210 - protein, 149 aa, Populus trichocarpa
  POPTR_0005s02750.1
MDDEQDRLLPIANVGRMMKKILPPTAKISKEAKQTMQECATEFVSFVTGEASDKCQKENRKTVNGDDICWALISLGFDDHAEAMVRYLHKYREAERERSTNQHKASGTDQGEESNHESKQPKQPIEAPNNGVEFRVLEKGNSSSFTNPS

SEQ ID NO: 2211 - DNA, 447 bp, Populus trichocarpa
  POPTR_0013s02030.1
atggaggaggagcaagataaattgttgcctattgccaacgtgggtcggattatgaagcaaatcctgcccccaactgccaagatttccaaagaagcaaaacaaacaatgcaagaatgtgcaacggaatttataagtttcgtaaccggtgaggcatccgacaagtgtcataaggagaatcgcaagacagtgaacggagatgacatctgttgggctctaggttctctagggtttgatgactatgccgaggctatagtaaggtacttgcatagatatagagaagttgaaagggagagatcagctaatcaacacaaagcttctggcactgaacaagacattgaagaatccaaccatataagtttccaaccacagcagcaaattgaagctcctaacggaatagaatttaggattcttgataagggcaacggcagctctttcacaaatccatcc

SEQ ID NO: 2212 - protein, 149 aa, Populus trichocarpa
  POPTR_0013s02030.1
MEEEQDKLLPIANVGRIMKQILPPTAKISKEAKQTMQECATEFISFVTGEASDKCHKENRKTVNGDDICWALGSLGFDDYAEAIVRYLHRYREVERERSANQHKASGTEQDIEESNHISFQPQQQIEAPNGIEFRILDKGNGSSFTNPS

SEQ ID NO: 2213 - DNA, 429 bp, Populus trichocarpa
  POPTR_0013s02020.1
atggatgatgataagcaagatcagttgttgcctattgccaatgtgggtcgggtaatgaagcagcacctgccaccaacagcaagggtttcgaaagaagctaagcaaagaatgcaagaatgtgcaacagagtttataagctttgtcactagcgaggcttctaacaagtgtcgaaaggagaatcgcaaggctttgaacggagatgatgtctgttgggctctcagttctttagggtttgatgactatgctgacactacagtaaggtatttgcacaaatacagggaggctgaaagggaaaaggctgaccaaaagaaagctactgacactgaaaaggtcaacaaagatgaagaatccaaccatacaagttgccaagcagtacagcagcaaactgaccagattcctgaaccaacaatattagagtttaggtttctt

SEQ ID NO: 2214 - protein, 143 aa, Populus trichocarpa
  POPTR_0013s02020.1
MDDDKQDQLLPIANVGRVMKQHLPPTARVSKEAKQRMQECATEFISFVTSEASNKCRKENRKALNGDDVCWALSSLGFDDYADTTVRYLHKYREAEREKADQKKATDTEKVNKDEESNHTSCQAVQQQTDQIPEPTILEFRFL

SEQ ID NO: 2215 - DNA, 456 bp, Vitis vinifera
  GSVIVT01010260001
atggctgatgagcaggatctcctgctgcctattgccaatgtgggtcggatcatgaagcaaatcccgccaccaagtgccaagatttccaaagaagccaaagaaacaatgcaagaatgtgtatctgagttcataaagtttgttactggcgaagcatctgaaaagtgtcaaagggagaaccgaaagaccgtgaatggagatgacatttgttgggcactgagtgctctgggatttgatgaccatgctgaggctatagtaaggtatttgcataagtacagggagtttgaaagagagagaccaaatcaaagggtccaaaatgaagtcgatagcactcgaaccaaatctggagcatcagactataaatgcatccaagcggggaagcagactgaaactcctactccaatattattgttcgaagttactgatcaaaatggtaatagatctcttacaaagccattt

SEQ ID NO: 2216 - protein, 152 aa, Vitis vinifera
  GSVIVT01010260001
MADEQDLLLPIANVGRIMKQIPPPSAKISKEAKETMQECVSEFIKFVTGEASEKCQRENRKTVNGDDICWALSALGFDDHAEAIVRYLHKYREFERERPNQRVQNEVDSTRTKSGASDYKCIQAGKQTETPTPILLFEVTDQNGNRSLTKPF

SEQ ID NO: 2217 - DNA, 456 bp, Vitis vinifera
  GSVIVT01010264001
atggctgataagcaggatctcttgctgcctattgccaacgtgggtcggatcatgaagcaaatcctaccaccgggggccaaggtttccaaagaagccaaagaaacagtgcaagaatgtgtatctgaatttgtaaagttcgttactggtgaagcatctgccaagtgtagaaaggaggaccgacagacggtgactgtagatgacatttgttgggcactgagtgctctgggacttgatgactatgctggggctacggttaggtatttacacaaatacagggagtttgaaagagaaagagtcaatcaaaaggtccaaaacgaagtccacagcactcgagccaaatctggagcatcaaactataaatgtatccaagcagggaaacagaccgaaacccccactccgctattattgttcaaagttactgatcaaaatggtagtagctctcttacaaagctatct

SEQ ID NO: 2218 - protein, 152 aa, Vitis vinifera
  GSVIVT01010264001
MADKQDLLLPIANVGRIMKQILPPGAKVSKEAKETVQECVSEFVKFVTGEASAKCRKEDRQTVTVDDICWALSALGLDDYAGATVRYLHKYREFERERVNQKVQNEVHSTRAKSGASNYKCIQAGKQTETPTPLLLFKVTDQNGSSSLTKLS

SEQ ID NO: 2219 - DNA, 480 bp, Eucalyptus grandis
  Eucgr.B01940.1
atggttgatgagcaagagagattactaccaatcgcaaacgtgggccgtataatgaaggaaatactgccgccgagcgccaagatctccaaggaagccaagcagacaatccaagaatgcgcgacagagttcataggcttcgtgacgggtgaggcgtcagacaggtgtcacaaggagaatcgcaagacggtgaacggcgacgacatctgttgggctctgagcaatctagggtttgacaactacgctgaggcaatggccaggtacttgcacaaatatagggagtatgaaagagagaaaaatagaagcaacagcagcaacaacaatcaaaccctagctacttcaagtggagataataaggatgatggagagctacacttaagaattgaagagcagcaagtaaggcaagttgaaacccaccaaagtcttgctcctttagagtttcaattcattgacaagggccagagttccacatctgagccagct

SEQ ID NO: 2220 - protein, 160 aa, Eucalyptus grandis
  Eucgr.B01940.1
MVDEQERLLPIANVGRIMKEILPPSAKISKEAKQTIQECATEFIGFVTGEASDRCHKENRKTVNGDDICWALSNLGFDNYAEAMARYLHKYREYEREKNRSNSSNNNQTLATSSGDNKDDGELHLRIEEQQVRQVETHQSLAPLEFQFIDKGQSSTSEPA

SEQ ID NO: 2221 - DNA, 507 bp, Eucalyptus grandis
  Eucgr.H04502.1
atggttgatgagcaagagaagttgcttccaatcgcaaacgtgggtcggatcatgaagctaatccttccaccaagtgcaaagatctccaaggaagccaaacaaaccatccaagagtgtgccagtgagttcataagctttgtgacaggtgaggcgtccgacaagtgtcacaaggagaaccgcaagaccgtgaatggggacgacatctgttgggctctgagttctttagggtttgatgactatgctgaggcaattgttaggtacttgcacaagtacagggagcatgaaagtgagagagccaactgtaagcagcaaactagtaaagccagaaatgttactggtcggcatgatcatgaagataaagtagaaggtgaggacgacgacgacgacgatgatgaaggatcgtgccacacagatagtcaaagaggaaagggtattacttcaacttgtcacaggcatcctgctccgttagagttcagaatcattgacaggaatgagacctctccatct

SEQ ID NO: 2222 - protein, 169 aa, Eucalyptus grandis
  Eucgr.H04502.1
MVDEQEKLLPIANVGRIMKLILPPSAKISKEAKQTIQECASEFISFVTGEASDKCHKENRKTVNGDDICWALSSLGFDDYAEAIVRYLHKYREHESERANCKQQTSKARNVTGRHDHEDKVEGEDDDDDDDEGSCHTDSQRGKGITSTCHRHPAPLEFRIIDRNETSPS

SEQ ID NO: 2223 - DNA, 441 bp, Vitis vinifera
  GSVIVT01031089001
atggttgatgagcaggatcatttgctgcctattgccaacgtgggccggatcatgaagcaaatcctgccaccaagagccaagatctccaaagaaggcaaagaaacaatgcaagagtgtgcatctgagttcataagttttgttactggtgaagcatctgacaagtgtcacaaagagaaccgcaagacggtgaacggagatgacatttgttgggctctgagtgcactaggatttgatgactatgctgaggctatattaaggtacttacataaatatagggagtttgaaagagagagagccaaccaaaacaaagttggtggcagtgaagacaaagatgaagcatcaaactgtaaatatatccaagctgggaagcaaactgtaattcctcctccattagagtgcagagttatcaagaagggtaatagctctcttacaaagccatct

SEQ ID NO: 2224 - protein, 147 aa, Vitis vinifera
  GSVIVT01031089001
MVDEQDHLLPIANVGRIMKQILPPRAKISKEGKETMQECASEFISFVTGEASDKCHKENRKTVNGDDICWALSALGFDDYAEAILRYLHKYREFERERANQNKVGGSEDKDEASNCKYIQAGKQTVIPPPLECRVIKKGNSSLTKPS

SEQ ID NO: 2225 - DNA, 438 bp, Solanum lycopersicum
  Solyc01g099320.2.1
atggtggatgaacatgtgaaattggtaccaatagccaatgtaggaaggattatgaaacaaatcttgccaccaacagccaaaatatcgaaagaagctaaggaaaccatgcaagaatgtgcatcagaatttattagttttgtaactggtgaagcatctgacaagtgtcacaaggagaatcgtcgaacggttaatggagatgacatctgttgggctctgagttcacttggttttgacaactatgctgaggttatgttgaggtacttgtataagttgagagactttgaaagagtaagagctaatcaaaacaaattaggtttaaatgatgatgataatactgatgatgacgatgatgatggtgaagctcgacgtgctagtactacttctctagcaccattggagattaatgtaatggaaagagtgcaacgtagacgcttcaat

SEQ ID NO: 2226 - protein, 146 aa, Solanum lycopersicum
  Solyc01g099320.2.1
MVDEHVKLVPIANVGRIMKQILPPTAKISKEAKETMQECASEFISFVTGEASDKCHKENRRTVNGDDICWALSSLGFDNYAEVMLRYLYKLRDFERVRANQNKLGLNDDDNTDDDDDDGEARRASTTSLAPLEINVMERVQRRRFN

SEQ ID NO: 2227 - DNA, 552 bp, Eucalyptus grandis
  Eucgr.H01189.1
atggtggacaagtcgggctcaaactcagatagagaaggcgacaacaagtacaacttctcaggaggagcagcaacaagtgcttcaaatgaagaagcaagctctttaagagagcaagatcgtctcctcccaattgccaatgtggggaggatcatgaagcatattctccccccgaacgccaagatctcgaaggaggcgaaggagacgatgcaggagtgcgtttctgagttcatcagcttcgtcaccggtgaggcctcggacaagtgccacaaggagaagcgcaagaccgtgaacggcgatgacatcgtctgggcacttgggtccctagggtttgatgactatgccgagccgctcaagcggtacttaaatcggtatcgggaggtcgaaggggagagggccagccaaaacaaggtcacaggcggcgaatcaagaaacgagaagaacttgtacggggatgagtcgccggagaagcagctgggcgctgcctcttcgtcgcctctgaagttcttcgatgtggccgacaggagtaccaatggctctttctctaagaggtat

SEQ ID NO: 2228 - protein, 184 aa, Eucalyptus grandis
  Eucgr.H01189.1
MVDKSGSNSDREGDNKYNFSGGAATSASNEEASSLREQDRLLPIANVGRIMKHILPPNAKISKEAKETMQECVSEFISFVTGEASDKCHKEKRKTVNGDDIVWALGSLGFDDYAEPLKRYLNRYREVEGERASQNKVTGGESRNEKNLYGDESPEKQLGAASSSPLKFFDVADRSTNGSFSKRY

SEQ ID NO: 2229 - DNA, 528 bp, Populus trichocarpa
  POPTR_0014s12710.1
atggttgatagcataggcaataataattcagataaggaatggctaaagtacgactttgctggaggcagtaccagtgatgatggaatcatcaaggagcaagacaggttgcttcccatagctaatgtgggacggatcatgaagcagattctgcctcccaacgcaaaaatctcgaaagaagccaaggaaaccatgcaagaatgtgtatctgagttcatcagctttgtcactggagaggcatccgacaagtgtcacaaggagaagcgcaagacagttaatggggacgacatatgctgggctcttgcatctctagggtttgatgattattccgagcccctaaagaggtatttatacaaatatagggaggtggaaggagagagagctagccataacaaggcaagcaacaacgaagaaaaggatgattcgtcgaagtatagaggtgaatctatcttgaaggctactgtttatcctcatactccattgaagctccctgggaatattgatagaagtaatagtctctcaaggcgattt

SEQ ID NO: 2230 - protein, 176 aa, Populus trichocarpa
  POPTR_0014s12710.1
MVDSIGNNNSDKEWLKYDFAGGSTSDDGIIKEQDRLLPIANVGRIMKQILPPNAKISKEAKETMQECVSEFISFVTGEASDKCHKEKRKTVNGDDICWALASLGFDDYSEPLKRYLYKYREVEGERASHNKASNNEEKDDSSKYRGESILKATVYPHTPLKLPGNIDRSNSLSRRF

SEQ ID NO: 2231 - DNA, 534 bp, Solanum lycopersicum
  Solyc06g009010.1.1
atggttgataataatatcaacatattaaggtctaaatatgatagagaaagctctaattacaattcaattagtgaagatggattgatttataaggagcaagataggttgttgccaatagcaaatgttgggagaattatgaagcaaattcttccaccaaatgctaagatttcaaaagaagccaaagagactatgcaagaatgtgttagtgagtttattagctttgtgactggtgaagcatctgataagtgtcacaatgagaagaggaagactttgaatggtgatgatatttgttgggctttgggaagtttaggttttgatgattatgttgagccattgaagaggtatttgcacaagtatagagagttagaaggtgaaagaattaatcaaagtaaaggtgttggacttggaaataatattgaagatcaaaggggaagagatgatgatgaattaacacaaaggggatctacaattccattcaaaatcaccatcatggatcataagggggaaaacaattttctccctacaaggccttat

SEQ ID NO: 2232 - protein, 178 aa, Solanum lycopersicum
  Solyc06g009010.1.1
MVDNNINILRSKYDRESSNYNSISEDGLIYKEQDRLLPIANVGRIMKQILPPNAKISKEAKETMQECVSEFISFVTGEASDKCHNEKRKTLNGDDICWALGSLGFDDYVEPLKRYLHKYRELEGERINQSKGVGLGNNIEDQRGRDDDELTQRGSTIPFKITIMDHKGENNFLPTRPY

SEQ ID NO: 2233 - DNA, 519 bp, Citrus clementina
  clementine0.9_035771m
atggttgatagcgcagggcataacttagaaagctacgataatagctacaactttacggtgggtgcgagtagtggtactgatcaagatggggtgattaaggagcaagatcggttgcttccgatagctaatgtggggagaattatgaagcagattcttcctccgaatgccaagatttcgaaagaagcaaaagaaaccatgcaagaatgtgtatctgagttcattagctttgttactggagaggcatcggataagtgtcacaaggagaagcgcaagacggttaatggggatgacatttgctgggctcttgcaactctaggatttgataattatgctgatcaattgaagaggtatttgcatagatacagggagttggaaggagagagagctaatcaaaataaggctggaaataataataatggaaaagatagcgaaccagctgcacaaaggaaacataatacgctttcatctatgcctttgaagttcaatgcgactgacactagcaatggctccaggcgattc

SEQ ID NO: 2234 - protein, 173 aa, Citrus clementina
  clementine0.9_035771m
MVDSAGHNLESYDNSYNFTVGASSGTDQDGVIKEQDRLLPIANVGRIMKQILPPNAKISKEAKETMQECVSEFISFVTGEASDKCHKEKRKTVNGDDICWALATLGFDNYADQLKRYLHRYRELEGERANQNKAGNNNNGKDSEPAAQRKHNTLSSMPLKFNATDTSNGSRRF

SEQ ID NO: 2235 - DNA, 441 bp, Glycine max
  Glyma02g17310.1
atgggtgacaacaacataggcaaagtcttagagagagaaggctttaagtacaacttcacggcagctgcaagtgacacctctgcacaagatgaggtgattaaagagcaagatcggttgcttccaatagcaaatgtggggcgcatcatgaagcaaatccttcctcctaacgccaagatctcaaaggaagctaaagaaaccatgcaagaatgtgtgtccgagttcattagctttgtcactggggaagcttctgacaagtgtcacaaggagaagcgcaagaccgtgaatggcgacgatatttgctgggcccttgctaccctagggtttgatgactactctgagccacttaaaaggtacttgcataagtatagggagttcgaaggggagagagcaaatcaaaataagggtaacaacaacacttatgaaaacaacattgcaaacata

SEQ ID NO: 2236 - protein, 147 aa, Glycine max
  Glyma02g17310.1
MGDNNIGKVLEREGFKYNFTAAASDTSAQDEVIKEQDRLLPIANVGRIMKQILPPNAKISKEAKETMQECVSEFISFVTGEASDKCHKEKRKTVNGDDICWALATLGFDDYSEPLKRYLHKYREFEGERANQNKGNNNTYENNIANI

SEQ ID NO: 2237 - DNA, 435 bp, Glycine max
  Glyma10g02480.1
atgggtgacaacataggcaaagtcttagacagagaaggctttaagtacaacttcacagcttcagcaagtggcacatctgcacaagatggggtgattaaggagcaagatcggttgcttccaatagctaatgtggggcgcatcatgaagcaaatccttcctcccaacgccaagatctcaaaggaagctaaagaaaccatgcaagaaagtgtgtccgagttcattagctttgtcactggggaagcttctgacaagtgtcacaaggagaagcgcaagaccgtgaatggtgacgatatttgctgggcccttgctactttagggtttgatgactactctgagccacttaaaaggtacttgtataagtatagggagatggagggggagagagcaaatcaaaataagggtagcaatggttatgaaaacaacattgcaaacata

SEQ ID NO: 2238 - protein, 145 aa, Glycine max
  Glyma10g02480.1
MGDNIGKVLDREGFKYNFTASASGTSAQDGVIKEQDRLLPIANVGRIMKQILPPNAKISKEAKETMQESVSEFISFVTGEASDKCHKEKRKTVNGDDICWALATLGFDDYSEPLKRYLYKYREMEGERANQNKGSNGYENNIANI

SEQ ID NO: 2239 - DNA, 384 bp, Vitis vinifera
  GSVIVT01010959001
atgaagcagatcctgccacctaatgcaaaaatctccaaggaagcaaaagaaaccatgcaagaatgtgtctcggagttcattagctttgtgactggagaagcatctgacaagtgtcacaaggagaagcgcaagactgtcaatggggacgacatttgttgggctttgggaactttagggtttgatgactatgctgaaccgcttaaaaggtatttgcatagatatagggagttagaaggtgagaaagctaaccagagtaaggctagtgaagaaaatgatgaaccttcaaattatagaggtgaaccaccaatgaagcatacagtttcacctgctccactgaagttcaatgtgcttgagaggagtaatagctctctttccaagcgactt

SEQ ID NO: 2240 - protein, 128 aa, Vitis vinifera
  GSVIVT01010959001
MKQILPPNAKISKEAKETMQECVSEFISFVTGEASDKCHKEKRKTVNGDDICWALGTLGFDDYAEPLKRYLHRYRELEGEKANQSKASEENDEPSNYRGEPPMKHTVSPAPLKFNVLERSNSSLSKRL

SEQ ID NO: 2241 - DNA, 414 bp, Solanum lycopersicum
  Solyc09g074760.1.1
atggttgataccaacaatatattagggtcatttgactcgagtgaagaaggagggtttaaggagcatgataagtttttgccaatagctaacgtgggacgaattatgaagcatattcttcctcaaaacgcgaagatttcaaaagaggggaaagaaacaatgcaagaatgtgtctccgagttcataagctttgttactagtgaagcatcggagaaatgtcacaaggagaagaggaagacgttgaacggagatgatatatgttgggctatgggaaatttagggtttgatgattatgttgagccattgaacaggtatttgcataggtatagagagttagaaggtgaaaaagctaaccaaaataaggttgatattgggaacaagaatgaagaaagtctccttggaagattttatggtcct

SEQ ID NO: 2242 - protein, 138 aa, Solanum lycopersicum
  Solyc09g074760.1.1
MVDTNNILGSFDSSEEGGFKEHDKFLPIANVGRIMKHILPQNAKISKEGKETMQECVSEFISFVTSEASEKCHKEKRKTLNGDDICWAMGNLGFDDYVEPLNRYLHRYRELEGEKANQNKVDIGNKNEESLLGRFYGP

SEQ ID NO: 2243 - DNA, 1260 bp, Arabidopsis thaliana
  AT2G43260.1
atgggggaagaagaagagaaccctaattcgatcgacattcttcccgagctacttgaagaagttctccttagattgcccacgaaatcgatcctcaaatgcagaatcgtctcaaaacaatggaggtcactcctggaatcgagtaggttcgcggagaggcatatgagtcttcaaaacagccgccggagaatcttagctgcttacaactgcgactgcggcggacggaggaagctcctacccgagtcacggtttgaaggggacgaagagattgtctatctgcactgcgacgcctcacgaccctcgatgacttgccaaggtgtgatctgcttccccgagcaagattggatcatcgttttgaacccatcgactagccaacttcggcgattcccttccggcttgaaccataactgcagatttagaattggattatggaagactttctctccgggaaactgggtaatggggtttggtagagacaaagtgaatgggaggtataaagtggtgaggatgtcttttgctttctggagagttaggcaagaggagcctgtggtggaatgtggtgttcttgatgttgatactggtgaatggcggaagctgagtccacctccttatgtggtcaatgtgggaagcaaatcggtatgcgtgaatggatctatctactggttacacattcagacggtttacagaatactagccttggatcttcacaaagaagagtttcataaagtcccagtgccgcctacgcagatcactgtggacactcagatggtgaaccttgaggaccgtctcgtacttgctataaccagagttagccctgaatggatactagaggtatggggcatggatacatacaaagaaaaatggagcaagacttactccataagtttggatcatagagttgtttcctggcgaaggcagaaaaggtggttcacgcccgtggcagtttctaagcaagcgaatcttgtcttctatgacaataagaagaggctattcaaatattatccagtgaaagatgagattcgttgtctctccttagacatttgtgttctgtctccttacgtggaaaacttggtccctcttccgttaaagccaagccatccgcatcctactccgaaaaattcagattttgaaatgaggatatcaagatgccgcttgttttcgacgccaggttcttggatatccaaaattttgaaatggaatgttatgactctagagattttgtttacctctctagcaatagttggttatatatgcttacctctc

SEQ ID NO: 2244 - protein, 420 aa, Arabidopsis thaliana
  AT2G43260.1
MGEEEENPNSIDILPELLEEVLLRLPTKSILKCRIVSKQWRSLLESSRFAERHMSLQNSRRRILAAYNCDCGGRRKLLPESRFEGDEEIVYLHCDASRPSMTCQGVICFPEQDWIIVLNPSTSQLRRFPSGLNHNCRFRIGLWKTFSPGNWVMGFGRDKVNGRYKVVRMSFAFWRVRQEEPVVECGVLDVDTGEWRKLSPPPYVVNVGSKSVCVNGSIYWLHIQTVYRILALDLHKEEFHKVPVPPTQITVDTQMVNLEDRLVLAITRVSPEWILEVWGMDTYKEKWSKTYSISLDHRVVSWRRQKRWFTPVAVSKQANLVFYDNKKRLFKYYPVKDEIRCLSLDICVLSPYVENLVPLPLKPSHPHPTPKNSDFEMRISRCRLFSTPGSWISKILKWNVMTLEILFTSLAIVGYICLPL

SEQ ID NO: 2245 - DNA, 918 bp, Arabidopsis thaliana
  AT1G49790.2
atgttcgcggagaggcgtatgaatgttcaaaagaagctgaaaattatggccgccagagaccggaaccggttccgaccgctattcgaaggggacgaagaggtcgatatgctctatctaaactgcaatgtcgcctcacgaccgtctttatcatgtgacggtctggtttgcatccccatacctggctggatcaacgttttaaacccttccactggagaattccttagattctcttctggtcgagatccacggttaatcaacgacttcgaatgcgtcgattctaagtttgatgttttccctggattttggacgatgggattcggtagggacaacgttaatgggagctataaaatagtgagaatgttgtttgatcgtcatttcgagaaccgctattgccagattctagatgttaatattggggaatggcgaaaacaaagacagcctccttactttgtgggatatagagagaagtccgcttgtgtgaatgggtccatctactggtcacaagcactcattcgttgcaaattactagcttttgatctttactcggaagaatttcgtgatgtcccaacaccgcctcgatccgaaatatgcgaaaggtcatgccaaatagtgaatcttgaagaccgtctagtcttagccgtaacctatactacgagtcttcattggaatgttaagatatggagcatggatgcacacgatggaacacggagcattacttactccatacgtttattctctaaagatatgaactctatggaacatactaggaagagtagtagaatagtaatcgacaaatcaggagagcatttgctgatggtagtgaaagaatcaagagtgactatctgtttggtggaagatgatatttggccaagttatgagaatactaatccacagaggagaggttctggtcattccgag

SEQ ID NO: 2246 - protein, 306 aa, Arabidopsis thaliana
  AT1G49790.2
MFAERRMNVQKKLKIMAARDRNRFRPLFEGDEEVDMLYLNCNVASRPSLSCDGLVCIPIPGWINVLNPSTGEFLRFSSGRDPRLINDFECVDSKFDVFPGFWTMGFGRDNVNGSYKIVRMLFDRHFENRYCQILDVNIGEWRKQRQPPYFVGYREKSACVNGSIYWSQALIRCKLLAFDLYSEEFRDVPTPPRSEICERSCQIVNLEDRLVLAVTYTTSLHWNVKIWSMDAHDGTRSITYSIRLFSKDMNSMEHTRKSSRIVIDKSGEHLLMVVKESRVTICLVEDDIWPSYENTNPQRRGSGHSE

SEQ ID NO: 2247 - DNA, 1203 bp, Arabidopsis thaliana
  AT2G43440.1
atggaggaaaaaagagaaaacactaactcgatctacatagttcccgagctattggaagatattttccttcgattgcctttgaaatcaatcctgaaattcaaaaccgtatcaagacaatggagatcaatcctggaatccaagttgttcgtggagaggcgcgggaatcttcaaaagcaccaccggaaaatcctagctgcttacaactgcaactactttatgcggccgagtatcttccctgagtctcgtttcgaaggggacgaagagatcgtttatctacactgcgacgccgcgcaaccctcgatgacttgcgacggtttactctgcatcaccgaacctggttggtttaacgttttgaacccatccgctggacaactccggcgattccctcccggcccaggtccagtaaaaggaccgcaggaaaattggctattgggattcggtagagacaacgttacgggcaggtataaaatagtgaggatgtgttttcatgattgttatgaatttggtattcttgatattgaaactggtgtatggagcaaactgaggtcacctcctcataatatgcttccgggaagtaaatcggtgtgtgtgaatggatcaatctactggttacaaattagtgcgggttacataatattagctatggatcttcacgaagaaagctatcatggtgtccaccaccttccggctacgtgggtcacgcaggaaacccagttagtgaaccttgaggaccgtctagccatggccatgaccaccaacgttgggcctgaatggatactagagatctggagcatggatatagaaggaaaaggatggagcaagggttactcgtggagcaagagttactccataagtttagcccatggagttggtttttcctggccatggcagaaaaggtggttcactcctgtgtgggtttctaagcaagggaatcttctcttctacgataatcacaagaggctattcaaatattattcaggaacagatgagattcgttgtctctcctctaacatctgtgttatatcttcttatgttgaaaatttggccccacttccgttaaaaccaagccatacgcatcatgatcttgggaattcgaattccaagttcagcacgtccagatgccacttgtttccgacgcgaggttcttggatatccaaagttttgtttacctctatactatttgggtatatctgcttacctctc

SEQ ID NO: 2248 - protein, 401 aa, Arabidopsis thaliana
  AT2G43440.1
MEEKRENTNSIYIVPELLEDIFLRLPLKSILKFKTVSRQWRSILESKLFVERRGNLQKHHRKILAAYNCNYFMRPSIFPESRFEGDEEIVYLHCDAAQPSMTCDGLLCITEPGWFNVLNPSAGQLRRFPPGPGPVKGPQENWLLGFGRDNVTGRYKIVRMCFHDCYEFGILDIETGVWSKLRSPPHNMLPGSKSVCVNGSIYWLQISAGYIILAMDLHEESYHGVHHLPATWVTQETQLVNLEDRLAMAMTTNVGPEWILEIWSMDIEGKGWSKGYSWSKSYSISLAHGVGFSWPWQKRWFTPVWVSKQGNLLFYDNHKRLFKYYSGTDEIRCLSSNICVISSYVENLAPLPLKPSHTHHDLGNSNSKFSTSRCHLFPTRGSWISKVLFTSILFGYICLPL

SEQ ID NO: 2249 - DNA, 1215 bp, Arabidopsis thaliana
  AT2G43445.1
atggaggaagaaagagaaaacactaactctatctacatagtttccgagctacttgaagaaattttccttggattgcctttgaaatcaatcctcaaattcaaaaccgtctcaaaacaatggagatcaatcctggaatcgaacttgttcgtggagaggcgtagaactcttcaaaagaaccacccgaaaatcctggctgcttataactgcgactactgcacgcggccgggtatcctccctaagtctcagttcgaaggggacgaagagatcgtttatcttcataccgacgccacgcaaccctcgatgacttgcgacggtttagtctgcatcaccgaacctggttggttcaacgttttgaacgtctccaccggacaactccgaagatttctacccggtccagatccaggaccgcaagcaaattggctcttgggattcggtagagacaaagttacgggcaagtataaaatagtgaggatgtgttttcatgattgttatgaatttgggattcttgatattgaatctggcgaatggagcaaactgatgtcacctcctcatataatgcgagtgggaagtaaatcggtgtgtgtgaatggatcaatctactggttacaaattagtgtgagttacataatactggccttggatcttcaccaagaaacgttcaatggtgtctaccacctcccggctacgtgggtcacgcaagatacccaattagtgaaccttgaggaccgtctagccatggccatgacgaccaaagttgggcctgaatggatactagagatctggagcatggatatagaagaaaaaggatggagcaagcgttacacatggagcaaggcttactccataagtttagcccatagagttgttgtatcctggccatggcaaaaaaggtggttcacgccggtatcggtttctaagcaagggaatcttgtcttctatgataatcacaagaggctgttcaaatattattcaggtacagatgagattcgttgtctctcctctaacattaatgttatatcttcttacgttgaaaatttggccccacttccgttaaaaccaagccatacgcatcacgatcttgggaattcgaattccaagttcagcacatccagatgccacttgtttccgacgcgaggttcttggatatccaaagtttttagaaggaatgttttgtttacctctctagtagtagttggttatatatacttacctctc

SEQ ID NO: 2250 - protein, 405 aa, Arabidopsis thaliana
  AT2G43445.1
MEEERENTNSIYIVSELLEEIFLGLPLKSILKFKTVSKQWRSILESNLFVERRRTLQKNHPKILAAYNCDYCTRPGILPKSQFEGDEEIVYLHTDATQPSMTCDGLVCITEPGWFNVLNVSTGQLRRFLPGPDPGPQANWLLGFGRDKVTGKYKIVRMCFHDCYEFGILDIESGEWSKLMSPPHIMRVGSKSVCVNGSIYWLQISVSYIILALDLHQETFNGVYHLPATWVTQDTQLVNLEDRLAMAMTTKVGPEWILEIWSMDIEEKGWSKRYTWSKAYSISLAHRVVVSWPWQKRWFTPVSVSKQGNLVFYDNHKRLFKYYSGTDEIRCLSSNINVISSYVENLAPLPLKPSHTHHDLGNSNSKFSTSRCHLFPTRGSWISKVFRRNVLFTSLVVVGYIYLPL

SEQ ID NO: 2251 - DNA, 1194 bp, Arabidopsis thaliana
  AT4G17780.1
atggaggaagaagagaaaaaccctagttcgatctacatagttgccgatcttctagaagatatattccttcgacttcccttgaaatccattctcatatcgaaaagcgtctcaaaacgatggagatcaattcttgagtcgaagacgttcgtggagagacgaatgagtcttcaaaagaagcgcaaaatcctggctgcttacaactgcaaatgcggctgggagcctaggctcctccccgggtcgtcgcagtgcaaagggaacgaagagatcgtctatctgcactgcaacgccgcacaaccctcgtttacttgcgacggtttggtctgcattctcgaaccacgttggatagacgttttgaacccctggacaaggcaactccggcgatacggattcggatttggaaccatatttggagtaggttcggctttctctccaagacattgggcaatgggatttggtaaagataaagttaccggaagctataaagtagtgaagatgtgtttaatatctttcagtgaaatttgtgcacgtgatcctgaggtggagtatagtgttcttgatgtcgaaactggtgaatggcggatgttgagtccacctccttataaggtctttgaggtaagaaaatcggagtgtgcgaatggatcgatctactggttacacaaacctactgagagggcttggacaatactagccttggatcttcacaaagaagagttacataacatttcagttcctgatatgagtgtcacgcaagaaaccttccaaatagtgaaccttgaggaccgcctggccatagccaatacctatactaagactgaatggaaactagagatttggagcatggatacagaagtagaaacatggaccaagacttactccatagatttagagaatagagttgcttcccgggaaaggcggaacaggtggttcaccccggtgtcggtttctaagcaaggaaatattgtcttctatgataatcacaagagacttttcaagtattatccaaggaaaaacgagattctttatctctccgcagacacttgtgttatatctcctttttttgaaaatttagcaccacttcctcagaaatcaacccttcatacccccatcatcgccggagaaccaaatgcccccttaacgactctagtagtagtaggttccatttggtcaccactcttcttatttagtgtcaaacta

SEQ ID NO: 2252 - protein, 398 aa, Arabidopsis thaliana
  AT4G17780.1
MEEEEKNPSSIYIVADLLEDIFLRLPLKSILISKSVSKRWRSILESKTFVERRMSLQKKRKILAAYNCKCGWEPRLLPGSSQCKGNEEIVYLHCNAAQPSFTCDGLVCILEPRWIDVLNPWTRQLRRYGFGFGTIFGVGSAFSPRHWAMGFGKDKVTGSYKVVKMCLISFSEICARDPEVEYSVLDVETGEWRMLSPPPYKVFEVRKSECANGSIYWLHKPTERAWTILALDLHKEELHNISVPDMSVTQETFQIVNLEDRLAIANTYTKTEWKLEIWSMDTEVETWTKTYSIDLENRVASRERRNRWFTPVSVSKQGNIVFYDNHKRLFKYYPRKNEILYLSADTCVISPFFENLAPLPQKSTLHTPIIAGEPNAPLTTLVVVGSIWSPLFLFSVKL

SEQ ID NO: 2253 - DNA, 1161 bp, Arabidopsis thaliana
  AT2G43270.1
atgatttacgtagttcccgatctacttgaagaaattttccttggattgcctttaaaatcaatcctcagattcaaaaccgtctcaaaacaatggagatcaatcctggaatcgaagagtttcgcggagaggcgtttgaacgttgagaagaaggagaaaattctggctgttggagaccggactgagttgggattcgaaggtgaggaagagatccagatggtctatttacactgcgatattgacgccacacgaccctctctgacatgtgagggtttggtgtgtatcccagcaccaggttggatcaacgttttgaacccatcgaccagacaactccggagatttccttgtagccctaatcatcacgtgccctctgatcgtattcgttttcagttcagagacgaactatacctcacttcctttccggggaattgggagatgggatttggtagagacaaatttaatggtagctataaagtggtgaggatgtgttttagtcctgtggaaaaatgcgaggttcttgatgttgaaactggggaatggagtgaactgaatccacctcctaacgatattgacgtgggaaggaagtcacgtttcggaatcctagccttggatcttcacacactagagttccacaatgtttccgttccatctacgtgttgcaccatgagtgcccagatggtgaaccttgatgaccgtctagccataactaaaacaaacggtgcgccagaatgggagctagagatactgagcctgatggatgtagacaaagaaatatggagcaagacttactccataactttagccagtatcattattaaccacccatgggagtctagttggttcacggtgttgacggtttctaagctagggaatcttgtcttttgtgacaatcacaagcggttgtttaaatataataccgagacaaatgagatttgctgtctctcctcagatatttctgttatatctccttatctcgaggatttggtaccacttcgtttggactcaggacatgatcatcgggattacaaaatcaggacatctagttgcggattgttttcgaagcatccggaggcagggttattcaaggagatcatcacttttcggtttgtgtttgccactctagttctagttggttatcagtattatagatcattaaaattcaag

SEQ ID NO: 2254 - protein, 387 aa, Arabidopsis thaliana
  AT2G43270.1
MIYVVPDLLEEIFLGLPLKSILRFKTVSKQWRSILESKSFAERRLNVEKKEKILAVGDRTELGFEGEEEIQMVYLHCDIDATRPSLTCEGLVCIPAPGWINVLNPSTRQLRRFPCSPNHHVPSDRIRFQFRDELYLTSFPGNWEMGFGRDKFNGSYKVVRMCFSPVEKCEVLDVETGEWSELNPPPNDIDVGRKSRFGILALDLHTLEFHNVSVPSTCCTMSAQMVNLDDRLAITKTNGAPEWELEILSLMDVDKEIWSKTYSITLASIIINHPWESSWFTVLTVSKLGNLVFCDNHKRLFKYNTETNEICCLSSDISVISPYLEDLVPLRLDSGHDHRDYKIRTSSCGLFSKHPEAGLFKEIITFRFVFATLVLVGYQYYRSLKFK

SEQ ID NO: 2255 - DNA, 4578 bp, Oryza sativa
  LOC_Os04g49950.1
atgttaccggaaaacgtcggcgacggcggtggtggtggtggacgaccggtcatgttaccggaaaccgtcggcgacggtggttcatctgggctcttgtgcctgccaccggaagctctcggcgtgtcctcctccggcggcgcctgcgttccaccgccggaaactcttggcgtggaaggtggtggcacacgtacactggcgtatgcgtccggcggtgtgtgcttgccaccggaaactctcggtggtgtgtcctgtggtggcggcggcgaacggacactcgtgtttgcgtccgggggcgtgtgcgtgccaccggagatctttggtgtgcgtggcggcggcgatcttacacttgtgtatgcgtccggcggcggcgtgttcgtgccactggaagaagctgtcggatgttccggtggagggagtcgcacgcttgtttcaaccactggcgccggcggcggtggtgttcgacggggaaaggtctttggtgaaccaagggaaaatctgggagcaggcggtggaggagagcgcacgctcgtttcagacatcggtgtctgcggtggaggtgttcgacggggaaaggtcttcggtggaacggacggtggaggagagagctcgctcgtttcagccactggcgccggcggcggaggtgttcgacggggaacggtcttcggtggaccaagggagaatctaggaacgggcggtggaggagagagctcgctcgtttcagccactgctgccggcggcggaggtgttcgacggggaaaggtcttcggtggaccaagggagaatctgggaacgggcggtggaggagggtgctcgctcgtttcagccattggtgccggcggcggaggtgttatacggggaaaagtctttggtggaccaagggagaatctcggagcagacggtggaggagagcgcacgctcgtttcagccactggcgccagcggcggaggtgttcgacggggaaaggtcttcggtggaccaagggagaatctaggaacgggcggtggaggagagagctcgctcgtttcagccactgatgctggcggtggtggtgttggaccaggaaaggtctttggtggactaagggagaatctaggagcgggcggtggagaagagcggatgctcgtttcagccgttggtgttggcggcggcggtgttggactgggaaaggtcttcggtggaccaagggagaatctaggagcgggcggaggaggagattgcacactcgtttcagccattggcgacggtggtggtggtgttggactgggaaaagtcttcggtggaccaagcgagaatctcggagcgggcggtggaggagatcgcacactcatttcagccgttggcgccgacggcggtggtgttggactgggaaatgtctttggtggaccaagggagaatctgggatcggacggtggaggagagcgcacgctcgtttcagctgttggtgcctgcggcggtggtgttggactgggaaccgatggcgcgcacgcgccaccgctgctggtcgccgcgacgccggcgcaatgccgcagcaggccatgcgggaggagcgaggcgacgaaggtgcgggtgaagggcccgcagtgctcgtcggcctcgcacgccgcgaggcggcacgcgcgcggaatggggcaccccgtgaagaaggcggcgagcaggtcgtgcttgcagcggcccagcgtcagcagagactcccagcagatgcccgagtcggtgtgcgggccgcccgggaagatgctgtcgaacgcctcatcgatcattcatggcagtcgaggcatgcagcatatgtcgtcgaagaggggcaagagagcacgccggtcgtccgccggccagccgctgccggacgaaatgatgacagaaatcgttctgcgcctgccggcctattccatcgtccgtttccgcgctgtctcccgctcatgggccgctatgctctcttctcctggattccaggacggctacgcggccatggcagatgcccgtcgcatgagcatgagcaagttcgtcttctttgcggcgtcgccggcgtcgcccagaggcgccacggctgtctactcctgcgacgtcggcccagtccggcgcatcacgacgacgacgaccgacttgctcttcaatatcgaccgcctgcgcccgggcttcctcgtcgtctcaagcaggccgtgccacggcctgacgctcctggctgacactcgatccttcgcctactgggtgtgcaattccagcaccggcgtgttcaggccattgccgcggcggcgctgccacgatctgtccagcgccggcctagccttcgacgatcggaccaaggagcacaaggtggtgcatctcttctgccatgtgagccgtggcggcgagaacctcttccctgacacgacggtatttgagaaccgaaacagcagcgttccagtgctatgcttctctgttgccgacgaggccttcagcctggtcgctgggccggcggtcgacggcatagcggattactgcgctttggacagccactccccggctgttccactccacctggtggagctccatggctctttgtgcatggtccgcgatctccgccatcttccgcatggtgaaagctgcctggagatatgggcgctgagagattacagcgccagcgtatggtcactcgacttccgtgtcgccatgacgccgcaggtggcacgcgacatgcacgatccccggttcatcaccgtccttggatgtctcggcggcgcgcgcggagacgacgtcgggagtgtggagcggatcaagaaaatcctgatcgctacctcgcagcacaaggtgcacgcctacgacccagctacggggagcatcgaaacggtggtcaccgtcccagaggatttcgccggcggccgggaggaggcggtggccggtattcggattggtctgtacgaggacagccttgcccgtgtaggcggcgagagttgtcgacagagggaagccacggcggcgatgactgagatcctactacggttgccgcccaaatcaatcgccatgtgcatgctcgtttgcagacagtggcgcacactgatcgagagcgagcgctttcttacgtcacacatgcttgctaacatggaacggaagaaggtcatggtagtcacgaatggccgtcgacgggagaatttctttaatttcatgccggtggagacctggattgggcctgccgccaaagctcgttcggacgttcttgtcaaccgcaggatcctctgctctaagccatgccatggacttaacctgataagcaccagcagcgacgactacctgtgcaacccttgcactggttctatccggtgtcttggaatccgtggaaagtttcgtgagattgatccaactgtcagtattgatgacgatcgccgccatgtcacgagagttggcaggaacatcgggctaggattcgaccggttgtcacaagagcatgtagtggttgagatgagccgcttcaaaggcgacctgcagctgtgcatgatcaagacgagctgcgtggattactggagctgcgctggcaagccgccgaggccggtgaccgacatgccaccggcacatgttgacgggacgctctactggatcagcgagccacagccgacggcccgagaccgtgtcattgtggcatttgacatctcctcccgggagttctccgtcttgccatgccagccatgctgcagcgagagggacggcggtgattatccgttgctcgtcgagctggaaggatcgctgtcgctcgtcgtcgcaaacgcggaggagaacaatctgcagatatggacgatgcaggaggctgacggcacatggcacaaaagttacagcatcttactggacgagaggtacccggacttctcactaaaaacgggcgtggtggtagtgccactggacgccgtcgccgatagcaatggcggcggcaggatcttgctcgacacagggcgagcattgggctactacgatctcgagacgagaagcatcgacaccttgtactcgctcgaccagctaaagcttccccagtgccagatggcattccccatgctgtacggggatagcttggtgcccatccaggacgacgaaccgcccgactacgtcgcgccgactcttcgcgacgacgacggcgggcggcgctgctactaccagccgcaacacgtggagatcagcggcggcgagcagcctgcggctgcctcctgcgtattccggccatgcgaggcggccggcggcggctgcaggggcatgggctgcgtgtacgcgggtagctgctgcaggagggtgctgtgccgggagtgcagcctcccgtgcgtcgagcacaccgacggcttccacaccgcgatactgcccttcctgccgcggcgctccgcgacggcgaccgagatggccgaggatttgctgctgggtttgcctctcgagcacccgtgcgtgccggggcccgagtactgctactactactcggagggggacgaggtggaggaaggcgtggggcggcacgtgttcgtgtcgctcagggatctcgcgcgcaccaggcagccgcgccgtctcatcgagtgtgggtacaggatggatatgatttacattttggtccttttaaaaaacttatttcgcaaa

SEQ ID NO: 2256 - protein, 1526 aa, Oryza sativa
  LOC_Os04g49950.1
MLPENVGDGGGGGGRPVMLPETVGDGGSSGLLCLPPEALGVSSSGGACVPPPETLGVEGGGTRTLAYASGGVCLPPETLGGVSCGGGGERTLVFASGGVCVPPEIFGVRGGGDLTLVYASGGGVFVPLEEAVGCSGGGSRTLVSTTGAGGGGVRRGKVFGEPRENLGAGGGGERTLVSDIGVCGGGVRRGKVFGGTDGGGESSLVSATGAGGGGVRRGTVFGGPRENLGTGGGGESSLVSATAAGGGGVRRGKVFGGPRENLGTGGGGGCSLVSAIGAGGGGVIRGKVFGGPRENLGADGGGERTLVSATGASGGGVRRGKVFGGPRENLGTGGGGESSLVSATDAGGGGVGPGKVFGGLRENLGAGGGEERMLVSAVGVGGGGVGLGKVFGGPRENLGAGGGGDCTLVSAIGDGGGGVGLGKVFGGPSENLGAGGGGDRTLISAVGADGGGVGLGNVFGGPRENLGSDGGGERTLVSAVGACGGGVGLGTDGAHAPPLLVAATPAQCRSRPCGRSEATKVRVKGPQCSSASHAARRHARGMGHPVKKAASRSCLQRPSVSRDSQQMPESVCGPPGKMLSNASSIIHGSRGMQHMSSKRGKRARRSSAGQPLPDEMMTEIVLRLPAYSIVRFRAVSRSWAAMLSSPGFQDGYAAMADARRMSMSKFVFFAASPASPRGATAVYSCDVGPVRRITTTTTDLLFNIDRLRPGFLVVSSRPCHGLTLLADTRSFAYWVCNSSTGVFRPLPRRRCHDLSSAGLAFDDRTKEHKVVHLFCHVSRGGENLFPDTTVFENRNSSVPVLCFSVADEAFSLVAGPAVDGIADYCALDSHSPAVPLHLVELHGSLCMVRDLRHLPHGESCLEIWALRDYSASVWSLDFRVAMTPQVARDMHDPRFITVLGCLGGARGDDVGSVERIKKILIATSQHKVHAYDPATGSIETVVTVPEDFAGGREEAVAGIRIGLYEDSLARVGGESCRQREATAAMTEILLRLPPKSIAMCMLVCRQWRTLIESERFLTSHMLANMERKKVMVVTNGRRRENFFNFMPVETWIGPAAKARSDVLVNRRILCSKPCHGLNLISTSSDDYLCNPCTGSIRCLGIRGKFREIDPTVSIDDDRRHVTRVGRNIGLGFDRLSQEHVVVEMSRFKGDLQLCMIKTSCVDYWSCAGKPPRPVTDMPPAHVDGTLYWISEPQPTARDRVIVAFDISSREFSVLPCQPCCSERDGGDYPLLVELEGSLSLVVANAEENNLQIWTMQEADGTWHKSYSILLDERYPDFSLKTGVVVVPLDAVADSNGGGRILLDTGRALGYYDLETRSIDTLYSLDQLKLPQCQMAFPMLYGDSLVPIQDDEPPDYVAPTLRDDDGGRRCYYQPQHVEISGGEQPAAASCVFRPCEAAGGGCRGMGCVYAGSCCRRVLCRECSLPCVEHTDGFHTAILPFLPRRSATATEMAEDLLLGLPLEHPCVPGPEYCYYYSEGDEVEEGVGRHVFVSLRDLARTRQPRRLIECGYRMDMIYILVLLKNLFRK

SEQ ID NO: 2257 - DNA, 2874 bp, Brachypodium distachyon
  Bradi5g19770.1
atggcgctggagtacacctcgagggcgtcgaagagaaggattaccgcgctgtgcagcgaggccaatctgccggaggagatcatgtccgagatcttgctgctgctcccggccagatccgtcctccggtgccgcgctgtctgccgttcctgggccgccctgctctgctcccgaggcttcttggacgcctacgccgtcaaggccgacacccgctcccgccgcatggacaagtttgtcttgttcgcgccgtcggccgcgttgccgaaccgctccacggccgtctactcgttcgctcggggcgccgtcggggccccactcttcaccgtcgaccgcgtgcgcgccgacttcctgtgcttgtcgagcaggccatgccacggcgtcatgctcttttcggacacccgcagtggcacctactgggtgtgtaaccccagcaccggggagcgcagccccctgccgaagcagcaccgcggcctgacggaatcaagcgccggcttggtctacgaggaccggaccaaagagtgcaaggtggttcatctcttcaaggatgcccgcatgatcgggtgcgagatttacacgctctgtgaccccagccggcagtggaggccggcaaaccaagacgtagggctgctggggacagaaaacatggttgtaaaactcatgaacgccctgcaaactgaggacttggtgaccaaggcacctccggtgtttgcaaatggatgcctgcattggctactctaccccaacagtatggacatgcaggcggagccagcaggccgggacgcccttctttgcttctccgtcgccacggaaaccttcacactgctcaacgcgcctgcaagcgtactcgtggcagagtacagagaattggacgacagcttcccggcggttccggtgcacctagcagagctagaaggctacttgtgcctggtccatgacctccgccgtcgagggcaaggtagaaactgctggctggatgtatggatgctcagagatcacggtgccagcgagtggtcactggattaccgcatcgctcttcacacacacgatgtgcatatcccccggttcatcaccgtcctcggctgctgcagtggcgttggccaagaggggaattttcgtgaaacaaggaaaaagttactgattgcttcgtcacaacaccaggttcatacttacgatccggacacaggggatgtccaactagtcgtctctgttcctgatactgatatccgtattggccagaaggaggcacctgccgcgctttggtttggtctctacgaggacagcttagtccggattgggagcgaaagccatcaggagaagcaagagctatcggcactgacggagatcctggtgcgccttccggtcaagtcaatcgcacaatccatgctggtatgcaggcgatggtgctcgttgatcgagagcgagagctttgttgcagcacacatgtcggtgaagaggccgaagaggatcttgatggccaacaatggccgtgctcggcgagcactcttcgactttgccccggtgaagaactggcttcaagctgcaggtcccgctatcgccaaggacaagatcatctgctccaagccatgcaacgggctcagcctaataagcaccggcaatgatgacttcctatgcaacgtatgcactggcgccatccagtgtcttggaagacgtggcaaatcacactttagcccgactggcaatcatcgccggcatgccttctcggtcggcagaaacatcggattcggtttcgaccggtcaacgggagaacatgtggccgctgagataggccatatctctggtactctggcgtgcatgatcaagacaagcagcgaaaagcaatggagctgtgtcggcaagccgccgaggccggtgagcgacatgccgccggcgcacgtcgatgggacaatctactggatgagcaagcctatgcatgaggaagcgcgcgccgttgttgcgtttgagatctccacccgagcgttccgcgtcctcccatgtgaaccatgcttgaacaatgaccacgatgatgcatttgttgtcgagctaacggccggaacactctccgtcgttgtcgtgaacgccgaggcggaagagatggatatatgggtgatgcacaagcacagctcctcgtgggtttacgcatacaagatacagctcggccaacacgccgactattctctcaggaggggtcaggtggtggtgcccatggacgaagaagacggtaacgatggaaggatcctgctcaacacaggacgagctttaggctactacgacaccaaaacaggggcgctagaccacctctactcgctggacaaactgaagcttcctcggagcaatttggcctttcctatcttgtgccaggagagcctgattcgcatccaagacgacgaacttcccagccgcgtcgctcacccagtccgcgaccaaggatgcaagcgctgcgaccatcccgagcacgccgacgcatcgccagctgggcgaggacgagctttactgctaccgtgtgagggcggtgcatgtcgtgacattggtgttgtctaccggagctgctgcaggagactgttttgtggggcatgccaacgccgctgcctcgagcattcccagacacatgcactgcgcggcgatcctgtgctcccagcttacggttttgacgcgaccatggtaagcccggacagtgtcttgcccttttgccatccatccgtcccaggtccggagtactgctactataactcgatcgaggatggcgacgtggtgcgacatgttttcatctccctcaaggattacatgcgaggcgagcaatcgtgtcgttggacggagtgtgggtacaggatggagggacaggtagttaaggagatatgggttcggagatacctcaagttg

SEQ ID NO: 2258 - protein, 958 aa, Brachypodium distachyon
  Bradi5g19770.1
MALEYTSRASKRRITALCSEANLPEEIMSEILLLLPARSVLRCRAVCRSWAALLCSRGFLDAYAVKADTRSRRMDKFVLFAPSAALPNRSTAVYSFARGAVGAPLFTVDRVRADFLCLSSRPCHGVMLFSDTRSGTYWVCNPSTGERSPLPKQHRGLTESSAGLVYEDRTKECKVVHLFKDARMIGCEIYTLCDPSRQWRPANQDVGLLGTENMVVKLMNALQTEDLVTKAPPVFANGCLHWLLYPNSMDMQAEPAGRDALLCFSVATETFTLLNAPASVLVAEYRELDDSFPAVPVHLAELEGYLCLVHDLRRRGQGRNCWLDVWMLRDHGASEWSLDYRIALHTHDVHIPRFITVLGCCSGVGQEGNFRETRKKLLIASSQHQVHTYDPDTGDVQLVVSVPDTDIRIGQKEAPAALWFGLYEDSLVRIGSESHQEKQELSALTEILVRLPVKSIAQSMLVCRRWCSLIESESFVAAHMSVKRPKRILMANNGRARRALFDFAPVKNWLQAAGPAIAKDKIICSKPCNGLSLISTGNDDFLCNVCTGAIQCLGRRGKSHFSPTGNHRRHAFSVGRNIGFGFDRSTGEHVAAEIGHISGTLACMIKTSSEKQWSCVGKPPRPVSDMPPAHVDGTIYWMSKPMHEEARAVVAFEISTRAFRVLPCEPCLNNDHDDAFVVELTAGTLSVVVVNAEAEEMDIWVMHKHSSSWVYAYKIQLGQHADYSLRRGQVVVPMDEEDGNDGRILLNTGRALGYYDTKTGALDHLYSLDKLKLPRSNLAFPILCQESLIRIQDDELPSRVAHPVRDQGCKRCDHPEHADASPAGRGRALLLPCEGGACRDIGVVYRSCCRRLFCGACQRRCLEHSQTHALRGDPVLPAYGFDATMVSPDSVLPFCHPSVPGPEYCYYNSIEDGDVVRHVFISLKDYMRGEQSCRWTECGYRMEGQVVKEIWVRRYLKL

SEQ ID NO: 2259 - DNA, 2940 bp, Setaria italica
  Si015074m
atggcttcgaagaggagcaagcgcgtggccagtctcccggacgagatcgtcagcgagatcctgctgctgctcccggcgaggtcagtgctccgctgccgcgccgtctgccgccgatgggctgccgaactctcctcgcccgggttcatggacgcgtacgccgccagggccggcgcccgccggacgagcaagctcgagctcgtcgtcttcgccgcgtcccccggccaccgctccacggccgcctactcctgcagcggccaaggcggcgcccacgccgccgacccgctcttcgccgtcgaccacctgcgcacggacttcctctcgctgtcgagcaggccgtgccgcggcctcatgctcttctccgacacccgcaccgtcggcagctattgggtgtgcaaccctagcaccggcgagcgcaggccactgccgctcccaccgcagcaccgcggccagttgacgctctcgagcgccggcctggtcatcgatggccggaacatggagtgcaaggttgtccacctcttctacaaggtaggctcggagtggggtctgaagtgcgaggtttacacgctaggcgagcgcagccgccggtggaggcgggttaccgtaggcctggagtggctccgggtaaacgagaccaaggtcacgagagccttgcagaccgaggaggcggtgaccagggtgcccccagtccacgcggacggatgcttgtattggctcctttacccttgcgacatgggcgatccaccgggccaaaaccgagacggtgccactgccatcctacgcttctccgcggccgacgagagctttggcttcgtcgacgtgcccgcgggcctgccaatggaggattacgtgtcgctggaggagcactcgccggcggttcctgttcacctcgcggagctcaaaggctctctgtgcatggtccatgacctgcgtcaccaagggcatggtccaagctcgttggatgtctgggtgctaaggggtcgcgacgccggagggtggtcgctggattatcgcatccctgccacacctctaatggcacgggacgtgcacggccctcgcttcatcaccgtccttggctgcatcgtcacaggcaagcaggagaagttactggtcgctacatcggagcacaaggtctatgctttcgccacggacacaggccgtgtcgaaacagtgttctccatcggagagacgactggcattggcctgcagaaggaggcggccgctgcgctctggattggcctatatgaggacagcctggtcaggatcggtggtggcgcgagccgtcgggaggaggaagtgctgtcggcggtggcagagatactgctccggcttccgctcaaatcgatcgcgcaatccatgctggtctgcaggaggtggcgcgcggtgatcgagagcgagagcttcgttagaagacacgcgatgtcgtccatggagagtgcaaagaagacactgatggtcaccagtgggcgcgctcggcgtgccttctttaacttcaccccgatggagagatggcttgatcaagctagtcccgctggtcttgcggccgccctcgccaatggcaagatcatatgctctaagccttgccacgggctcaacctgattagcaccagcagcgatgactacctatgcaacccctgcaccggcgacatcaagtgcctaggcatccgtggcaaatcgcgtttcggaccacgctgcaatgatccccaagctgcaggtcgacatgcgttcacagtcggcagacagatcggtttcggtttcgaccggtctacgggggagcatgtcgcggttgagattggtcacctatgcggcactctggcctgcatgctcaagacgagcgagtcggattcctggacctgtgccgggacgccccccatgccggtgaccgacatgccgcccgctcacgtcgatgggacgctctactggatggccgagcggacacaggaggcgacggcgtcgtcgtctcaccagggcctcgtcatcgtggcgttcgacatctccgcacgaaggttcgacaccctccggtgcgaccaacctcgcctggacgacgatcacggcgcgttcctcgtggagctcaacaacatgctgtcgctcgtcgccacgaaccgccaggtcgaagagatggtgatctgggtgatgcgcggcaagcgcggggcatgggttgaggcgcacagggtatgcctgagggggcagcccagcatctcacccaggacgacggtggcggtgccactggagatcagtagcggagatggcaggatcctgctcagcacagggcgaactctgggctactacgacaccaggacgggagctctggacaccgtgtactcgctggaccatctgcagcttgctccatacgaattggccttcccgatgttgtgtcaggaaagcttggtccgcgttccagacgatgacgaacttcccgttggccgtgttgctcctccaccggtgagcagccacaatggccgacacggaagctgcaacgaccatcctgagcttgtcgatgtcgacgacgctggcaggacacctagatccatattctacgagtgccagaacgcgggatgtcgaggcaacggagacgtctactcagcttgttgcaagaggctgatctgcgtggagtgtctgcgccagtgtcccgggcactaccgtggacaacactttccgctcagcactatcttcgacgacggcgtggtcgaggggattcggaggcacggcctgcccatggagcaccccttcgttccggaccccgactgctacggctactactactccgccatcgacgatgacgatgtggcgcgccatgtcttcgtctccctgagggattttgtacggtgcaatcagccgtgccatctgatcgagtgcgcgtacaggatggatggccatggcaaagtcatcgagacctgggtccgccggtacctaaaggttgattttggtgaactaccattggca

SEQ ID NO: 2260 - protein, 980 aa, Setaria italica
  Si015074m
MASKRSKRVASLPDEIVSEILLLLPARSVLRCRAVCRRWAAELSSPGFMDAYAARAGARRTSKLELVVFAASPGHRSTAAYSCSGQGGAHAADPLFAVDHLRTDFLSLSSRPCRGLMLFSDTRTVGSYWVCNPSTGERRPLPLPPQHRGQLTLSSAGLVIDGRNMECKVVHLFYKVGSEWGLKCEVYTLGERSRRWRRVTVGLEWLRVNETKVTRALQTEEAVTRVPPVHADGCLYWLLYPCDMGDPPGQNRDGATAILRFSAADESFGFVDVPAGLPMEDYVSLEEHSPAVPVHLAELKGSLCMVHDLRHQGHGPSSLDVWVLRGRDAGGWSLDYRIPATPLMARDVHGPRFITVLGCIVTGKQEKLLVATSEHKVYAFATDTGRVETVFSIGETTGIGLQKEAAAALWIGLYEDSLVRIGGGASRREEEVLSAVAEILLRLPLKSIAQSMLVCRRWRAVIESESFVRRHAMSSMESAKKTLMVTSGRARRAFFNFTPMERWLDQASPAGLAAALANGKIICSKPCHGLNLISTSSDDYLCNPCTGDIKCLGIRGKSRFGPRCNDPQAAGRHAFTVGRQIGFGFDRSTGEHVAVEIGHLCGTLACMLKTSESDSWTCAGTPPMPVTDMPPAHVDGTLYWMAERTQEATASSSHQGLVIVAFDISARRFDTLRCDQPRLDDDHGAFLVELNNMLSLVATNRQVEEMVIWVMRGKRGAWVEAHRVCLRGQPSISPRTTVAVPLEISSGDGRILLSTGRTLGYYDTRTGALDTVYSLDHLQLAPYELAFPMLCQESLVRVPDDDELPVGRVAPPPVSSHNGRHGSCNDHPELVDVDDAGRTPRSIFYECQNAGCRGNGDVYSACCKRLICVECLRQCPGHYRGQHFPLSTIFDDGVVEGIRRHGLPMEHPFVPDPDCYGYYYSAIDDDDVARHVFVSLRDFVRCNQPCHLIECAYRMDGHGKVIETWVRRYLKVDFGELPLA

SEQ ID NO: 2261 - DNA, 1071 bp, Solanum lycopersicum
  Solyc04g080320.1.1
atggatgactgtgtggttcatttccctgaagatatacaaaaggatattctgttaagatgtccagtgaagtcattgttgcgtttcaaatgtgtaagcaagagctggtgtgctcttatcaaaaatcctaaattcgttcaacaacacttgaagaatcgtagccccccacaactcctcgcctatactgttggtacctcaaatgatgctgggcgaggtccccgctccataactttgatttctgaagaaaatccacaaacattcataggtatgacacatctcataggttctgtggatggtttatttttaatgtatagaataattgatactatgatttcatgtgcattgtggaatcctgctactagagaagtgagatccctccaaatcccactccccgcacccataatatttgatgcccctctgttggggttcgggttggaccccgtgactaatgactataaaattgtttactctcattgtggttattggcgtaaatatacggcagcagtctattcctgttctaggggttcatggagaatttttaaacctaaagaaccagtccccttctacacagacgtgaaacactcatttggtactgcttatttgaatggaagttactactggttgctaagagggggcgaccaacgtaattacaccattctttcgttcgaatttggaagtgagatgtttgaagaaatcgaagggccagatagaaacattgtatctacttttgcgttgggtttgatgttaattgatgattccattgccatgttgaactataccacatatactatgcttgcttatgatatttgggctttgatccaaccaggggtctggaacaaaattgtgacctttgaactcttcacaccaattaagacttgttatgatagctctctcattacagtcgttaatgattctcaactggtctcttataatgttcggactaacagtatgaggtatcttggatttcaacatccgggtttgagcagacatgcaatattgggtggttgtggggtttcttattataaggagagcttagtaacattcaaacaacaagagcatgaagatttggaccat

SEQ ID NO: 2262 - protein, 357 aa, Solanum lycopersicum
  Solyc04g080320.1.1
MDDCVVHFPEDIQKDILLRCPVKSLLRFKCVSKSWCALIKNPKFVQQHLKNRSPPQLLAYTVGTSNDAGRGPRSITLISEENPQTFIGMTHLIGSVDGLFLMYRIIDTMISCALWNPATREVRSLQIPLPAPIIFDAPLLGFGLDPVTNDYKIVYSHCGYWRKYTAAVYSCSRGSWRIFKPKEPVPFYTDVKHSFGTAYLNGSYYWLLRGGDQRNYTILSFEFGSEMFEEIEGPDRNIVSTFALGLMLIDDSIAMLNYTTYTMLAYDIWALIQPGVWNKIVTFELFTPIKTCYDSSLITVVNDSQLVSYNVRTNSMRYLGFQHPGLSRHAILGGCGVSYYKESLVTFKQQEHEDLDH

SEQ ID NO: 2263 - protein, 94 aa, Arabidopsis thaliana
  amino acids 51-144 of AT1G16150.1, GUB_WAK_bind domain
KECYLNPWYEVVCNTTTSVPFLSRINRELVNIYLPDPTEYYSNGVVHIKGPVTSSGCSTGTSQPLTPQPLNVAGQGSPYFLTDKNLLMAVGCNV

SEQ ID NO: 2264 - protein, 106 aa, Arabidopsis thaliana
  amino acids 174-279 of AT1G16150.1, Wall-associated kinase domain
NKICSGNKCCQTRIPEGQPQVIGVNIEIPENKNTTEGGCKVAFLTSNKYSSLNVTEPEEFHSDGYAVVELGWYFDTSDSRVLSPIGCMNVSDASQDGGYGSETICV

SEQ ID NO: 2265 - protein, 267 aa, Arabidopsis thaliana
  amino acids 442-708 of AT1G16150.1, Pkinase domain
FNTNRVLGQGGQGTVYKGMLVDGRIVAVKRSKAMDEDKVEEFINEVVVLAQINHRNIVKLLGCCLETEVPVLVYEFVPNGDLCKRLRDECDDYIMTWEVRLHIAIEIAGALSYLHSAASFPIYHRDIKTTNILLDEKYQVKVSDFGTSRSVTIDQTHLTTQVAGTFGYVDPEYFQSSKFTDKSDVYSFGVVLVELITGKNPSSRVQSEENRGFAAHFVAAVKENRFLDIVDERIKDECNLDQVMAVAKLAKRCLNRKGKKRPNMREV

SEQ ID NO: 2266 - protein, 48 aa, Arabidopsis thaliana
  amino acids 14-61 of AT1G57560.1, Myb domain 1
KGLWSPEEDEKLLNYITKHGHGCWSSVPKLAGLERCGKSCRLRWINYL

SEQ ID NO: 2267 - protein, 46 aa, Arabidopsis thaliana
  amino acids 67-112 of AT1G57560.1, Myb domain 2
RGAFSSEEQNLIVELHAVLGNRWSQIAARLPGRTDNEIKNLWNSCI

SEQ ID NO: 2268 - protein, 66 aa, Arabidopsis thaliana
  amino acids 6-71 of AT1G09030.1, CBFD_NFYB_HMF domain
RLLPIANVGRLMKQILPSNAKISKEAKQTVQECATEFISFVTCEASEKCHRENRKTVNGDDIWWAL

SEQ ID NO: 2269 - protein, 322 aa, Arabidopsis thaliana
  amino acids 32-353 of AT1G51800.1, Malectin_like domain
LDCGSPRETSFREKTTNITYISDANFINTGVGGSIKQGYRTQFQQQTWNLRSFPQGIRNCYTLNLTIGDEYLIRANFLHGGYDDKPSTQFELYLGPNLWSTVTTTNETEASIFEMIHILTTDRLQICLVKTGNATPFISALELRKLMNTTYLTRQGSLQTFIRADVGATVNQGYRYGIDVFDRVWTPYNFGNWSQISTNQSVNINNDYQPPEIAMVTASVPTDPDAAMNISLVGVERTVQFYVFMHFAEIQELKSNDTREFNIMYNNKHIYGPFRPLNFTTSSVFTPTEVVADANGQYIFSLQRTGNSTLPPLLNAMEIYSV

SEQ ID NO: 2270 - protein, 57 aa, Arabidopsis thaliana
  amino acids 412-468 of AT1G51800.1, LRR_8 domain
SLDLSTSGLTGEILEFISDLTSLEVLDLSNNSLTGSVPEFLANMETLKLINLSGNEL

SEQ ID NO: 2271 - protein, 247 aa, Arabidopsis thaliana
  amino acids of 609-855 of AT1G51800.1, PKc_like superfamily domain
PVAVKMLTESTALGYKQFKAEVELLLRVHHKDLTCLVGYCEEGDKMSLIYEFMANGDLKEHLSGKRGPSILTWEGRLRIAAESAQGLEYLHNGCKPQIVHRDIKTTNILLNEKFQAKLADFGLSRSFPLGTETHVSTIVAGTPGYLDPEYYRTNWLTEKSDVFSFGVVLLELVTNQPVIDMKREKSHIAEWVGLMLSRGDINSIVDPKLQGDFDPNTIWKVVETAMTCLNPSSSRRPTMTQVVMDLK

SEQ ID NO: 2272 - protein, 58 aa, Arabidopsis thaliana
  amino acids 191-248 of AT1G18860.1 WRKY domain
NDGCQWRKYGQKIAKGNPCPRAYYRCTIAASCPVRKQVQRCSEDMSILISTYEGTHNH

SEQ ID NO: 2273 - protein, 116 aa, Arabidopsis thaliana
  amino acids 24-139 of AT1G61440.1, B_lectin domain
PLSIGQTLSSSNGVYELGFFSFNNSQNQYVGIWFKGIIPRVVVWVANREKPVTDSAANLVISSSGSLLLINGKHDVVWSTGEISASKGSHAELSDYGNLMVKDNVTGRTLWESFEH

SEQ ID NO: 2274 - protein, 108 aa, Arabidopsis thaliana
  amino acids 198-305 of AT1G61440.1, S_locus_glycop domain
YRTGPWAKTRYTGIPQMDESYTSPFSLHQDVNGSGYFSYFERDYKLSRIMLTSEGSMKVLRYNGLDWKSSYEGPANSCDIYGVCGPFGFCVISDPPKCKCFKGFVPKS

SEQ ID NO: 2275 - protein, 86 aa, Arabidopsis thaliana
  amino acids 322-407 of AT1G61440.1, PAN_AP_plant domain
TELHCQGNSTGKDANVFHTVPNIKPPDFYEYANSVDAEGCYQSCLHNCSCLAFAYIPGIGCLMWSKDLMDTMQFSAGGEILSIRLA

SEQ ID NO: 2276 - protein, 263 aa, Arabidopsis thaliana
  amino acids 479-741 of AT1G61440.1, TyrKc domain
SLSNKLGHGGFGSVYKGKLQDGREIAVKRLSSSSEQGKQEFMNEIVLISKLQHRNLVRVLGCCVEGKEKLLIYEFMKNKSLDTFVFGSRKRLELDWPKRFDIIQGIVRGLLYLHRDSRLRVIHRDLKVSNILLDEKMNPKISDFGLARLFQGSQYQDKTRRVVGTLGYMSPEYAWTGVFSEKSDIYSFGVLLLEIISGEKISRFSYGEEGKALLAYVWECWCETRGVNLLDQALDDSSHPAEVGRCVQIGLLCVQHQPADRPN

SEQ ID NO: 2277 - protein, 100 aa, Arabidopsis thaliana
  amino acids 34-133 of AT1G07900.1, DUF260 domain
CAACKILRRRCAERCVLAPYFPPTDPAKFTIAHRVFGASNIIKFLQELPESQRTDAVNSMVYEAEARIRDPVYGCAGAIYHLQRQVSELQAQLAKAQVEM

SEQ ID NO: 2278 - protein, 46 aa, Arabidopsis thaliana
  amino acids 16-61 of AT1G74080.1, SANT domain
AWTQEEDQKLIAYVQRHGEGGWRTLPDKAGLKRCGKSCRLRWANYL

SEQ ID NO: 2279 - protein, 44 aa, Arabidopsis thaliana
  amino acids 69-112 of AT1G74080.1, SANT domain
EFSQDEEDSIINLHAIHGNKWSAIARKIPRRTDNEIKNHWNTHI

SEQ ID NO: 2280 - protein, 193 aa, Arabidopsis thaliana
  amino acids 102-294 of AT2G43260.1, F_box_assoc_1 domain
TCQGVICFPEQDWIIVLNPSTSQLRRFPSGLNHNCRFRIGLWKTFSPGNWVMGFGRDKVNGRYKVVRMSFAFWRVRQEEPVVECGVLDVDTGEWRKLSPPPYVVNVGSKSVCVNGSIYWLHIQTVYRILALDLHKEEFHKVPVPPTQITVDTQMVNLEDRLVLAITRVSPEWILEVWGMDTYKEKWSKTYSIS

SEQ ID NO: 2281 - protein, 93 aa, Arabidopsis thaliana
  amino acids 44-136 of AT2G26150.1, HSF_DNA-bind domain
PFLTKTYEMVEDPATDTVVSWSNGRNSFVVWDSHKFSTTLLPRYFKHSNFSSFIRQLNTYGFRKIDPDRWEFANEGFLAGQKHLLKNIKRRRN

SEQ ID NO: 2282 - protein, 192 aa, Arabidopsis thaliana
  amino acids 48-239 of AT2G46510.1, bHLH-MYC_N domain
LNKKLSSLVDWPNSENFSWNYAIFWQQTMSRSGQQVLGWGDGCCREPNEEEESKVVRSYNFNNMGAEEETWQDMRKRVLQKLHRLFGGSDEDNYALSLEKVTATEIFFLASMYFFFNHGEGGPGRCYSSGKHVWLSDAVNSESDYCFRSFMAKSAGIRTIVMVPTDAGVLELGSVWSLPENIGLVKSVQALF

SEQ ID NO: 2283 - protein, 52 aa, Arabidopsis thaliana
  amino acids 394-445 of AT2G46510.1, HLH domain
LNHVEAERQRREKLNQRFYALRSVVPNISKMDKASLLGDAISYIKELQEKVK

SEQ ID NO: 2284 - protein, 327 aa, Arabidopsis thaliana
  amino acids 33-359 of AT2G19190.1, Malectin_like domain
IDCGIPDDSSYNDETTGIKYVSDSAFVDSGTTKRIAAQFQSSGFDRHLLNVRSFPQSKRSCYDVPTPRGKGFKYLIRTRFMYGNYDDLGRVPEFDLYLGVNFWDSVKLDDATTILNKEIITIPLLDNVQVCVVDKNAGTPFLSVLEIRLLLNTTYETPYDALTLLRRLDYSKTGKLPSRYKDDIYDRIWTPRIVSSEYKILNTSLTVDQFLNNGYQPASTVMSTAETARNESLYLTLSFRPPDPNAKFYVYMHFAEIEVLKSNQTREFSIWLNEDVISPSFKLRYLLTDTFVTPDPVSGITINFSLLQPPGEFVLPPIINALEVYQV

SEQ ID NO: 2285 - protein, 60 aa, Arabidopsis thaliana
  amino acids 415-474 of AT2G19190.1, LRR_8 domain
RVVSLNISFSELRGQIDPAFSNLTSIRKLDLSGNTLTGEIPAFLANLPNLTELNVEGNKL

SEQ ID NO: 2286 - protein, 187 aa, Arabidopsis thaliana
  amino acids 580-766 of AT2G19190.1, PKc domain
IGKGGFGKVYHGVINGEQVAVKVLSEESAQGYKEFRAEVDLLMRVHHTNLTSLVGYCNEINHMVLIYEYMANENLGDYLAGKRSFILSWEERLKISLDAAQGLEYLHNGCKPPIVHRDVKPTNILLNEKLQAKMADFGLSRSFSVEGSGQISTVVAGSIGYLDPEYYSTRQMNEKSDVYSLGVVLLE

SEQ ID NO: 2287 - protein, 26 aa, Arabidopsis thaliana
  amino acids 47-72 of AT2G37430.1
FECKTCNKRFSSFQALGGHRASHKKP

SEQ ID NO: 2288 - protein, 26 aa, Arabidopsis thaliana
  amino acids 93-118 of AT2G37430.1
FHKCSICSQSFGTGQALGGHMRRHRS

SEQ ID NO: 2289 - protein, 51 aa, Arabidopsis thaliana
  amino acids 191-240 of AT2G24570.1, Plant_zn_clust domain
RKRCFEHDHSEGFSGKISGSGNGKCHCKKSRKNRMKRTVRVPAVSAKIADI

SEQ ID NO: 2290 - protein, 59 aa, Arabidopsis thaliana
  amino acids 242-300 of AT2G24570.1, WRKY domain
PPDEYSWRKYGQKPIKGSPHPRGYYKCSTFRGCPARKHVERALDDSTMLIVTYEGEHRH

SEQ ID NO: 2291 - protein, 67 aa, Arabidopsis thaliana
  amino acids 63-129 of AT2G34450.2, HMGB-UBF_HMG-box domain
PKKPATAFFFFLDDFRKQYQEENPDVKSMREVIGKTCGEKWKTMTYEEKVKYYDIATEKREEFHRAM

SEQ ID NO: 2292 - protein, 47 aa, Arabidopsis thaliana
  amino acids 125-171 of AT3G05200.1, zf-C3HC4_2 domain
ELECAICLNEFEDDETLRLLPKCDHVFHPHCIDAWLEAHVTCPVCRA

SEQ ID NO: 2293 - protein, 46 aa, Arabidopsis thaliana
  amino acids 16-61 of AT3G23250.1, SANT domain
PWTPEEDQILVSFILNHGHSNWRALPKQAGLLRCGKSCRLRWMNYL

SEQ ID NO: 2294 - protein, 44 aa, Arabidopsis thaliana
  amino acids 69-112 of AT3G23250.1, SANT domain
NFTKEEEDAIISLHQILGNRWSAIAAKLPGRTDNEIKNVWHTHL

SEQ ID NO: 2295 - protein, 127 aa, Arabidopsis thaliana
  amino acids 14-140 of AT3G15500.1, NAM domain
LPPGFRFYPTDEELMVEYLCRKAAGHDFSLQLIAEIDLYKFDPWVLPSKALFGEKEWYFFSPRDRKYPNGSRPNRVAGSGYWKATGTDKVISTEGRRVGIKKALVFYIGKAPKGTKTNWIMHEYRLI

SEQ ID NO: 2296 - protein, 57 aa, Arabidopsis thaliana
  amino acids 298-354 of AT4G22070.1, WRKY domain
DGCQWRKYGQKMAKGNPCPRAYYRCTMAGGCPVRKQVQRCAEDRSILITTYEGNHNH

SEQ ID NO: 2297 - protein, 108 aa, Arabidopsis thaliana
  amino acids 23-130 of AT4G11470.1, Stress-antifung domain
AQKCGESVFFRPNGNYDTNRRLVLSTLASNVSSQNNRFYNVSVGEGAGRIYALGLCIPGSDPRVCSDCIQLASQGLLQTCPNQTDSFYWTGDNADKTLCFVRYSNNSF

SEQ ID NO: 2298 - protein, 57 aa, Arabidopsis thaliana
  amino acids 189-245 of AT4G11470.1, Stress-antifung domain
SPDLIYALMQCIPGISSEDCETCLGKCVDDYQSCCNGFIGGVVNKPVCYFRWDGYKY

SEQ ID NO: 2299 - protein, 270 aa, Arabidopsis thaliana
  amino acids 342-611 of AT4G11470.1, TyrKc domain
NNKLGQGGFGEVYKGMLPNETEIAVKRLSSNSGQGTQEFKNEVVIVAKLQHKNLVRLLGFCIERDEQILVYEFVSNKSLDYFLFDPKMKSQLDWKRRYNIIGGVTRGLLYLHQDSRLTIIHRDIKASNILLDADMNPKIADFGMARNFRVDQTEDQTGRVVGTFGYMPPEYVTHGQFSTKSDVYSFGVLILEIVCGKKNSSFFQMDDSGGNLVTHVWRLWNNDSPLDLIDPAIKESYDNDEVIRCIHIGILCVQETPADRPEMSTIFQML

SEQ ID NO: 2300 - protein, 104 aa, Arabidopsis thaliana
  amino acids 23-126 of AT4G11480.1, Stress-antifung domain
AQKCVDSMFFRPNGTYDTNRHLILSNLASNVSSRDGYYNGSVGEGPDRIYALGLCIPGTDPKVCDDCMQIASTGILQNCPNQTDSYDWRSQKTLCFVRYSNSSF

SEQ ID NO: 2301 - protein, 95 aa, Arabidopsis thaliana
  amino acids 142-236 of AT4G11480.1, Stress-antifung domain
NSGLFQGDLAAYTRTWEEFMNSMITRVGRTRYLADISPRIGSARIYALMQCIRGISSMECETCIRDNVRMYQSCCNGFIGGTIRKPVCFFRWDGS

SEQ ID NO: 2302 - protein, 278 aa, Arabidopsis thaliana
  amino acids 325-602 of AT4G11480.1, PKc_like superfamily domain
NKLGKGGFGEVYKGMLPNETEVAVKRLSSNSGQGTQEFKNEVVIVAKLQHKNLVRLLGFCLERDEQILVYEFVPNKSLNYFLFGNKQKHLLDPTKKSQLDWKRRYNIIGGITRGLLYLHQDSRLTIIHRDIKASNILLDADMNPKIADFGMARNFRVDQTEDNTRRVVGTFGYMPPEYVTHGQFSTKSDVYSFGVLILEIVCGKKNSSFYKIDDSGGNLVTHVWRLWNNDSPLDLIDPAIEESCDNDKVIRCIHIGLLCVQETPVDRPEMSTIFQMLT

SEQ ID NO: 2303 - protein, 31 aa, Arabidopsis thaliana
  amino acids 4-34 of AT4G20380.1, zf-LSD1 superfamily domain
QLVCHGCRNLLMYPRGASNVRCALCNTINMV

SEQ ID NO: 2304 - protein, 31 aa, Arabidopsis thaliana
  amino acids 45-75 of AT4G20380.1, zf-LSD1 superfamily domain
HIICGGCRTMLMYTRGASSVRCSCCQTTNLV

SEQ ID NO: 2305 - protein, 25 aa, Arabidopsis thaliana
  amino acids 95-119 of AT4G20380.1, zf-LSD1 domain
CGHCRTTLMYPYGASSVKCAVCQFV

SEQ ID NO: 2306 - protein, 81 aa, Arabidopsis thaliana
  amino acids 61-141 of AT5G54900.1, RNA recognition motif 1
SLWIGDLQQWMDENYIMSVFAQSGEATSAKVIRNKLTGQSEGYGFIEFVSHSVAERVLQTYNGAPMPSTEQTFRLNWAQAG

SEQ ID NO: 2307 - protein, 80 aa, Arabidopsis thaliana
  amino acids 153-232 of AT5G54900.1, RNA recognition motif 2
DHTIFVGDLAPEVTDYMLSDTFKNVYGSVKGAKVVLDRTTGRSKGYGFVRFADENEQMRAMTEMNGQYCSTRPMRIGPAA

SEQ ID NO: 2308 - protein, 73 aa, Arabidopsis thaliana
  amino acids 260-332 of AT5G54900.1, RNA recognition motif 3
TTIFVGGLDANVTDDELKSIFGQFGELLHVKIPPGKRCGFVQYANKASAEHALSVLNGTQLGGQSIRLSWGRS

SEQ ID NO: 2309 - protein, 233 aa, Arabidopsis thaliana
  amino acids 25-257 of AT5G06740.1, lectin domain
LKFDFPGFNVSNELELIRDNSYIVFGAIQVTPDVTGGPGGTIANQAGRALYKKPFRLWSKHKSATFNTTFVINISNKTDPGGEGLAFVLTPEETAPQNSSGMWLGMVNERTNRNNESRIVSVEFDTRKSHSDDLDGNHVALNVNNINSVVQESLSGRGIKIDSGLDLTAHVRYDGKNLSVYVSRNLDVFEQRNLVFSRAIDLSAYLPETVYVGFTASTSNFTELNCVRSWSFE

SEQ ID NO: 2310 - protein, 272 aa, Arabidopsis thaliana
  amino acids 335-606 of AT5G06740.1, Protein tyrosine kinase domain
KLGQGGFGMVFKGKWQGRDIAVKRVSEKSHQGKQEFIAEITTIGNLNHRNLVKLLGWCYERKEYLLVYEYMPNGSLDKYLFLEDKSRSNLTWETRKNIITGLSQALEYLHNGCEKRILHRDIKASNVMLDSDFNAKLGDFGLARMIQQSEMTHHSTKEIAGTPGYMAPETFLNGRATVETDVYAFGVLMLEVVSGKKPSYVLVKDNQNNYNNSIVNWLWELYRNGTITDAADPGMGNLFDKEEMKSVLLLGLACCHPNPNQRPSMKTVLKVL

SEQ ID NO: 2311 - protein, 35 aa, Arabidopsis thaliana
  amino acids 28-62 of AT5G26930.1, GATA zinc finger domain
CSECKTTKTPMWRGGPTGPKSLCNACGIRHRKQRR

SEQ ID NO: 2312 - protein, 282 aa, Arabidopsis thaliana
  amino acids 77-358 of AT5G14640.1, Protein kinase domain
ERIVGQGSFGIVFQAKCLETGETVAIKKVLQDKRYKNRELQTMRLLDHPNVVSLKHCFFSTTEKDELYLNLVLEYVPETVYRVSKHYSRANQRMPIIYVKLYTYQICRALAYIHGGVGVCHRDIKPQNLLVNPHTHQVKLCDFGSAKVLVKGEPNISYICSRYYRAPELIFGATEYTTTIDIWSAGCVLAELLLGQPLFPGESGVDQLVEIIKVLGTPTREEIKCMNPNYTEFKFPQIKAHPWHKIFHKRTPPEAVDLVSRLLQYSPNLRSTAMEAIVHPFF

SEQ ID NO: 2313 - DNA, 3000 bp, Arabidopsis thaliana
  AT2G39850 chr2:16627473-16630472 FORWARD (source_file=TAIR9_upstream_3000_20090619)
actcggcggttctcgatgatataatcaggcgactcacggaggtccggttagctagaccaggaaagcaagtccagctctctgaagctgagatcaaacagctctgtactacagctagagatattttccttcagcaacccaatttacttgagcttgaggctcccatcaaaatctgtggtatcttcccaatttgattcgttgattttaataatttcgtcggaattgattttagggttcttattgtgtttcttagattttccaaaagtgtgaacttggttaggttttggggataaagttgttagaccattgtgagacctttttgtttgatgttgtgaagtgactagaatctgagtgagaaatgttttggctttttgtggataatgattgagtggagaggcttatcttgttgcttatgatactgtgtgtgttcatgaaaaatcctatcccgttctgtgatttccttatggtttgtggtgtacatgtcttaaaccaggtgacatacatgggcaatatagtgatttgttgaggctatttgagtatggtggcttccctcctagtgccaattatctatttcttggggactatgtggacagaggcaaacagagtcttgaaacaatatgtctcttactagcttacaagatcaaataccctggcaacttttttctactaaggggaaaccacgaatgtgcttctatcaataggatatatggattttatgatgagtgtaaaaggaggttcaatgtgagagtatggaaggtttttactgattgttttaactgccttcctgttgcggcgcttatagatgacaaaatattgtgtatgcacggtggactttcgccggatcttgaccatttggatgagattagaaacttgccgagaccaactatgattccggataccgggcttctctgtgatttgctctggtctgatcctgggaaagatgttaaaggatggggaatgaatgatagaggtgtttcatacacctttggtccagataaagtttccgagtttcttacgaaacatgatttagatcttgtgtgtcgtgcccatcaggtagatatttttcaatcatgtctctttgatactactgcttttgtgatgttaacaagggagttggattttttatggcaggtcgtggaggatgggtatgagttctttgctgatagacaacttgtgacggtgttttcagctcctaactactgtggtgaatttgataatgctggtgcgatgatgagcgtggacgagaaccttatgtgctcgtttcagattttgaagcccgctgagaagaagaccaagttcatgatgtccacaaagatttgatactttcattgaggttagtcaatagtctgtccttggcggaaaccaaaacgaaactagtgaatgaaaggattctcttgcactgatttgttcatgttattcattacaaagtcaagttcacatttctgttgaacatgatttcttttggattcttccaggctaaactttttacttaaatgggtcttgatttcggcttttccttctttcacagatggatttggtctttcttgagaaattgattgaaaccattgaagatttggctgtgaagtgtgtacttatggtagtgagaactcttggaaaggagcaagaccttcttagtcttctaatctctttcttcccccaaattcactttcagcattttttttctatcttcttttatgggttttacatgattttcatctgcctgttgggatcacatagttggtgtgtacatgcatatggtcgtttcttggattttaggacaccaaatgaaaatgatgttataaaaaaggtttagtatgatgagtttcgtctcttaagcggcatgtgaaagtgaatgagacataagtaacgcatatgaacatcttcaattaaccatcataaatatcgaatgagcatctaaattggacaacaagtttcacacatgttcatcatgtttaagtaaaagaagaatttgagaagctattgaaagtaaagtccactggttttggtatgatcgtgagtgaagtgatatatgatccgtttggtggactcgggaaatagaatagaatataataattggagggactgaaattttatgttgttctttgttgtggatgagaagtaaacacggaagcgataagttcgtaaaagtaactttttttttgggttgcaaacgggaaccaaaaccacatgtatccaattctttagacacatatcatgtcattatcctatctttgaatatgttcatattcttagtccatttcctcaccagaagatgttggacaaaacgtatcctttgatcatagtatcctcaaacatttcctacatagtattgtgaccatgtcatattcttctagacttcctagttcctacatagattatgaccatttcatactattctcaaaactcaaacaaacaaaaaaatcaattttgaaatataattatttctaattttcatatttttgtaaattgaatacacaagcgttcgtcgtatacgaccattgttttcagcgtgtaagtttagcaaaaaaaaaatcttaaaacttgtggttcatttggaaaagtaagaaaatatacacgaacgtaataaacacaaacaaacaattgaaacatgaatgtacaggtttagtgttattatctgaccacattgtgcgcgagtgtggaccatgtggacgttataagtttcatcaaaccaagcatacatatatatgtgcgtcaacgtagaccctcaagttttcttgattttcactcgaatcaataccgtatactcatgttttatcgtaacatagaaaaaaaaaaaatcatggactttctcaagaatcaccaaaaaaagcatgcagcttcataatcgaagaataagattctttaaattgattgatgagcgtctgcactatgaaatgtttcgatttcaatcttctcctccaattttcttcttcattagtcctttttcgctcccaatatccttcatgaaatttctctataaatagagacataaagcattaacat

SEQ ID NO: 2314 - DNA, 3000 bp, Arabidopsis thaliana
  AT2G03500 chr2:1056710-1059709 FORWARD (source_file=TAIR9_upstream_3000_20090619)
agaaatcctgtttatatcccctataatactaatctgactttaactgaaccaggtcggttcagtctgcaaagtttttgacactacaacatctctatttgttattgagatcaccattgattttgtaagaaaggagatatataattccactcttatttcgaatcatagtttagaggtcgtgatgacaaggatgttcaaataattgttatttctgaatttatagaaagtaactaaaaatttcaaatttttggttaattaacaagagttaaagagaataaggtacaatgatatttgtacttaagaaaatattagcatatagaataatacaccatcacttgaattgaaagaactttgaggaaaatatgaaatatatatgaattggatatccaaaattttaggatatgcatgtcggagggtctgtccgaaaatttgatgtgtggcattagatgccaattggttgcttgaaactatatattataaaaaaaattataaaagaaaagacaagagtaacaaacttttaaaatgcgatatcatacaaaataagtgagttcattacttatacagtgatgaaaaactgattttatttgataagattttaaaattaacttgatctttttcatcataattttctcagaattaatatacacatgtaacacagagttacagatattgacctcactggaacaactaatagtagaatattagaaataagaaacattttttgtaggatcactcttactggagtataatttattgattgaatgcgatgttccgattaattttagaaatttaattggtcaatggtataattgatagtaattagaatatatatatttatttcagcttttttatctatacgtctagactataatatcgttgcaagcaggttctaacgtcatgtgtagatcctttaagcagttcttgtagcatcacttgcattttcacgatcacgtagccttattgcttagttcaatttttattttctttgactgtgcctttagaaaggtctgagggtgatcctacaaaaaactagataactcgatatataagaccacatgtcagaaacttggaagggtttagtgattagacgactaaaacatcataagctatccaattaggaaaattaagtactaataagaggacgagattctcacatctcaaatacactttacatatgtaaagcttatttttgcttcattagtttttagagattaatgttctagaaatgttattatatgaaagcatagagcaactaaacaattacaacttctaaatgctctcttatttgccttgaatataaatttgattgggtagaaaaaatcttgtatcatcaaatcaaattgatatatccgccccgaatttgttttaatatgcatatatctaataattaatttgtattacatatgtgcatcaaatattaaacagaagcattttagagaattaattttatcaggtccacaattagttcatcggttttcaatgaaacctagatacgaaaagaaattttgataagactttgaattgcaaaaactctttaaaaaagtttaaaatatttctaagtaagaagaatcttctaccttcctggccacttcactaaagtccggtgggaagattctgcgactctcaaacttctgtcaatattatttacttaagtgaatatctgtcctagtttatggtaataaattaaatcagatattccctttctttctcttttttgcatccactaaaatttagaataattattcaacttttttaagaaattcaatttacaaaaaaatattgatcaatcgttatctctgtctctctctctcgccgtcgtgcaactataaatataaaaatcttgtggcctaatatgtgcttctttgatttatattgaatctcaattccttttgaaaatttaaaataattaactatataaattaagaaggtggtagaagaatatttgtttttctggcaacgactataaatttcccaaaatgtactaaaacgttcacaatttattcctttcacataattgcgttggtgattccataattttattttaactttgtcgaatatataagataattaagaaccaaatacctgaaatgttagcttagatctatttttcagtcaacatgagctaagatttataggagaattaggaaacatattttatcttaagaattatgagactgaatttacgaaagtataagctatgtgaagtggtgaaccaacaaaagcagaatctgagattaaaaacaatatatcgctttattagaaataatttaaaagtttgtattcttacccatttgttctttataacaagtttccatatattcccttttgctctgctgctttatatcttcctcttttctcctttagcctctcttttctctttctttcatatggaattatacatagattaattttctgaagaagtgattaaaaactaagcattataagagaagataaaaaaacaaatcaaatggttactaatttaatgattttactaatatttaccaagccatagttttttatatattaactattttgtttaagattcatgaagccatatatggtagcatcaaaagccttgattataagctttttgagaaatgagagtcacacatgatacacctttagtaatattgactcattagaaaataaaaataatttatctttgttatattttctcaaattttgctcaaacacaagcagcacttgatgtaaaacagtttttttccgaataattttacataatattaaaaaaaataaaaaaatattgactcattagagaagaggaacgacttctaacagtaagaagcctctcactctctctctctaaaaaatacacctccttagtctctccctctctcgatagatatatgtgtgtgtgtgtgtgtggtgacagatcacattattccgttcctttgaattgagccctctaaaaaggacaggaacctccttgtgatcctccttgtgtccacaacctaacattttattccccttttcctctatctt

SEQ ID NO: 2315 - DNA, 3000 bp, Arabidopsis thaliana
  AT3G42670 chr3:14760086-14763085 REVERSE (source_file=TAIR9_upstream_3000_20090619)
cttcttctttcacaagcctgcaaacacagcttaaggaagctaactgcaaaatgaaggaacaagaaactttacaagcagagcgtgaagaagaggctttgcaaattgcagctgagcacttgatgatcgtgaagtacttgagcgcaaccgacccaaacattctcgccttcctcgagtctcaatctattgatcccgctactgctgatgtccaaacataggtaccttttccatccttctctgaatttgaaaacgtgtgttggtttgaataagaatttttgttttgttttgaacatataggttgtttggttttgaattgaacaagaatgtgtggtttgttggatctgttttaaatacacatttcttatgtgttaacaagtctgttgataataaattagaattataatcaatttatcaagaattaattgaaggctaaatcaagaattaaacctctaatcaatcacaaagtagtagcaattcaatcaccaaaacgttcacaaaacaattgtgatgttgtggcaaagatgtcgcataacagtcgctatacttagcgacgacattgcgactaaatagtgaccacttaaatcggttgcacattagtttgttatgcgagtgattattttaacactcgttgtttaggaaatacgtgttttagtcgcaaataagtcgcaagtaggggttttgcgactgattagtgacttcttatgttgtcgccaattagctgtttttttgtcctaccaacaaaaaaaattagttgttttcttgatctagagacttgatcgtagaattcgatggtagtgaggaatgttggtgagatgagagagagagagagagagagagagagagagagagagagagagagagagagagagagagagagagattgttggatagcatgacaaaatttataaatcaatgataatagcatgttttgtccttgaaatacatgcgtttataaaatcatatataatcttatatgtcacactgacgagtgatggagaaaatccggtgagaggagaaacacaaaatatacgagggataagaaagatagcttctaggaagaaagaaagagagaattgatggaatcacatatccaacgagaggaagataggaaaaaaggaatgtggtggtgatgagattcagtaaaagaaaaagatatctagagagagaatgactataatgttgcagacaaacaagaaaaaaaaagaagaagataataaaaggataagatgaaccaaaaacccttaaaaaaacatatagcaaatagtgtccatttagtcaaaggttatttcgttgattcttttcgagtcttaggttagtttctatatattctctaaattttataattttcttttcgattctagtgagagctgttgctaaagctaaaaagagaaaaagatatttaagtaaagttttctattaaacattatatattttactatccatatcaaatcatggaacattcatagccacccaaaacattttgagtgccaccagcaaaaaaggcctaatcatatcaaaaaaaaaacatttttgtaagtgtaagagttgaacctactacctattgttctatcacccaacgattaaccagtatagttataagagatatttggaaaatagatgacggttaattaataactatatcttataccgtaaacacatgcttccctagcttgtgactaaggcagattctggtaacaactcatattttatgcataagataaagctcacatagaccttgttcaaaagcattacatatccaacgatttacaataactctatcatttacatttccaaatgttatatattttagtgtttgtttgatttaatggaaaaaaaaacagttttgcattaactttgtaagggatacaacaattaaaaaaagagtcagaaataaaatagaaaaataatataaacaaaaatagagaaatctactaaagaaaactagatatttgatcttccaacatattaaacagaaaaataaaaaactaaagagaaaaaaaattagaaatggagtaaagaaaatacagcaattcaccgttacccttaactactttttaaaatattaaatgatattttcttttagaatcttgaaataaaaataaaagtttcttttttgatatcaaaaccatattaaaaactcatcttttactaattttagtataataattaaaaaacaaactaagtaaatgtttttgttttgtgcaaactaaatgttaagttcatgaatttgtgtaagatattttccctataaacctatctcaatgtggacccaataggccaccatgcacacaacttggcttttactctttgtgtcagtaaaatctaaagatagtaaagacagaccaaatcgcagccgtttatttcccatataaagaagtacgtacatggaaatgacaataataccctcactccttaaaccctcctcttctctcactttatttttcagtctctctttatttctctctatcactttttatcgattctgcgcaaattcatgcaaaaagggaaaataaaaagttctacactgtccccaagattctgcgtgagtgtggtattgaattcttcgccgtcccttttctatttatcatattttgttccttctcttattttcctcttagtgtcaatcatggactagaatcaactctctttttccctcaaaggtgatatattgattttgtgttctgatcataaagttgtggttttttcaatctgggttttgtttgttgttgatgacgatcatgtttcgtttttcattttgatacgacactgttactctgttttacacctttttagtacaataatgttgctttcgcacattaaccaatatgatcaagttttaaagttcatatatcatatatgttctgggttgtctctagttgcagataaagtttgaatcttttttttatttgtcaagtggtgaatgaatcctaatgaagctatacatgtattggttacaggagatcatatgtggatccacaagtgatcttgaagggaaagaaaaaa

SEQ ID NO: 2316 - DNA, 3000 bp, Arabidopsis thaliana
  AT1G24735 chr1:8754977-8757976 FORWARD (source_file=TAIR9_upstream_3000_20090619)
cttcttggaaaagaagcttccagcaaaatggctcgtcgtgatcctgacccgtatccttaaataaaagagccaacttataaaatctctctgcttgagtattgcatcatgattcaaatccttatatgatgcatcattgaatggtatcttcagaattgcaaaatccaaatccaagaatagcaatttccttgacattgctctagaatctatgaccgtgaatgggaagacgacaagaggagagcagagcggaagcggagagatcggaagtagagagtgatgatttgcagatcctttggtttgttcaacgaagagagagacaaatactggtattgaacactgcttatgttgtacacgtactattcaatgaccgtgcgggtctactttgtcatttggctccgccgagtttgataaatgacttgccagacttcagatatattcatagcaattgacttattcgaaatttttttcagatgatttatgactgagcttgtaaactgtagctagccagggaaattgatagtgtaacaaatatcgaattttgtttggggattttctatgtgagaaaaaaaagcatctgaagacaataataacaaatggttcatcaaattatatagctttgacctgccccggttttattaatcatgtcactttgctcagctaaacactgaaatagttacaacttttggtttgcaatggggatatgtggagttgtaatgttgattatgcccattgatttccattaacttcggcgaaatcaagagtaatatgtctttagttaaagtcacgcttttggtatataagctgatggcaaataattccttatgctgtaattttcctcggttgttatcagtgtgctaaggtagttatcttatccaaacctatggcttaatctcatcacaatccaatgatgtaaaggtagactaatgcagattgattctgttcttcttgtggaatagtcatgagtcagatttctgaattcttttaatgatttcaacttattgaattagtcagagaataatgtgaccatacaatctgtttgtttcaagttaaactaagcaagaaataatcatcaattacaagttttaattcccaaaattatcagttattcctattttcttaacaccttgttgcctgtgataatccaaaatcaagctcattattttgggtcattaatttattttttatgaaaccataagaaaatagtcacgaaaacaaaaacaatagagcaaaaaagggttttcaaagaaataagtactctttcagttcaggtctccaatttttttcagcatattgaaatctcaggagaacgaaagttttgacatcataagagcttaccccagataaaaaagacaccataatttgtaaaaacaaaaagaaaagagatgatgaaattgcctcagctcagttcaggtctccataatttctccgcatgataaaatctcggaagaacgaaagttatgatttgatcatcatcggaggcaatttctacacaaattgaaaaacatcgctagatttgaaagaattttatcaaaacccaaaacaacgataatagaatcaatacgcgtgaaaaaatcaataaagagagaacagaagtatcaaaacgactaaaagtgattggtaatgtgataatttcatcactgcgtcatttatatggctctggaagagggaggctgagctggggcgagtaaaccctagctctatctttgagtaaatgggcttttaatgggcctttgttattgggtctttcaaaatcagtccataatatttctttgtagattctttatttcttttactttttaaacaacttaattagaagtatgcatttaggatttttattattattatcgaaaatcatattatactcaaacgatatcaaagattattacacgttctaccatcttagagattacaacaatacgattaaaagcatgtagggatgcaacataagaaaaacaaaaatagaccgacgatgaatccatgagatttcggagacaaatattgagaaaacataacacgagaaagcactaaaatacactatttttttcctcttaatttgatgacattggtttgtgaatgataatggatcggagcacaggagaatccaaaaccagagtttgattttgcatttgttgatgctgataaaccaaactatgccaacatgcacgagagactaatgaagctggtgaaggtaggtaggaggaatcatagcgtttgataacactttgtggtacgggtttgtggcggagaaagaggaaacgtgccagagcacatgagggtgaacagaaaagtctttttggagttgaacaagcggctagctgctgatcatcgcatcgaggtctctctagtctccgtaggtgatggtgtcactctatgcagacgccttgtatgattaagagactcatcaaaatattaaatgtttctttagttttgtttggtttgggatttgaattgtcgaatgcttgttgcgatacctttatttttttctcaagttctgctccaaccatgccatatatatgtcacgctagcaactgtcatacagtccatattttcaatcaccgatttcaattttctagtgtaaatctcattatttgtttttggaaaattagtggtgtatgaaaagacttcttattttaaaaggaaaaataataatttgattacctaaatcataaaaatacacttattttcataactcatcatgaaaaaactttacaattagagtttgagttgaagcggttgtagaaaatgtaatatactacaacgtcatgattcttaatatcatacgacacatttttttaatagtaaaccgatcgtcggcggtggtttaggcttccatcataaaaaaaaaaaaacgaaagatgtatacacttgtcgagctgttaatatcattactaggccactacttttacagattctctttaaaaagagtaatagagacatgtaagttcgtgtgttacaaagcttttaaagttgaaggcgtcgagagagagagagagagagagagct

SEQ ID NO: 2317 - DNA, 3000 bp, Arabidopsis thaliana
  AT5G56530 chr5:22886226-22889225 FORWARD (source_file=TAIR9_upstream_3000_20090619)
tgaatctcattttgggtgtgtatgaaattatgatgatgatgtgttcttgtcaaagatcaaacatcaaagtttgagttctcctgttgattacttcttggtggtcttcttcctgcaggttggagaattattctggaatccaaattcaagattttgtagtcatttttctaggaggaagtattcgtactgaaatgtaaaagtttaagaggattccgaatcttctgagctgtatcttacagtggaatcaactttcaaaatcttaagaggattcaatatttgtctctaattatataatcctttatttattttcattaatcaaggtgtttttaagaattttattgtgagtttcataattgaatcatgttgatagataacatatataatttgggccagcccgataaagaatggaaaaccccaaaagtaattttaccaaaaaaaaaaatcaaatttgggccagcaggccaggtctctgccaatggggtccaattagtatataccataatctaaaactagatgtgcattcttcagaagttctcatgcttacgaaaaccaaactcatgaaatgatgaaaacacataacaatatctagtataagattccacaatgacgaatcacgaaatattgataaattctcaaaagatccacaaaatctatctgatgtaagaagaacactgcatttatagatatggccagtcatgctacacagtttggactgactgttttttttttttttttttttactttcccttgaaatattattatattagaattactgttctcaggatccacttggacatttctccaaaatagtcatgtaaccgttgatttgggttaattaatcacttggttgtttagtgcacgcacgttataatcttttactagtaatcatacaaattaaaaaagtagaaaagacaagggtggtgattaacgaggatgatggccaaattagttaagacttctatttcttaaaaataataatcagaaagaaacatgaaaaaagctcatcttttctactacctaacctactcaaagctatctaaccaaacaagtattaagatgttaatcacatctcataaatcttattcttcatactattaattttctgttgacttttacaagagaaaatacagtatacatttttagcatttaaattgattaatgttttggttttaaactttgaaagataaataaaaagaattaaaattgcatattaccaagtaaaaaactctttcttgtgggaatctcataatgatgctctctgctacacacagtttgactgactcattggattccccaccgttcgttagatcctttcttccgtctttacctgaccttcttcattgggaacatagacgctccgcaccgtacacgtgtcatcgatcaaaatgaattaaacgccatcaaaactataaacggcaataccatttcacttgttaacggcgagcaaaccgaaacagaagaaggaaagaccaacagcttcatcgggagacagaatcttgtgtctgcttccccatcataatgctactattttacttactactactccattgattgaaactatttgtaaccaaactaaagacaaacattatcattacgaggcaaccaactctcgtatcaacaacaatatctctttgtaatttctcatataacaacaaaatatgattccatttttttgtaaatttgtaatctagtatcattttttaccactgcaaattaaatctgttggggtagaaaaatgtgttaaaaagaactttgattcttaacctagactcaataaaaacgatgatcattaatactccttttatgacccaaccacactattaatgatcaaataacttttacgtataagctgccttgaattatatttattgatttctttagtattttggaacatccatcttaactatagcctataggtgataaacaaaagctaagcattagtttttttttaataatctgagtagctaacaaaaagcaataagctattcgaccagtagtatgatgggtcaaaacccaaaacaatattttttacaaaagactcttctgaaaaagttgatactttttgcagagaactttgttcttgtttctttatcttatctttaatttaataacatcgttcgatacgatgtttcagaatttattcgtttcaagattataaatttaacagaaagaaacactgatttaaagaggaatatatgcttgaaaagtacgcaaaacatttaaattttgaaaacataatgtttctccatcgttagtaataaggtccactaaattaccaaaattgagtgatattattagtttgatgcaattaaatgcaaggaccatttcatataaaggggtaaatttggaatcttacgtattttggttagtcgctcttcggagcggaggctcgtgaattttttcacaagaagttgcatcggcattctcgccatgactcatgggctccactcgcatcttcttttagattatgttttttttgggtcagaatttggattttgttatttcaactatttagtaagtttaattataagaaaattatgttctaatgcatttttttagttaagttaagctattttcttccttaatgattcaaatgtatctaccaatttttgatgtattttgttcaaaaaaatatcgtagtattattatgaaataattcatctgaatacccattatctaaaaaaatcattattaatcaagccaaggctgacactttttttagaaaaaggggtttcgaataatcattttatgtagcaaaaaaattattttcaacataaataaaaaagttgatctttaattgtcttttaattacctagaaaaggtttatttagtgataattaaaagtagagagagaatatttgacaaataaaagagagagagagtgacaaaaagtggagacctttcatcatcaaaggagagacccacttcaaatgtcactgcagaatcactggtgttagtggtggtgggttacatagtaagagctctctgctactagtagaagaa

SEQ ID NO: 2318 - DNA, 3000 bp, Arabidopsis thaliana
  AT3G12750 chr3:4053202-4056201 REVERSE (source_file=TAIR9_upstream_3000_20090619)
acatatgtcagctaacatgggacaatccatcaatcaaatcgtaaaccagataaaagaatggcgactcaattttctccttacgttcatctttaagctcagaacgcataaatggcagcttttcctgcaacttcccgattgaatctacactgccatcagaaaattgggtcttagtactccacatcaaaagacccttgatcaggtcacaacataaaagaaaactggaaagacccttgatcatttcactcaccctaatgcctgtaatccactgataaattcttgcctggaaaactcacacgctgttgcagcattcatatgccacgaaagaaccaactgaaagaagatgagcaagaaaaccaacgagtttaactcagcatatgtagtttggtagcccaagacgaaagcaagaacacatggacaaagttgtaggaaaagtttgatattgaacataccgtgactatgtcttgcggttccacctgaagaaaaattcaagacagttgttattaatggaagataaaaccacatcattcttaaagcattatgcaatgatataaaatacctcaagatcattacacagaaccgagataccctccgcaagaatcatatcagaatacgggtctgcaagacgtaacatgtcaatactaaagcacaaggtacacacaaatgatcaactcaaaagagtaacaacaagaagcttgcctttatatctattgtagagctcctccaagcgtcttacttcagcagcattgcttcttggttgaggctggctgtaaaacacatcaaacgctgcttcaaggtgccaatcactggctttgagagcctgaagagcattcttctcactgcccacattatttaaacaaatcaaaccaaacacacaatttgagataaatatggacaaaaccaattctagtccctgttttggcctaataacaacaaatctagtgataaggcttgctctacggagatagatccagttacctagctcctgtgatagccacgaactgctgaagtttgtcacggttgcttctgctcaacttatgctacagaaaacaaaaccaatcatatgattaacaaagatgtcgacaatcactgaaatcgcaaaattaaggagccttgttcgttttctactcgacttaaaatgaaactctaagaatcagaaaagcaaagacgccataagaggatccgcaaacctaaagcagagggaaaaaaacaaaaggaggagaaggagaaagcgcgtaccatagtgaagaagaatccagaagccaaaatacaaaaccctaacaaggtaatcgaaggaagatgaaatggaagacgttcgatgtttactatctctctctctctgactcttaatcgcgaagcaaaaaggtgtgagaggagaggagtgactcagggaagactcgagagagtctctcacgattgcttcttcactttcctctctctccgcctctctctcttctatgcaaaatgtttttttcatttctacttttctttcttataaatgttgtttcagttatgcaaatactccggttcgccaaaccggtttgtttagtaaaatgtctccctatacaaaatggaccggaaatttagtccggtatactgttctgtctttaagctttggactagagttaatcagctgggatataaattgtaccttatagtttataaaatcctgatttgatagagaatttgatacattttaattcaattggagctagaatgtggtatgaattttttcgcgggaagaaaaaacggtaaacgatataaaattatcttgaaatggtaaaaaaaatagtagacaataatggtataaaatttaactatatcgtttttggtatcgctttgatatagttattatgattcgtaattattaaatcgttaaatcatatactgcagcgatataaaattaccaaccaaaaataaaaagtgaatgtcttacatataccagagattaattaggtacatatatgtttatatataatctattagatcaattttaggaattaaaaacaaaaaaaaagtgaaatgatagtcaagtgtgatcaaacttggattctttccaatttctttgcttatgaaaattcaaccattgttttctcaaacctctatatcttatttatagttcagagttttcgaaaacaagatataaaaggccaaaatcattaggttcaggtaaccatcacactcaagtggcgatggtgaaatctgaatttgaaacacgtggtttgattgggccagcattacccacccatcccaccttgagaggacgatgagaccatcttacgtttcttgaatccaaaagtagatttaacaaatcaaaccaaaaccactctcctcacggctcacatagtaacatgacgacattctgtcttcacattttactttctagtaaaaaagtcttcaaattttcaattcataatacacatatattttgcttttggtaaagtgaaaagatatgtactaacctaataattacaaggattagcattcacagctaatctcttttccaccctattctacgcccctaaagtttaagaccaataatgttccaaactcacttttagtctctatgatctttccctaatcatctatctttgaattgtcgtctttgttttattattgtttgtatatctcaaaaatgtataaatagataagtaatgattagaagagatcgaaagggcgtcttacttgaaccatccatagactacaatctaagatgcttgcagaatttcttatactaaccaatgaattctttcgcagcctttttccgtaaatgttccatcctattttatctagtcattgttaaagacttaatggtatacaataagagtaataacagaatttaattatttttttgtgtgcgacaaacaaagaaatgtgtatagtggtcaactctacgtaactagagattctgctactaacatttatggaccactcgcttcaaaagtgaggttctctctcgctttctctctataaaaagctcctctttcttcaccataactcttc

SEQ ID NO: 2319 - DNA, 3000 bp, Arabidopsis thaliana
  AT3G16340 chr3:5536897-5539896 FORWARD (source_file=TAIR9_upstream_3000_20090619)
tctagtgattgttaaaaatcgttatttacttacttatttaaatgtcacatagagagaaaagagatttgcatacttgtaataatataatcgtgcttgtataagaaaaaaaaaactttatgagacaagaaaaaaaaactcgggtgtacgtacgtcgtaagtaaaagggccaatgcaagcaagctgtttggctctttccttaaagcaaaataaaagaaaaagttatctttttctccttttatttcaacttttttctttaattttcttttccattttttatgcttaatttttcaactccgagatatgaaactctctactttgtgtttagtttgaactcttttagtcataaaacaacaaactctgccgcaatcaacaaaaagcgaaggagtcaaataaaaacttctttttacgagtgaaagtgactattttacttcaatctcttttgattttcaaaactaagaaaaaaaagaatggaaatcaaagttgtgcatgttcttcccttagtcgatatgtaaaagtgatttgatagacattattgtatgtaaaagtaatacaactctgaaaaattttaagaaaaattgctagtatcagctaatccaacaattagttatatgttttggagaatgtgtaacatgaccgattataaagctaacatcactttatttattgaatttataagtaatgcaattatttaaataggtcttctcgaagaacatctagatggtatacgcttttgtgaggtgagctcccttttatgtttgatttaatagaagaaatgtaatgtgtaatgacttgcttcaaatgatttgtatgttcctattggataagggcatcttgattttatttttattttttgtatctataatgtgcagtaaactttttacttttcattttagtatgatagctggagtttggttgtttcaaagataggcaagtattgtgtttaacaactaaaaataaaacaacacatatttttcaatagaattatttacaaattataaatctaaacacagggaaaatgttagatacaaaaacaaaaaaagtatcaaagacaagcagtgtatcagacatatataatatcatattttcaattcattagaaatacaacttgccatatcgcaaattagtccataatcaccaaggtagggaacgattgtctatcgataagttatgattgaaagaaaaggatttcatgaagaaaaaaaaacttaatttttcttccagaatcgtgacttagaatttttgttaacaccgacgaatttagataacaaaagctactccctcattgactaagccaagaaagttgagtagttgactaacaatgggactaatattttagcaaaatcaatacaattttggtaattattttggttcatgaaaatgttcaatttttttggtctgaattgtggaattcacgatttatttagcctttttgcggtatatataaaattaagatatttttatgtaacactttgttttataaaggataagcttgtatagtttatatataacggctagtcatgctcaaagcctttatcatctgtgggcttcacaatcttatttcttcgacccatttgcttcaagcctcaaaccaaaacttggctgagttcttcgaaagctcattatttcttatatagtaattcttttacatagtgttggaaaatgaagtaaaagaatatcgaaacttgaacgcttagatgacgaatctgtgacattatgatttcaagtatcgacgtgttttatcaaagtgaaaagttgttaatgttggtgttgggtccgtgaaagctcgaagccatggagattaatttcaaacacttttgacctttgagccttgcaagtttggtttatttgttcaacgccagacacgtttgcacagatatgagttggtgagtgcaaatcccatcataccaactaatataaagttataccatcaatgatattctatcgtgaaaaaatatgtaaagtctaatatcattaagtatcatttattaaaagaatgaattgaagggaaaaaaaaaaaaaaagataggcaatccactagtgttcataatgaaagatgatggtcgatgtaatatgtatactaatattatatctctagctttgatcctcaatagtcaatatctatagtgtttatagtgttttaacagcttttgtataatgttaactgtgcaaaatacatgacataaaataaatgattttttttggcttttatgttataagtactattagttggttatctgttttaaaggtttttccttgaattagaggatcagatttacatgcccataacagaaccaagctggtcaccaaatccatcttatgtagtggcataacagaaccaatcttggtcaccgaatacagtagtttcacctttctctttctccaaatataataaaaaacttttttattttgtgcaaaataaactttagtgagatatattgagcaaatatgtatatatatataaagatttcttgagacgatatctctttgcctctttgggtcattgttaattccatgtatcgatttttagggttgaagagacttgtttgtaactttgaccaattgtctactctttttagaccacaatgttagtaagtatgtaggtaggacttgtttcgaatgtgatgatttatttaggcccagacaaattatttactagacccattgttgttctattatttactgtttgaaagaagttgtttttgtcgttgattgtttactagtatttcaaagaaaagggtatgcatagtttaaacttcaaggaaatcccttatatatagtaaaattaaaagaaattccacaattagatttcgtaatacaattttctataacaaaacctagttaattagtccacatgtcctagctcttacccactcagcccgcatattcctcacgctttctttttattttccgaaattttttaaacggctaccaaatcaaaatgcataaataaacaaacccttctcttctttaccaattcccaaatccaccaaaaaaaaaaaa

SEQ ID NO: 2320 - DNA, 3000 bp, Arabidopsis thaliana
  AT1G65150 chr1:24205776-24208775 REVERSE (source_file=TAIR9_upstream_3000_20090619)
aaagaaaagactttgaacaaggaagataaaaactagacataaccttggctagggttcttgacaaacataaaagcctgaaactacatagatctacaaggattaaataactcattttgattatgtacaaggcaaaccaaattttgattctgaaagtacaagcagtacattctcttcgaagcagatattctcttcaataaactgaaatttttaacttgttgtggaaacagacttgaagttgtcttcttttgaaacttagatgcaaagtgtaacaagactctaaggaccagagtaaacaaggacaagtgcaaaagagaatctcaaagcacaaattttaacaaaatagataagttggtaaatactctgttgcagctgttttgtgttttgtcattttgttttcttttactactaaacacaaggaaatttgagtagaatgcaatggataccgataactcacagctatagcagaggcggtaagaccagatctttcccgtggatctctacggtcatagtttgtcaaatacaaaaacgtacaacgcaaatgagaatgcaaatccaagaagaaacctaacagaaacatgtaaaagaatctgcttaagcaagaatctattgttgcgtactctcaataattagactaaatgatgatataaacaaggccaaacttgcatgtattgtttgtgttaaggagcattacaaaatggtctattacttctggaacttaagagacagagctatgttttatctacacacaagtgttcaatgagcatcacaaaatggtctattacttctgaaacttaagagacagagctgtgttttatctacacacaagtgttcactgagcataacaatccggatagtgaatttgggctaaaacatatacaaaatctgtccacaatagtgtaacaccaacaaggcatcaatctgattcctataaagtttttgacttcagactcaagcacttttatgtctatacatcaatctgattcctatgccattgaaaaagcttttctatttattgctccctttgcataacctgcaattcaaagtaggtggaattgagagaaaacacacataataaaagcaaaacatgagcaagtacgcagtcgaaagggccttacgttttcgaaaaacagaatctgtggacggatattctttaaacaaatgctgacaacattctcccagtctccaataacctggagaagcgacatagcctcactcaggtaaagaagtcacaattccacatacaaaaatgtctaaaagactaaaagctttatacctctatctcagaacgaagatatctgacccatctattgttttcataagctacacagttgtatcgatttccatgcaagcaaacctgaatgttaacattggagttgtttctggtaacatagtaaagttaaatggaactgaaacaaattgtaggtacttggcccttaccattgagacaagacggtacttggtatatcgaatgtcaccttcgcattggtatatcacattaacatcaatctcagtcgccagaacagaaactgtatcgaatatttctcctgcagtctcattctttgtccactcaagtgctaaacaatacgagagaaaaaaaatatgctcaaaactactgcattttgttgtgatctctactaacaaattaacttaatagcttataccataggcttaccaattgtgaaaacagatggaagtttggttatcatacggtgaacatagctttgtttcccacatccttccttatcacaaggcatctttaagttcatcttgatgaccttaatgatattctcaaatgtaaaatccttgaatgcagactgcaaataaccaaaacactttcacgagactgaattctactttcaatgtataagggaaaaaaagagacttgccttgacttctctaagtgaactagcactgatgataagacgaaaagaacgttcagcaggatattccaaatccagtttgcatctattgcaaatctttttagccacttcgtatacttcaaagtacaaaccccagttaggcagagcctccaagatgtttagaaacaggtcaaaaacaccatttgcttcctaaagcgtagagaacaagaaaacatcaagtcttgagaaagaagtaattggtaacatagattttttaaagatcagaggttagaccagaggatgcttgagacttagatcgttgagaaggaactcatgaaaaacagattcatcttctctggagcttgcgaaaacgttaatgttccatatagactgcacaaatccacattcttgaaaacttaaataaacaaaatcgagaaaaacaaattctttaggtttgtgaagtttgcgaaaccttgagtatcatagcaagagctgaaacacaggtggcgtttagcttccctataggttcctctgcatcgtcttgcgttagtgagagatctctaaacaaaagataagcaccaagtcgaaaatgtatgagaaaagcataaatatatactcggaggatgagatttaaactacttacggatctatttcttcgagcttctccacttcttgaacgtttgatggatccatctcaatgatcgaaggcaaaaccttctttctttggcagattttcccaagaaaaacaacaatggagattttctttctgagttttctcgagaaaataaacggcagagaaagaaaatgggaaaagttgaagagaagaccaaaggcgattaggcgaggacttaatagggttagagtctgttagtttgtttacgtgatcctcacgtgatatatattaagaattgtgcgccaaaaattgttatgaagctttaatcaacattacatagctcttcgagtacatattatcaaaatcttaaaacacttttttggagattgaaacgtcaacgttttgaagcagaagaagctaaaataaaaaacgagccgggccagtcttgtagctttaggcccgttatatgaaaataatatctaaaccctagaaaatctcttcttacttgttagtgacgaagaatccctt

SEQ ID NO: 2321 - DNA, 3000 bp, Arabidopsis thaliana
  AT5G27690 chr5:9800764-9803763 FORWARD (source_file=TAIR9_upstream_3000_20090619)
atatgaatgataaatatatagatgcatgcattatgcataacataactatgcaaaacatgagcaaaacatatgcatatgaaaaaacttttatatgcaaatcacatcacctaaaacatgtttagcattgtgaacatcatggaattcattcattatgtagagaaataaagaaaaaagcttattagagattatacatattttaaggatatcaactagtctattagaacataatattactgccatgaatggatggaagtaaggcatattcactccaaattgctgcatttccctatgtcgctagaatcaaccatatggaaaacttttccacacttttccacatttgttttaacaagcgtgtcaaatgagattctcaactaaaacaaagactgattattcaaactcaccacaaaggtaaagagatgatgtgcttagattgtgattgtaacgaggcagcacaaaattcacacgaacaaggttctcatggccaatgaatgattgaacaaaagttaatgttgtgaaggcgattgccgtcataaccaaaaccttaactacatacacaacaacaattataaaaggatcttttgagctattggtcatactcatattctttgattaaagaaaccgttatataattttccagctgttttaaattacaaatttagtttgttttttgttccgactcatagaaataattttagttattggtttcttaatcacagaacaagttaaacttgtaaattaaaataaaaactacacaagatttctttaaaaaaaaaaaaagatatggaagttttgaagttcacaaggaagaaagaaggtaaatcttttttacaaaaaaaaacatggtttaaagtttaaaatatgttggaatgtattcatggtttcacatagtctaaattaaaatgatacaatatagaggaattgttagaaatgcttcttttatatttctctttttaaaaatacttttttctagctattcttttagtttatatttttcgatgaccaaaggttataaattttacaagtttttctaaaaaaaatagaagtgtaaaagttttgctaagttttgacggtcttaagtgattttagttttgggcttttgtatataaaagagtaaaatataaaaatcaaaaatcaatattatacaattacaatttaattacattagctaactaaactgtataaacattcattatctatacaatagtatctctttttttaaattatatatatatatatatatatattgcttcaatataagtatctgaaactttaatacacattattacataatatcattatgtacttttgttatcatcaatatgttttcaactatacacctcctaaatttaaatcacaacctagagatgttgtggtgggtaaaaaagcccagcccgacctgaacccgaaataaacccgcccaccaaaaacccaactttagaaaactcagatgggttttttatttagtgggtaaaccccgaaaaaacccgattgttccgaaatatattttgcttataaatatattttaaattatatttattttctgtattacatatatatttgatgggaaaaaggttgaaatgttaaattgcgttttttggcggaaaaatgttaaattgtgtttttggcgggaaaaatgtcaaatccttttcttggccggaaatgttgaatgtcatttttggccgaaaaatattgaatatcttttttggtgtgaaaatgttaaattccgtttttgatcggaaaatgtgaaatcttcttggcgggaaattgttgaatgtcttttttggcgggaaaatgttaaattgcgtttttggcgggaaaatatgaaatcatttttggcggaaaatgttgaatcgcgttttggcgggaaaatgttgaattgcgtttttgacgggaaaatgttgaatatcgtttttggcgcgaaaatgttgaatgtcttttttggcgggaaaatgttgaatgttttttttggcggtaaactgttaaatcgcggtttaggggaaaaaatgtgaaatctttttttacaagaaaatgttgattcacttgaaaaaggacttaaaaaaacccgtgggtacccataacccaatgagataaacccatatgagttttatttatttggatacccagtgggttttaacccatcattaacatctctatcacagcctttttttctttttataaaatatattgcactgtgataattttaaaatacgtctgttataaaagatacaaacacacatacaaatacacttcatataaatactaaaaaaaaaaaaatcctcagtgtagcgagagtccgatcctagttacaattattagactactgaaatgctatgatattatattgttaccaaacttcgaatatccactttaataacagttataaaaattgtattatcgtaatgtgttatcaatacttatattttttatagtgtaagaatagtgtaggaaaatacttgtttatattggaagtcaaaattaaataaaaatgacataaacgatactatgagaagaaatcaaactgagtaaaatgggcataatccaactattttgtgagccgatacatatgacaattttcgatcgctgaatcatggtttggaaatatgtttgattactactctctctttctcggtcaaattaacatccgtaagagagagaaaattattcaaacccctaggtttatggtgtacttcgaacctagctagactgggtattttgacaatttcagtgtcctaaaatatcttctaatagtaagaaaatgaaaatgatggcaaagaaaaatcgaaaatttcatgttttgacaaaaaagaaaaaaaaaaaaactctttttaatcctaactaagtaaatattaatgttttgagaactgagcattttataatcttttccaaaaaggcaactattagagaatattatctgctgaagaagtcccacaaaaaaaaaaaagatatagaagccatgacttcgttactatattacacatgaaagttgcatcaattccctct

SEQ ID NO: 2322 - DNA, 3000 bp, Arabidopsis thaliana
  AT1G10155 chr1:3328449-3331448 REVERSE (source_file=TAIR9_upstream_3000_20090619)
taggaggctgaggatatacagacccaaatccaatggataaagactaaaggaagatcaagagccttcaaaatattgatgagaaactcccagttgacattatcataggctttagatatatccacctgaagacagcctctagtagtctctccatcagcctcgaaattatccaccaactcagatgcaagaagaacattctcacatagaagccgacccttaatgaacccaacctgatttgcctgaaccgcttggtcaatgaaaagctttagccttctggaaatgatgcgagtaatgaccttataaatagtagtgcaacaagccacagggcgaaattgagttagacgatctgcccctgttacctttggaatcagagtgatggctgtagcattaaagccccttggaagattcccagagataaagaattccctgatcgcagccacaacactagacttcacaatcgcccaagcttcgatgaagaattcaactggaaacccatctggacccggtgctttgttacggggcatagagaagagcacctgagttatttcctcttccgaaggaatagtagtcaactgagaagccaggaaggaatcacaacgaaaggggagaagacctttgattttttcaacagagaatggggtgacattctctgaaggaatgccaagaagatgcgaataataagcaatcaacatcccttttatctgatccacattctcgaccctaaaaccatcatctcctctaagaaacttgataagattagtcgcttggtgagcaatcacagctctgtgaaaaaatctagtattagcatcaccttcatgaagccatcttattctggatttttgtcgaaagaatgactctaaagcagcagcaaagaagatccattgcttgcgggcaacatgttcccgacgaaaaagagtatcagaaggtgacgtgaggagttccacttgaatgtcctcaagccgagttagagattgggctgtcctttgttgaatattgctgaaacggagcctgttaagagtcctgcaacacagcttagcaacttttaaatgctgcctcaaagaaaacatgtgagacccaaccaaagtattctcctcccaagcagtagacaaagccgccaaataagaaggatgagaagacaagaaggagaaatacttaaaggacttcttagaaggaggaggctgattatcgattaagatgatacaaggggcatgatcagagtcacctggaggatcaaagaccgcaagagcagagggaaagaccgcgaaccactcaccattagctaaggccctgtcaagcttccgaaggatgggattgtcctgttgatgatttgaccaagtgaaaaacacacctcgagaaggcaggtctgaaagctgactgtctctcaaacaacattgaagatcctccataccacgcaggttcaataaggattgattgatagaataatgttccgaagcagcggctatctgattaaaatctcccaacaaaagccagggagtaacagaaagaggagaagtcctggacagcacgagaatgtcttcccacagagatcttctatctaactcagaattcctgccataaacaaaagcaaccgcaaaagattgaagaagagaaggaatcttaatgctgcaaaacataatctgatccgttctcttaaacaccaaaactgaaatggaaggatcccagactatccatatcctcccaagttcagagcaacaatagttgctatccatcctccaacccggaagggttgaggccaaaaccgagtttgcattctcttgtgccacatgagtttccaaaaaacatcccacaagaagattattagaagcaatccagcttcgcacaactcgttgacgattacggctatttaagcctctaatattccaacaaaagaccttcatattcacaacaaaaggtgaaggtgaaagcaaagctttcaatgagaagaaggaccgtcaccggccctgccatcgacgaaaccttgaagctctgtcacggggggacgaatacggttgtgccacttcttaagttctttcttttttgccttagtagacatcactgcccagcccaggggaagagggaagtttggatccggatctttgatagactctctcatagattttttagggagagtaggaggttgagaaattccagaatctgcaccaatgacaacagtaggaactggcgaattcaaacctggtctcacaacccatttcttactagccgaaggcttgggcaatagagggacctgctgagaaatgggaatcaacgggtcaacaatccgaggtggagaactgagagagcgcttctttgatctcgaacgccttctttttggtttggaccaagggagctcaggtggattagctgaagctgaaccaatgacactagtttctgaaatcccagcacctgaaggaaggttaacagcagagagagccacttcattagccccggagggatagtcttttttaaagggaagtttcttctgcaaggggatgagacaacggcttattaaatgaccatacttgccacaattcaagcacttcccatatgtgtcatattctgcccactagcaaaaattgttatcgagaataaaatctagaacatcattaggacataggaatctaaaatgacaaaggccaactagttcaaaacttcattacagtctcaaaaatttcactctttggcaaattgaaatcaaatatgtgatcatttgattctcatacaaaagcagagatagaagaagagccacaaactgagaatatttgctttagcttttgccatccaattgaattataccttttacatggttatggcactaaagtaaaacttacaaggagaatattgagaagaaaagattgggtccaacttcatttattcttcttctgtcacaatactaatttttttctacagaaagtttccatatagtgaaaagaaacaaatctctatataaagccaacttaagagaagtgttcttttataaacaaacagcaaagaagaaagagagaa

SEQ ID NO: 2323 - DNA, 1009 bp, Solanum lycopersicum
  RBCS3 (Ribulose 1,5-bisphosphate carboxylase, small subunit 3) leaf-specific promoter
aaatggagtaatatggataatcaacgcaactatatagagaaaaaataatagcgctaccatatacgaaaaatagtaaaaaattataataatgattcagaataaattattaataactaaaaagcgtaaagaaataaattagagaataagtgatacaaaattggatgttaatggatacttcttataattgcttaaaaggaatacaagatgggaaataatgtgttattattattgatgtataaagaatttgtacaatttttgtatcaataaagttccaaaaataatctttaaaaaataaaagtacccttttatgaactttttatcaaataaatgaaatccaatattagcaaaacattgatattattactaaatatttgttaaattaaaaaatatgtcattttattttttaacagatattttttaaagtaaatgttataaattacgaaaaagggattaatgagtatcaaaacagcctaaatgggaggagacaataacagaaatttgctgtagtaaggtggcttaagtcatcatttaatttgatattataaaaattctaattagtttatagtctttcttttcctcttttgtttgtcttgtatgctaaaaaaggtatattatatctataaattatgtagcataatgaccacatctggcatcatctttacacaattcacctaaatatctcaagcgaagttttgccaaaactgaagaaaagatttgaacaacctatcaagtaacaaaaatcccaaacaatatagtcatctatattaaatcttttcaattgaagaaattgtcaaagacacatacctctatgagttttttcatcaatttttttttcttttttaaactgtatttttaaaaaaatattgaataaaacatgtcctattcattagtttgggaactttaagataaggagtgtgtaatttcagaggctattaattttgaaatgtcaagagccacataatccaatggttatggttgctcttagatgaggttattgctttaggtgaaa

SEQ ID NO: 2324 - DNA, 1714 bp, Arabidopsis thaliana
  RBCS4 leaf-specific promoter sequence
caaatttattatgtgttttttttccgtggtcgagattgtgtattattctttagttattacaagacttttagctaaaatttgaaagaatttactttaagaaaatcttaacatctgagataatttcagcaatagattatatttttcattactctagcagtatttttgcagatcaatcgcaacatatatggttgttagaaaaaatgcactatatatatatatattattttttcaattaaaagtgcatgatatataatatatatatatatatatatgtgtgtgtgtatatggtcaaagaaattcttatacaaatatacacgaacacatatatttgacaaaatcaaagtattacactaaacaatgagttggtgcatggccaaaacaaatatgtagattaaaaattccagcctccaaaaaaaaatccaagtgttgtaaagcattatatatatatagtagatcccaaatttttgtacaattccacactgatcgaatttttaaagttgaatatctgacgtaggatttttttaatgtcttacctgaccatttactaataacattcatacgttttcatttgaaatatcctctataattatattgaatttggcacataataagaaacctaattggtgatttattttactagtaaatttctggtgatgggctttctactagaaagctctcggaaaatcttggaccaaatccatattccatgacttcgattgttaaccctattagttttcacaaacatactatcaatatcattgcaacggaaaaggtacaagtaaaacattcaatccgatagggaagtgatgtaggaggttgggaagacaggcccagaaagagatttatctgacttgttttgtgtatagttttcaatgttcataaaggaagatggagacttgagaagttttttttggactttgtttagctttgttgggcgtttttttttttgatcaataactttgttgggcttatgatttgtaatattttcgtggactctttagtttatttagacgtgctaactttgttgggcttatgacttgttgtaacatattgtaacagatgacttgatgtgcgactaatctttacacattaaacatagttctgttttttgaaagttcttattttcatttttatttgaatgttatatatttttctatatttataattctagtaaaaggcaaattttgcttttaaatgaaaaaaatatatattccacagtttcacctaatcttatgcatttagcagtacaaattcaaaaatttcccatttttattcatgaatcataccattatatattaactaaatccaaggtaaaaaaaaggtatgaaagctctatagtaagtaaaatataaattccccataaggaaagggccaagtccaccaggcaagtaaaatgagcaagcaccactccaccatcacacaatttcactcatagataacgataagattcatggaattatcttccacgtggcattattccagcggttcaagccgataagggtctcaacacctctccttaggcctttgtggccgttaccaagtaaaattaacctcacacatatccacactcaaaatccaacggtgtagatcctagtccacttgaatctcatgtatcctagaccctccgatcactccaaagcttgttctcattgttgttatcattatatatagatgaccaaagcactagaccaaacctcagtcacacaaagagtaa

SEQ ID NO: 2325 - DNA, 1923 bp, Arabidopsis thaliana
  At4g01060 (G682) promoter sequence
ttattaagtgctatgcgttaatcggcatctataaagtgttgcattgatgaacaaagtggatgcctaaactagacgtttaactaaatgtttagaatgaaatcttcatctcatctaaaaagtgttgcattgatgtaaaaagtggatgcccattagttcttggctttgaaatgtttttagaatgaaatcttcatcaatctccatatgtggttcaatccactcattttatcttttgttaaagatgttcttcaggccaatataatgatgaccatggatggtttgcaactcgcatataacacttctttatccgatggttacaagtattacatggctatagatagcttttgcatgcaacaaattatctatcaaagtttatgcatcctctaaaatatggtcattggcaagccactaaacgtatatattgtgacaatgtatgatgatatatttttatgtgttgactccgtttttcattaagtaatgaaacatgttgctctagattaccattttaatcgcaaacatatatgttgctctaccacgcattgcatcaaatgataagcttgaggacgcttcgacaaaaacatatttctccttcttcttactgaaccaaatgacaattgacaaaccccattaataaaatcggttagtgttaatgtgtcactcataatattaacttagtaaagaacaagaccacattaattaaatcaggtgttagtctgagaatatacgtttctcttcctcattccaaacttaaattcggaatttactgagaatatattgttagcactgaaaaaggttaagttgaaagtttgctagggatggcaattaaatatagtcttgccttggggatattcccttcgtggacttgtaagtttatttataggtcctcttatgtatatatagatgatctaacgatcgatatactatgaaaaaagttgttactagattttattgcaggtaatagtgttgaataacccgaaccaataaagcagttgtaacgaacacacgacacgttgcttactgcgaggaccactttgttttttgttttttttggctttaagccaatttaggaccaaatttgcatgattgaggatgcaagtatccaacccattttcatctttcgtagtgacactcatttacttttgtgatggacacgttatagtatatcttaaatattaaagagacatgattgggggatcattgttttaatttaaataatgtagattctattcttttcatggtattaatccaatttatagaaagttatgtgttattagcaattaagctaaatgatgaaaacaatcagtttagtgaaacaaactcgccgagaaaacatgaatggttgaaaatattattgtgttttacaaacgtacacgaggacaatagttttgtaagtttttcttaggcattgaaaaatgtttgatacaaaaagtaatgttaaaataattaaaaatgattttgtcttaatatatccaaaatttcaatctattatgaacaaagggagtataatttctgattgaatgaactggaatagcaatcagaaaagctttgaaaacaattgttgttgattattaatgatcttaattaacggcatgtatcaatatttatacaacttatgttccagtccaagccatcacaacggagtaaatgaagtcacgggtacttgtggtttttattggttgcaaacttgcaacttgcaaagatagctaacaataattaatataattaatgagaacaaaaccaatttagtaaattaaaatcctttaacatagaaaccgaccaaacccgttggaccgttggttacttgatttggttagttgctataaatagaaatgatggttcgtgtgcaaccttcaaaatacgaccactctctcagagtactctcttagtttctttcttcttcttctttgtaatacggtgccgtttgac

SEQ ID NO: 2326 - DNA, 1500 bp, Oryza sativa
  Os02g09720 location Chr2:4997678-4999177
ggccgtcgtcggcgagttctcagctatagcttggtagctatctagctcaatttgctgtctccaagtgtgacagctagttgtaattgagttggtatagctttggcctcttcttttatttttttcaggccgtttagatggtaacctctctgacttgagagagttagagaggccttgtatatacggagtatatagtactccagtttagttgccatgccagcagttgcatgcactagtaagcaactagtctctcggtttcatattacaactcgttttaactaagtttatagaaaaaacatagtcgtatttttaatacaaaacaaatatattatcaaaatatatttaatgtttggtttaattaattaacattggtgtttttgatgttactaattttttttataaacttagttgaacttaaaataaattggttaagaaaaagttaaagcgacttgtaatatagaacggaggaggtagctattggtcaaggggatgtgcatccatgtttggtaggtagccgtggtggctttggtgtgtcattctctatcttttccacacacacactttaaatttgctggctttttagaagaacaatggtaatgtttcgcttttattttgctcatggtaaaaagattgtgtttcgcttttcgaggggcaaaaattaagtctaattgatgctattgattaataagatcgtgatcgcgaggaggattgagatgtctcgatggacataatagaatcttaggttcaaggaatttacactctttaataaagacttcgcttgcaaagatgtaggccaaatgaaagagacttaagcatgcttgttgatataatactagtttattttgagaattaggatttaatttgatgcactaaacctagagtaaaaaccataagatgacctaaatctgtgccaatatatttctagttggttcataattaatcaacggaatgagtatgcagtttttctcttaaaatgcctataggagttaggtgccatgctacaccacactactgaaactgaattggtgccggttggaaaccggctatagatgtcggatatcctaactgatacccagtagacgacacctttggcttcagtcatcgatcccgccggcatcttttacttacaaaggtgtcggttttgaatacagaaccaacacctatactgtcatataggtgtcagttcttaaattgattggcgtatggacagttttacatgtgacttttacaggtgacagttcgtaaatacaactggcacctataagaagcatatatgtgccatttgtacaccgggcaggacacgggacaagggttataggtgtttgtttgtaagtaaaaccagcacctatatgttagcaagaaaaaaaataaaaatgataggacctaccaatttcacatacatatcacacaataacagaaattcacatcacttcaaacatacaaccacattcacattcaaccaaactatatatattcaattccacatccacaaccctcatccca

SEQ ID NO: 2327 - DNA, 1500 bp, Oryza sativa
  Os05g34510 location Chr5:20455817-20457316 (reverse complement)
ctatatcttcctacctatccccctgcaagctaacaaggggaattacttgcacatctaatgatggactggtgttgttatgcggttgtgttggggtgagatggaggatgtctctcctcccccttgctagcctttaaaaaggagtcctacaggggcataacaggaatgagaggaagcttctggagatcaattctcacaacacacatttcctacagtacagttttgcccccagacagatcggatggtgtgtgtcagcagcctctatgcctgtaggcatgcattcagttgaatggttttgtctcgatcgacggcgaaaaaggatttacttttggacaagaaaaaagagcctttaatccatgagattactacatctcgcatacagggacaagtattacagctgtgagtgatgcttaagagactttacggttttgtttgcagctaagcaggaattaatataaataatctcccttttcagggctctgcttgcatgaatagctaccagccagagccaagagtgccagagacatcaagcctggatggtagtagtacagtacttgcgttactcgtgcccggcgttgctgcttcggtggggcccacttgaactggccgtcctcccgagccgtcggtgggggtggtccccaccaccggccagttactttgctcccgtcgattcggcccggtgcaccaacagcccatttttttatgatgggcttgcaacttggcccaacttgttggattgtcaaggccggagggaggcccatctgggcgaacttgtgtgggccgcttctttccattttagagaggaaacatgggctgggctacgggctgcgggctgccacctatcaccggagaaacacttgctcgcagcctcaaatacttgaaaccaggctttgaaaattcggcaaaaatcatcaaacctccgaaagtatgagagaggaaaatcaattatgatcttcctaattgtgtcatgattagcatagcgcatcaaagcaccttatcggtgcaaaattaatccctttcaaaaccattgtacttcatgaatcttgctacatatcttaaaaacgttgacgggcttacagcttaccagagatcaaagcgagaggcagaacaaagttcaaaatctgccgtgtataacaacaacaagtaattacagtagaaacaccttactactcatcaatcactactactaacaccaccacatacgaatcatttctaccagatccaaacaaagaaaaaaaaagagggagagagaactaattaaaaacacgaaatccgaaccggttcaactaatcaatcttcgccacaatctccagctccagcgatgaactgatgatcatggcggccaccaggtcaggtgtatgtattcacaggtttcgccgcgatttgacatgattggaagtggaacgcaaactcacgcggccactccggcgccggcgccgatgcaggagaagacgcggacgctgcgggccttggggagcgctacccgcggcagccgccggccag

SEQ ID NO: 2328 - DNA, 1500 bp, Oryza sativa
  Os11g08230 location Chr11:4325545-4327044
cgccgtatccaccttcaccagctcgatctccgtcgttgatcgttgattgattacgtactacctgagtgatgatggacgtggatcactggaatgggttgagaaaataaaaatgatttatgtagtgtgtaggagtactcaactaacaattgaacgaccagaatttgacgaattttatttacatgtttagagaccctgggtagagattcagtaataattaagttcttgccatatttttgcatcaatttaattattttactaaaatgatttatgttgttttattttcttggcactatatttgcatcaaatataattaaacttagcttaactggccagagcttatatatggctcagatttaattcccctcttatcttcagagcattaaaaagggagtatcctaaaatacctatctcctaaaagatcaatctgcctgtggctcaaatctatataaagtgagctcccctcccactgtcccacatatctatatagctaccatggcactacagcttgcaacacgctcaaggaagtctctcgccatcgccgtcgccgccgccgtgccgctgctgatgtgcctcttcctcgtcgccgccgccgccgcggctgcatcgtcggagacggcggtggcgagctccccacagtaccagccgagctatggtaatacgtactcgacgtgcttcgaggtttcggcatgcgatgacaccgggtgcgcgatcaggtgccgcgacatgggtcacaaccctgctggctcagcctgctggaccagcaacgtcgcgaccatcttctgctgctgcggccgtggtcgtcctcctccggttgcttgatccatatgtatacataattacatatatggtatatgtataactggataataaagcgtatgtgcgtgtcagcgtgagttggtgaagatgacttataacatgaaacaggagtagcgctagtaatgagatgtgtgtaaaaatgttatggttcaattaattaatcaaagtcgatctttgcattgcatgctgatacatatctatcgaaatatatatgtactaagaccaagaatcaaagtcgtactactcgtatatgtacaaaataattaattttaggcaaattttgctacaggacaccgtaattgtgtggttttagcctagggacaccgcaaaaacaaagtttgaggaaagacactacgtaaccgtggatatttgcgatggacaccgcaccgtctaaacgaaacttgctatgctgacgtggcggtcgggagccccttttttgacgcggtcggaccgaaatgcccctgcaccttacctcctcatattgcttgctggacactaaattgtttgctggacactaaatacatagatagatacatcgtacatatacatgacagatataccgacatggactacgttccttctagccaccgctgccggcgagctccaccgccgtcatatggttgttgcgcctggcgtgagaggtatatgcggcattgcatcactgtccggccaactttgaattaa

SEQ ID NO: 2329 - DNA, 1500 bp, Oryza sativa
  Os01g64390 location Chr1:37374848-37376347 (reverse complement)
tgtccagggctccaggccgtgatcagcgctcgctgctacgctcagaccaacacaggaaattattacttgctccctactactacgtgcaagcagcgtaaagggggcaggccactgtttgaaattcatccctctcaccttttgaaacagccgcgcgtcgtgccgctgtagtagtgcagctgtgcaggtgcagtagctttgggtcaaaactcaaaactcgaaagggagacagcaccaaaaagatactgcggctgcagccacacagggctagctgcttgacgcagagagttcgtagcgacgttgctcgtctgggcatggcagtcgcgcctagatcggctcgtgcacggcatgcgttgcttgcctgggtacgccaccacctgcgcagccagcgatcatggccggcgcggcgtcccacggcacgagagcgagcgcgcgcgcgcgcggcactctcgtgaaggcgtacgcgccatccggccgcgcggcgcggcgcaggccggtgcagcgtgcaggttgacccgcgacaggcgcacggccgcacacgcggtgcggcgggccggcggcctggatttgggcggagttctcggtggccgtcgcttttcccgtgccagctgacgcgattacgagccgtacccgatcaaaaccggcgtgatcgccggtccgatgcatgcgttttgttttcatgccagatctttggtaatcgttagtacgactctctgagtccgcgagtacgctggtttctgttaattgcagcctacagtattttctttttcttttttgcctcggggaagcgatgcgagcgatacgtgataatttcaggtggcgcagtgccgctgtgcatgtgtgaaatcatgcaagattggcaggttgctagcgcgcacgtactcctctctggtgtgatcggtttcaggtgatagagacgatacatgggcataccttgacacggagtgggctgggatggcgcgggtggtccatcggctacagccttacatgctcctcctatcaaactctcgttatgtccagttcacttggcccatccttggtttcctctacgactagtgctcctctagccagtagccactacccactgtttccatattggcgcacgggtcatataagatggtttgttcctgttcacctgacgggaaattctttctcctaaaacgatatcgaaccatccttatccggattggattaacgagatcgtcgtgctaagtgtgctaacacacttgttatatgaccgttattccgagttcgtcttgctgctgggagagttgcagaattgtagtactcccttcgtttcatgtgacaagacgttttgactttagtcaaaattaaattgctttaaatttgattaagttcgtaaaaaaaagtactacctccgttttacaatgtaagtcattttagcattaacgagcatggtggctcgcgcaaattgcgcggctagcatcattatattttctctcatataatagcatatatgttttctcattatattattcaaat

SEQ ID NO: 2330 - DNA, 1500 bp, Oryza sativa
  Os06g15760 location Chr6:8954266-8955765 (reverse complement)
ctccggcgaggcggtggactcggactccgactccgacgaagtcgaagagatgatcgaaaggtttgggagtcgcggcggcgaggatgaggggggtggatttggtatatttacgggcgcgggtttgggctttttttcgcgaatgggccccgcccggtttgacttctgcgatagggatgcccctcaaaaggtagaaaaatactcaaagaaatactcctaactccgtttctaaatataagtgatatatatatactactcaatcccttttagattggaagatgttttaactttgaccaaagtcaaactactctaaatttaactaactttgtagaaaaaattagtaatatttataacactagcatagtttcattaaatctataattgaataaattttcataatatatttgtcttgggttaaaaatattactattttttttacaaaattagtcaaacttagattagtttaaatttgaccaaaatcaaaacgtcttgtaacctgaaacggagggagtatttcttttagctggagaataggtgaaactatccctcttcaaaattttaaccagtcggatttttataaaaaaaaatattttcaaatattttagacaagcatattaccaaattatattgcatcttaaatatataaaagtattgcgaagtggtgctatactttttggcgcaaaaaaaaactcaaatacttcacatccctttttatataagggaaactttcttttactgaaataaataataagtgaaactatttatctttagattttagccactcgtattttttagactgatgccacttatttttctaaacaaggttttcaaatattcaaaacaatattattctcaaattataaaagcttgaacctttgtttatcgtaatacaaccatgtaagaaatttttagtggtgaaaacgaaaaattgtccagccaaatacatgtcatcttcacatcttctactagtttgatccacctttggtgtttaatgttttcacaaaaggagtaagatactacgtcgcacaattttggaatcagttgttggaaataatttattctattttggatggcataatactttcagactttcattatagaatttactatatgatcattttttttatatttcagctggctatcatttgaagggatgggtgaatttatcccatgacattaatcccccccctccccctaaatttttataacttatcggctgtgtcttttatataccacagatatgaatcagttttcatcattattaaaaaaaatcaagacaattattttaaaacaatatttagcgcggagattcgtgctgggtcgtccacgtatgcagcatgggtgtcgctgtggggggtttggtgattgctggtcgttgtcgtttcgtggccggttgcagtttgtagccaagggtggtggcatctgatatctggccacacactttggttatggaatgctgggtttgctgctggtgtggtgatcaaccggtgggtgattggtttg

SEQ ID NO: 2331 - DNA, 1500 bp, Oryza sativa
  Os12g37560 location Chr12:23047433-23048932 (reverse complement)
tgacggcgtctccttcttcttgcttcttgcttcttcttcttcctcctcccgatctggggttgtaggaagctactggtcgtgatcaatggagcattccgccatggatggattggatgggatggggagaaggggagggggagaagcgcgcgttgctggcgatgttctctccgcgtggggggtgggatgcgatgcgatgcgatgcggaggaggaggaagacgacgaggactcggctagtctggagttaattgattaattaattgattaattaggagcaggagaagtgcaagcacgacgagagtgaagggaaaggaaccgccgtttcaaaaaagatggaatttttgcggccaaccccttctactagtgacgaatcacggtcatgtttgccacaactttcaggctgagttcgtttctttgatactccattcgtaccgtaaaaaaccagcctaatactagatgtgacacatcatagtattacgaatctggagatacctctgtccagatttattgtactcgaatatgtcacattcagtcatatattcgttttttttggacgggggagtatctaattcactcctcggctaatgattaattaatcatgtactaatggatcactctgttttccatgaacacagcctcgggttaggtcttagatccacgacagatttaaatttttaagttttatttaaaatatgtgtaaaatgatttatccaaatgttatagacataattgaggatctaaatacatggatttgtggagcttgaaatattcagcttctaaaaatcttgaatttggagctatgctaaagaggacctacgtatcctgcagttaacttattccaaaaagaaaaacaatatccaaacctgatgcttaaaaaaacacactgaaaattaaaggcgttatataaaaagtatatataaagtattaaacttgacaaaatgtgttggagaaaccatgcgtaaaactccagatattacctggagacaaaagggcatgtagtcaatgattgcaaaacaaattctctggaagtaacggaaataattgaaagttatacatatccaagtaggatttactacttacatagccagccattatccactgataattgctgctattatcaccataatcaaccgaataatcagccaagaggttatcccaacgataaatgactttgatctctcctttggtttaactcaaatgaatgataatggcttatcaaatgaccagtcatcttgactacaaaatcatatgataattaacctcattaatttatcactagtggctgataaaatgggatatagagaatgctttggaattcatgatatttgctaatttataggtaaatttctaacaaacatatggtaaaataaacccccataataatcgtactaccaaactataccaaacaagtactcttagcatgtatatatagccacaccgatcaactagaagactcaaaataccaataggttgtcggcatcgcctaaccgtgatcagacatc

SEQ ID NO: 2332 - DNA, 1500 bp, Oryza sativa
  Os03g17420 location Chr3:9689781-9691280 (reverse complement)
gtgttcgcacgacgatagggctctgacttcttatggaagatgaacatgataaacgtagatgccttttcatatagtacgacctacctgaagacatgagatgagatttattagacgttttgctggtcaacacacaacacgtcgatgactcgtgcgacgcaaatgcaaatccagatgagttagtggaccctcacacttatacataggagtaggtgtcatctgagtcaatatactagcaagagtgagtttgaaagagatgttgggattgagcttttttttagcacatataaaacgagataagtcattactatatgattaattaaatattagctattgcaatttgacttctatgtaaaaattttttttcaaaaacatatacattagtttgcaaagcgatgaaatagtttacccaacttctctttagaactcagcctaaataaatctaacccctaaatatgctaaatgtgccagccctagtccaaaatttaatgagacctaccataagaatgttgacatgacatcttcaccaatcctacaaacccttaaaaagttaaaagtttgaagaaagttggaagtttagaaaaaaagttagaagtttatgtgtgtagaaaagtttttgatgtgatatgatgtgatggaaagttgggaatatgggggaaactaaatacggcctaacaagtatggcacacacacgctttatttttaccttttttcttctttttattctgtctttcattctccttttctatttctttgcttctatgttcttcctcaagcgagccttccttgagctcaagttgttgccattgagctcatggtgggctggtgggcatagtcgtgcactcacactaagcaactatcgttaagctttccatggctgctgtaacatcccggcccagggcttaataggattaatataagacttgtgcacacgagtgaggacaaagtgtgcagaaaagacttgtgttggtctgtgagggcagtctatgacctatgaaagctgccagatgtaagcggaccacttcttttctggaagccgatgtccaaagaactttagggttaagcgtgcttggcctggagcaatttgggatgggtgaccgaccggaaaattcttcccaggtgcacacgagtgaggacaaagtgtgcatgaaagctgccagatgtaagcgggcccagcttgggagaggcgggacgttacagctgcgatgcttaagcgtccctatcggccgccaccatcgagctcgtcctacccttggtcaccaccactcctctaccatcactgagctcctatgcatccacggccaaaacaaaaaccctatccttacgtatctcctctttcaccaaccgaaacccaccctagcctccattgcttcagtcaccgccattaaacaatattagatcgaaatcctaattcttcgccagcacaaaatgactaaattcattagtgttgcttctcatgttccaaaattaaacatgtatacgagttcattgtacccggtaatc

SEQ ID NO: 2333 - DNA, 1500 bp, Oryza sativa
  Os04g51000 location Chr4:30185779-30187278
gcgaggatggctactagcttgctgtccttgcggtcggccgggctcggtttctccggttgtttcttgtgtttcgcccacacacctctgtgcgtcgcgttgggctcgttatatagcggccactgtagtgttgggctatagttgctgcacgcggttgacttgacaaatctccatagctcgttgcattggtccggatcgatgtatctgcattcacgctagcttttggtttttgtccaatacttggaggaagggagcgagctaccgatcgatactacgtgaaaacgacctgtcctgtagaaagctgcatgcgtcgctagagcacacacgatttgatagtctagattctagtaagccctattacgtgccggtacataaaaagtaggcacagtaagccttataggagtaatacacccacacattgtgttgtcctgtcacggcgtacgtgcatttgtaatgtggcgcacgtctcaagtgtccttcgatcttttcgtcccgtctctccttggaggtagcaacggcgtcactgttcctcttccgaagaaaaaagatactcctgcatgcgtactgttgttgcgtacacggtgaacacgggtgaggccgtagccttgtgcccttaattatcgtacgtggcggttgtccatgtaatcgtgtgagcggtgggggcagaagattagcgtgtcattctgcagattttccccacgctagggcaactcaaaaatgtttttgattccgagggcgaaaatatactttttaagaattattttaccattctggataattaatgtatcgagagacaccgtatttttttaatataaaacttaatacttttagatactgtgtattttgagataaacaaaagagtaaattgcatcagcggtacacgaacttgtcaggttggtgcaatctagtacatgaacttctaaaacgctcgtttctgtgcacgagcttgtttgatgcgtgcgaataatgtcaaaatcgcactgcaaggttaatcttgttgattctgtggttgatttaaactctatgtaaacattagtctaagaaggataaacatataataaggcataatgattgtataaaaaaataaaaatttgagtaatgatgcaagggacagaaacaaagaaagataaagtggaatctaagaaaaatcggtcttgtcgcaccattttagtcttagtttgcacataccagacaaattcatgcaccaaaacgagacgagcattttataagttcatacactaaattgcacgcacctgacaaatttatgtaccgctaatataatttactctaaaaaatgtagtgtaaaatttctcttcttttaaagtctcactatggtgcattcattggtcttatttgattggaggatttagatcttttttacaattatttcaattaacggtagtagaaatatggagtgatatttattgtaaaaaagaataatgtgcatggtgtataattgtcatttagcaatgattaaatatttgtttctctttctggattttt

SEQ ID NO: 2334 - DNA, 1500 bp, Oryza sativa
  Os01g01960 location Chr1:522445-523944
gacctcgaggaactcctcgtatttctccctcttgtcctggaacttatccttgacggccttgaggtagacgagcgcatcgttcgtggtgagcttctggccggccgttgcgccgccggcgggcggctgagcaggcggagcagcggcggcctgaggcggcggcgctgcagcggaggcaggccccagaggcatgtgctgcggctgcgccgtcctacaccacgagaggaggggcaaacagttagatcaaaacgcaaaacaaaatcgcaccctaaaaaacacctcctttttttttgcgacgtagagttagaaattggaacacaaaatttgacggtgaagaagagagattccccaaaggaaacccgaattcctcccgcagatggaaataatatatataattaattattcactccctcgcgggctgagggtgagggaaacgaaaccgaagtgaagtttattttgaaaaataaaacaaacgaaataggcaggaacgcctggaagggcgaaggcgatgagcaccgaggaagccaaggatggaggaggcgaggagaaaagcactcacggatcggatcgaccgacgttggggcgcttgagttgggagcccatgagcgcgtcgtccctggcgcgcttcatccccccatacacagactcccttcctcctcctccccctcctcccttcacccaaccaaaccaccgccgcctcctacagaacaacctcccggtcgccgccgccgccgccgccgccgatcctctcaaacctcggaagacgtacaccggcgccggatctgcccgccgctggctcctgcgagaccccccgagcgcggcgcgaagagggcgcagcgcgaggcgaaggcgacgcgcggggaggagaggcggctaatcgcctcggcgagacgcgagacgcgagagggaaggatgggtgaggaacgaggcaagggcgaggcgaagaagaagaagagaagcgaggcctcctcttctctttaacacaacgaagagaagagagcgcatcacaacccatgtacacccaccggtgccaccacgctgccccgcgcccgtcgcgaaccacatcccgcccgcacatccccagataagggacacgtggacgtaccggatcgaccgccctagggtgcgaaatggttactggcggtgatcgcaccggtgggagggttagcttgtttcgtgggtaaacacaacctacccattggatttggggattccagtgagcggtctggattagcgcggggttacttcgagattagtgcccccgggcccacctgtcagtcggatgagtgcctccgatctcaggtttaacctagctccgctagggcggcgtcggttcgtatatccgcctcatgcgtgtgtgtcttctggctcaggagacgtatttccgtgggatccgtatatacatgggcttcatttggccatttgtcacgatccctagcttccagagagggctaccgctggatcttcagtttcatctgcagtatcaaactattaataaaaaag

SEQ ID NO: 2335 - DNA, 1500 bp, Oryza sativa
  Os05g04990 location Chr5:2418356-2419855
tgataacgatggtgcgccttcgtgatcgatcgagagcgtgaggagcaacgcggttcaatttatagacgatgcagatcaagctggtgccaagaagtggcgggaggttgatgacgatcgatcgatccgaggaagaagaagaagaagaaatgtaagtggtgatggtggtgatcgatcgagttgagttgagaggcggcatgcgcgcatgcatgaggatgagggggaggcaatggtaatgattgtgagcattatggggaggggagaggaggatcttggtgattaatgaacaacgttaatggtggaagtggtggcagtggggatttcgaatgagatttttctttttaacgattagcactagacaacacgactatgagaaatacccaagggtcatctggctagctctacaaggtggtaggccagatgatctgggttcaaagcctcgccccttttaattatttgatattagtctttttctaatattcatgtcttttactagacagtacgattattcatcgaatagaatatgaaaaaattacaagattaattagagacctagaagacaatagctaggaaagaagaaaaaaaatccaccaccacgcaccgacgtcatctacacacagccaaggagaaggtttagcaccggaccagtcggcgctaagcgtgaccgactgccgctaaaccaacaagggtatgggaatgaccgctaagattgcccaagtccaagctataacagccgagcatcaaacacaactctagccacatctataaaattgaggggaagaggatgagagagaagaattgaaccgctctctacgctaggccctctaacgtggccaatttgtttaaactagggcgccaccacaagaggatgagacatctaaagtgagcttgcaccagttatctatgataagatttgtcaagggggctttctagatgacgtctccagggacaggagcgacaatgacactgccgccaccatccgtcgaggtcttaaggagaactaagacaagattttcactcgataaccctacaagaggagaggggatggctcgacaacaccccgaagaagtaagatggcgcctgaagcgccagccaagaccgggctgggtttacacccgccgtcccgccacctgccgatcgaaagctgtgctccattgctacaaccaccatccatcctccgtcgcgcgtgggcaccgttgcaccgccggcccccgccggccaacctccatgcggcctcccactctttgcaccggacagttgtcaggccatcaccgtcgccgaccgccggcctttgccgctccgtcacccacgcctgccacaagccgtcggcctacgtcgcccgtgcccgtcgcaagccgctggcctctgtcgctgtctcctccggtctctagattcggcagcggctgtgccggatctaggcgcgggggagcgggggtggatgtggaggtgggggaggaaggggggcagatctggcagcggtggtgccggggacactatctcgag

SEQ ID NO: 2336 - DNA, 1500 bp, Oryza sativa
  Os02g44970 location Chr2:27240720-27242219
ggttgaattccacagggaaagctcatcatttacaattttctggaaaacaagtcttgactcagacagggcccctaaattagcataacaactcacaatcttagagccaagaatcacatcccagcacaatccatgtgtgaaaacatgacaatggatcttctttagagacctaatatctgcacagccttggaacaatggagcaaacttgtcaaaattaagtatcttattagagcatgaatttgcatcggcagtggatgctgatagtctccaacgcagcttcagcactgcaattttatcaaactttgaactagtgtttccagctaaattcccctcaaaagaattggtagcatcatcatggttgttgacgcaagaaaaacaaaaataggtaactaattgactccgaattcatagacatacgatgacagttcagttaaatgagcctacaatataatagtcccaagcacacatgtgtgagtcatgtgcaatgattacatcatgtgtgcttgggactattatattgtagactcatttaactgaactgtccaattgtggttggtgacatggttcaggagtctaacggtgtaccggaaacagatatagtgtatatctggaagtggagtctataaataggtccctaccctccagcctcataatgcattgtgagcggaacaacggaaaaggaatagagggtaggccggatagacccacgtaaacctaacaatatttgcttttcttgcacctccaaggatagactattcaactaaacctgatcaacagcggaacacatacaatcagtgtactttagtacaacagcactaaacttgatagcagatcacattaaattaagcgataatcccagttatggcatacacagcagaggagtgaagccacaatctctccaggacattgccacaggtaatgaatatgaaatactaccgcaatctcgccggtgctaccaaataaaccaccacctaatcagaacaaatagccacatcatcaagcagtcatcatgtaaaaacgagaaaatgggaaaactgaccaccagccgaaatctttttcagaggttcattccgtgaaagaaccggagtaggaggaggaggcctcggggtggccgccggcaagccgacctccggagggacggcgccaggaacagtggaggaggggcgcgcgcgtgggggaggcgcgggtggtgcggccgtgcgagggggcggcgctgccgctggctagtggagacatcggagttcggagcgaggagaggtggcgtggcgagacggtggggaatcgcgtgggcctttgcgcgtcccggagaaacggccgggtcgaaagcccacactaccattcggcttgggactagctatccatcacgcgacagatttttttttttccgaatcacacagattttatttttttttcaaatcacacagattttagattaattgaattaagctcatttgatcacttgattagaagagttatcaacatatattgcatatattttattta

SEQ ID NO: 2337 - DNA, 1500 bp, Oryza sativa
  Os01g25530 location Chr1:14470301-14471800 (reverse complement)
ggttgtagatgccagaaaaatgaatatgagtaactaattggcttcaaattcacaaacatgttttgcttttattgcacctccaaggatagactattcacctgaacccgatcaacagtaggggacatataatcagtgagctgtagtacagcaacacaaaaaatgatagagaatcacattaaaattaagccagaattccagttatgatgtacacaacaaacaagtgaagtccaggggcggatccaacttgggacatgggggttcagttgaacccccaaacttttgggtgaacaaacaaactgttattacctgaattatttaagagaggtttaaggctatcaaattaaggaggaggagaagatctagaagagaagctagtagggttcacgaacgcaagcaaattccagtcccggtggggtgggagagagagagagatgaatcagaaagaggacgcaccaggatcccctcccctccgctgcgatggagatcgccgcccggccctcccctgttcagccgcgactcgtcttggcggcggcgcaacgaggcaaggagcggaggagacaacgagaggtactcgactactctgcccttatctcaatatttttacttaccactctctacgtcctaatagttttacaaggttcacatccaacatttaactttttatcttatttaaaaatttgaaaattttttaaaaacggacggtcaaaagttcgacacggattttcacggctacacttattagggacaaggtagtattttaaaactagctagtgttatttctttatataactggtgacccatgtatcatcaatacttaggaaaaaattaaacgattgtgtcgacaacaaattcctcataccaccagcaaccgctaactgccactctacgcaccgccatcactgctctttctccatgaatcaccatcgttcttctcctttgcctttacatgcgcagccttaacctctagtaaccgacaagtctttttctcctcccctatcgtgatgcgcactattgttatcgttgccattgaggtcggagatgtcgggcttgcagggactttggaaggcaggagctgacccgacgaagaacgaaggcgctatatccgggctctttcttgctagatctatcggttatccaactgtcgtatggataaagaaaatggagagagagaaagagagagagttaatgtgcgaagtgattactgagtcaccggacttggagatggatagaatatggtggtctaaattaaaatgtaaagttagctattgtgtaaatgaaaatggttaaatgataccattatatgaaaacttttaagaatttttaagaatacatagtatggattgtaatttacttcctttgtcaaaaaaacgaatgtagaactggtgtggcacattctagtacaacaaatctgaacatatgtatgtctagattcgttttactaggatgtgtcacatccaatcctaggttagttttttatgggacgaagggagtacttttttt

SEQ ID NO: 2338 - DNA, 1500 bp, Oryza sativa
  Os03g30650 location Chr3:17474886-17476385
ctccgactctcttgtcttctctgcgtgtgcgcgcgtgttctgctctgtgtttgtgtgggagaaaggttccggcgttcagcgaggtttggaggtaggagtggggccctatttatgcactgattcgaatactactctgtattgtatttacggtggctaattgggattttcttggggtatttttataacgtacttctgtattttacggtgcctaataattgggatttgtttgaggtaggggtgaaaacggtacggaaacagacggaaaccatctttattgtttttgtttttattttatttttggaatcggaaaccccagatacgaaaacggaatcgaatattatcgaaaccgaaaacggagcgaaaacaaaccggcgcgaatacggtaacgaaaatttatcggaataaaaaacccctcaaactgataaatccaattgaataaattgtctatgtttaaaagagtaatgttgttgataaatcccaatataggaaaaaaatattcttatgtaattttagattcgcataacaaatatttttttaaaaaaataacagccaacatcattgtattcactatttagtgcttaaaaaaatacatggtatttcagtcacgaaatttttggtaattccggaaagtttccgaccgattccgagttccgatggaaactgcccttatcatttccgattccgtttccgagaaaatatttccgaattcgtttctgtttctgaaaaattccgaccgacagattccgttttcgaaaataggtctggaatccggaaagattccgtaccgttttcacccctagtttgaggtgataagctttgagatttacctcaagggtcccacgagcaggtgtagattctagaaacgggcagcgcccaggggggggggttgaaaagttcgttgaaggctgtcagaacaccatggaattgaggaattgcgtcaaactggaatgaacatgatgaacacccaagtactggcatgattagtccacttattattcaaagccaaaatggcgtaatggcgtacgtgaatggcgttgcaaaatcatccggactgcgactcgcgcgcggaagcctctgcctccgcggcgccccaacgccgcacgaggatgttctttttcttgacgtcgtgcctcatttcgagcgcagcgagttagccctgttttcccgatcaaaaactttttatcatgtcacatcgaatatttggatacatgtatagtctattaaatatcaaatatagacaagaaaaaacctaattacatagattgcatgtagattacgagatgaatattttaatcataattatgccatgatttggcaatgtggtgctactgtaaacatttgctaatgacagattaattaggcttaataaattcgtctcgcagtttacaggcggaatctgtaatttgttttcttattagactacgtttaatacttcaaatgtgtgtctgtatccttcaaaaacattacacccaaagaactaaacacaccctttgtattgtg

SEQ ID NO: 2339 - DNA, 1500 bp, Oryza sativa
  Os01g64910 location Chr1:37684066-37685565
ggcagcatgccttgccttcgatagttcgatctctagttagcggcaggcgcagtgcaggacagtgaactgattgcccaagttcttgcttgctgaggactggatgggagaagaatgtagtactagtacttcggaggaaaagagccaaagaaacgctcgtcatggctgacgaaacagttgaaggaatcaggtgattgatcgtgttcgtgtatgatacacggtgtatctggaattctggatccggctccgactccggctcctgtatctgtatatgtcaaaaactggtgtaaacgagatccctcgacggtttgaaagacagttttggctgacgtgatgcttacgtttttttattatttttccgggatcaaattgtcgcatatgcgccatgtcaatgttacgtgggacgaagtcctaatcaaaccagccacgcaaacgtcacatcagtcaaaatcgcctttcaaaccgtcgagggacttcgtttgcacagattttgacagttcagggaccggttgcatctgatttttggtttctaagaacgaaaatcggatttggtgtaaagttaagggatctgaaatgaacttattcatttctaatagggcacatcgccttcatttcaaatgggcctccatgtgccaggcccatatttcgattcgagtgtggcctccatggaccaattgagaaataagttcactttaggtcactcgtattgttggagagtctaatattcattccaggaccaattaaagtggcccatattgcggacgctgaagcccaaaggagttgctcctatggtgcggttggaatggtggatggctgaagatgcctcggaggtagagtagtattctctcattcccaaaataaactggagtaagagcatctccaatagatgactaaaattaaactcccaaaaatcatgtattggggacagccaaaaacatatttagcctaaaatacacccccttctccaagagaggactaaaatttgggagcgcttctagttgcccaatatttggttcaggttggtcctggttttggaggtggctaaattttgggaccatgcttaggagtctgttggagggctgattttcaccaaattcctaaaatttatgttttagtaacctgtttagcattctcttggagatgccctaactaccatctttaagggagtatctaaaacagtgataagtttttttttaaaaaaaatttagatataactatagtataattgatacgtaattacattgtaactatattgtaacataactatgatattggcatagtttggtggtttagtggtacgtgagcattcgacagatcgtgggttctcaatccttgaccactgcatgcattggttaattgttactccctccgtccataaaaaaaacaacctagtactgacacatcctaatactatgaatctagacatacatctgtccggattcgttgtactagaatgtgtcacatctagttctagaattgttttttaatgggacggagggagta

SEQ ID NO: 2340 - DNA, 1500 bp, Oryza sativa
  Os07g26810 location Chr7:15496040-15497539
gaatgatcatgtcgcgaagatctacggggcgacggcgaggcggtgaacgaggtcgttctgctcggcgctccctatgatgttcgggaggcgagtggacagatcgctcgtcgtgacccctgctcctgcgattagatcccacgccggcgatgctgaggcttggctgatgatagtcatgagatcggagatgggggactcggctgccagtcggcgtgcggacgcttccggagttaactgggaccgaagcagcaatcatggtcttggtctggttcaagatgttgaccacgtgatcagattgactgagcttgttctccttgaggagggtgtcgaggagggtgatcgcagcaacagcattctgttgtggggtgcggaaaaccggtgtcccctcaacatcttgctggccgataagatctcgcgctcggcgccctgcatctaaggctcattgccgtcggtcttcagcctccttagcggcccgctcgcgctcctgttgctcacgccgcagccgttcttgctcctgtgcttgacgctcctcctccagtcggcgtcgttcggcttcacgtcgcgcttcggcttctcgggcttggcgttgctcctccgtctcgttatttactcgatgagaggtaataccctactcctgtttggggatttaaatccaccgggtgtagtatagatctgacgatcatatgtgctcatgcccctagagggcctcctgcccaccttatataggatggggggcaggattacaagatagaaaccttaaccaatatagtatcggtttcctaaatttattttacaatattatcaaatcaggactttaggccgctccataatataaaaggaaacgtaatacccaagtcatgatctgttacatattccacagatataagctatcccctatgactagtcggataaccatgccgtgtgggtatggggtacccataatctccacagtagcccctgagaccttcacagtcgaaaagataatcttttctcgaactagattactccaaagccgagtgcttcaatcatcttcgccatgatctcccgagtacttttaccaaatatgaagactgtggagagctgaaaaataaagtcaggtgcaacgactagatgcatctaataggtgtagcccccgactatgtggttggctgaacaaactaagcatatagtcaaggaataaatgattcaaccaaccgagcggttttgataattgtaatcaaccaagtgacttgatatcaatatatagcatatgcggtgtgaatcccccaaataacatgatccaagtaatataccgactgctttgtaaaaattgatgcgagcaacttaaagttgactacatcattgaaaattcacatagcaaaacagctataaagaagcttgaatgttgcaaataaagtattgggcatacgccatgcgcacactgctttaacatatgtgcttaagttactaaaagacacatggtttcaccacacctggaaatatatggcatatgtggtgtaaaat

SEQ ID NO: 2341 - DNA, 1500 bp, Oryza sativa
  Os07g26820 location Chr7:15515227-15516726 (reverse complement)
agctgatgtagcgggtaggggagttgatgttggcgccgtcggctgaattgtggacgcaacggaggaaaccgcttgaacagatggctgaacatcggtgatcaaagatcgataattcgggaagacacctccttgcaagtaaactgggcctgtagcctgatgctcggctatcgaaccatcggctattgtcttcatcatgtttgacaatgtattgactaaaaccccggactgattgatcagagcatgatgcacagcgtaatcaactcgatcttgaaagttgttgaaaaaatcttgtgctagctcattattctgattaagatttccttcttgcggcccttgagcaccatcaccttgagccccacgcgctcctcgcagattgtcgccttgatcgcttggggagccgtcggtagcacctttagtactcggctgagcgtgtatcggctaatactccgataccactctatatcaggatattaaagcaggtataatatatcaaacaaaagcctaacatatttagatacagcaatatcttgatataaagggcagatttagcatatcaatgagacatatagaataaatatggctaaatcagatacgatcggctgaaactccaatgctattctaatcggcaactagaaggcaggctagagatcgatattctaagcacgacttaatagatcaaactcaacttatgcagcattaagtatgaaaagaagaacgatatctagacaatcaagccgctagcagttccatagaatggtggatatcttatatgatctagatcaacgtcaagatctaacctaatcggctgccttctgcgtacagatattggccgatagtagattagatagcgatattgttagagattatataagatatatgataactcgacgaattacataaacaagattagagtgtcatgaagatggaagcactaatcccgagaacgcaagccgtcataacaagttttacctcttgttgaatattgaaatcgatgcagctcaacccgaaagcaagaacttgtcgaaacaaaactaaagcaaaaagggtggcgatgcgccgagattgtattggacgtgtgtgttaaaaaattacatagggcccggggtctatttatacccgagaattacaagatatgcccataccggacacgaccattatctctaacaaactccaagataccataagtctttgcggcagatttttgcccacacttatctataaggaatttacataaaatatcctaattaatagatacaattgccttcccaggactctatccatgtatggcaatcatcttgaagtacattaacgtgaacccgatgtcgcgatcaagccgtattgtcggaatcggctgtatcggcttatttagctcgactcagacccagccgatcttaaccgtagccgatctggactccagccgattcctgctcagccgattcctactctgtttccgaactcgatctccgcctccgactccgctttgatcaaatcctctttcct

SEQ ID NO: 2342 - DNA, 1500 bp, Oryza sativa
  Os09g11220 location Chr9:6225987-6227486
cgggctagctacccccttatcaagagcctccacctcatcggctcatcccattctcttcctcacctccccctctcttctctttcgtgatccctcttcctcctcctcctctctctctctctctctctcacacacaccaattccacctcaaaacgcatgaatatagatgatgggttcatttgtatggccgtatgaagtttacaatgatccctgtattttctatcttccttatcatccttatccaaagctcttgctcgatgtctccgattgtgttcttcaaaaacacctacttattgtttgattgctttggtcttttgtgaagcaaaataaaaaagagcttgaagtggataaaatttttcccatgccttcccatgaaatcagtagcgaaggaatctttccttctatttttcgtacggctggtgtgttccatctcctccagatcctcggacgtagcactcgctacgtcagagggacatccggcgcagctgcgtcgttcataccgcatcggatgaacgcacgcagtgaggcggccaaacgggctcaaactcggtccaagtcactgaaataggacggctcatttgaacagaaggctcgtttccttagccagaaaaatcggtgtcgctcccaagttctccaggacatcagccggcggccgctcatcgtctcctccggctcaggcgctattggagccgatctcggacaaagcccctcccctcgtcgccgccctcctcaccatccctcgactcctcacgtggcgcgatgtcacgccctgaagttttccccctttttcttgctttaaaaatttgtttaataaattgcctcaagaaataatttgattaacctagagctaattccttaattaataaatgcaatcaataattggaaatggcattgtgggatttttcttgggttccacttgtcacatttcattaacgggatttttagtagaattttcatagccctataaatagttttaaccaataaaaatcaattatccgcaatattctaatcccaggaaaatccttttctttttcctcttttttcttttcctcctttttcctcttcttgggccatcggcccacttggctcctacgctgcccgctcggctgggccggcccacgccccatccctcctctctgggacgccgataggtggggcccacctgtcaagtcgtcccctacctctagccgggcagcaaccgccgctgaaaccgcccacgccaccaccgttcccgctctcctccacgccaccactccacaccagtgccccacgcccacgtcgcccgcccactaacccgcttctcccgctcgtgcgtgcgcccgtgaggggcaggattcaatttgaatccccccctctctctctcccccacctccccacgtcgccagccaaatcgggccctttcccggccgtgtccgcctctcccaaacccctatatagcttccctgcgtcctcctctccatttttcccctttccacctccctctcccgtgacctctatcgcacc

SEQ ID NO: 2343 - DNA, 1500 bp, Oryza sativa
  Os04g21800 location Chr4:12352409-12353908
ggtgacgggtttatgacgacagcgggttgcaggtgcgatgatcgtccttcctctcctctctcctccactttcccccggttgcttggctagtggattgtcgggtcccaaaactaatgattcggtaaccgacatgtttagactgtatcaagccctggatcagtagattgatacaggttcaacaatctggatctttattgtatacattttaataaggctccaaaggagatattgttattaccaaatatatgggtatttacaaacttgtggccaactaatacaacagaagctatagaatgaaccaactctaatgttttgcgtagagttaaaccatcaatctaatctatacttgaaaactaaactaaattagaatgagactaacttatatgattgaactcccagcttcggcaaaaactccgaaatgactctgaaaaaggtggggttgaagcaagggtgagtacaacgtactcagcaagctattatattcaatatgaatgtatgaaatagtagcatttgagtagggctagatttacttgcagaaagcagagaatgcagaagaagtgagcctgtaatgattttaatgcaacagtatttaataaagtttggaattaagtttctaaccaaataccatatgagtcccaatgctcaaatccatgagcacggctattcgaatagattcgttttcactttactgcagtaaatgtatgctttacccatagcccacgacgtgacgataatcatcagctttagtcatggcccagcattaggttattaacaatagtggcacctgtttcatgaactctagtccccatgcgctctgaacgtacgttatcagcagcgtgaggagttctggcgttcctggggtatttagagaggactgattgtatgacaccatatcatcgcaatcagggtttacaaacagttcgtgatatcacaatttatctcaaatatttacctatgcctcggtaaatatcacaatattgccctgctcggcataagttttcctcctgcgcgaggacttaaacaagaaccactatacagaggtaccaccttgttaaataacataataacttggtctgtccccatcctagaactgtggtcgtactcgtttgttcttcataagtacttggcagtcttatgtcggttggaacagtactagccacccggaaaatcaaccatttctaccgtaccgttcaaatctaagtttattatatttgtatgcagtctaactaggcatgactaagcaaagctagcatatatctggtttgctatatgttcatgatatgcattcaaaatcatgaagagctaatgcatagaacagaaataaagaatatagggcatttatgctcaaaggagaggaataataacttgccttgctccaatgcaaataaatccgagataggcaacctgattatctgatccttgaaatatcacaagttgccatctaaatataatagactctactggagaagaggaagaaccaaattcaataaaaatcatgaa

SEQ ID NO: 2344 - DNA, 1500 bp, Oryza sativa
  Os10g23840 location Chr10:12223468-12224967 (reverse complement)
gacctcgccccagtgggcatgccaaaaacctcacacccgacacggcaccactttacttaccaagctcaagaacacccaacgtaacgagcagacgcgcagggcagatcaaatatcaccggtacgaaatctgagacaggatagctcatgcggattatgcgtctaaacagctcaacttgcaacgacaagctgatacgcgagctcagctcatagcgataaccttttttttacggggagtaccgatagctgatgcggcgtcggggactcggggcaacgcaacctgatgcgaacaagcgaccgagaaagagaaacatcacataccaaaattacccctaatatatattaagagattactaatctaccctttaaaatatacggttgagattaattctacttgcagtagaatactgcaagtagaaagcaccggagcgtcaccttaaagccaaataatgccttctgaaatctcatgtacaactagaagtagaaaatttctagtggaaatcttgcatccgtggttctatgaatcttgttatctacagtgatcaatcgatcaatcggataacctgttctttgatgaatcttcttgagtttttatcggatggaatttgctgggattgctttgaattcgtgcacaacgccgtcgatctcgatgaggctgcagccggggaccttgtcgatctcgttcctcctcatggcgtcgagttgctggagcccctcctcgatgagtccggcatgacagcacgccgtgaggacgccgaggagggtcacctcgttcggcgtcacgccggctcgttgcatgctggcgaatagagacagggcatcctcgccgcggccgtgcattgcgagacccaggatcatggatatgtaggtataccggcgagacccagcgaccagcggccgcagcaagcctcgtaccggccagcgttcaacagccttctcgcgcacggccacatcctgctcgcgctccgcaccgccgttgccggccttgcgcgcagccgcctcctgctcacgctccacgccgccgtcctcgcgctccctccccgaccgtgtccgcatccgcgccattggtcgctcctggcgcgcggtcgccgctacccgctcccttgccgtggacaacctcgtcggcggcggctgctccctgatattttttttttttggtgtgattcaggtggagaaagatggagccaggggcaatcttgccatttcgaaaaatttctcacctcttttgacccggatattataaaatattgtcttcggtgtcctatagctaattacataatttttgtagtgtccatcagccgtgtctcgtttttgcggtgtctctcagccaattacacgttttttgagtgtcctatagcaaattttgccttcttcgaacggcgggaagaagtttgctttgtaatctatatagtcaacacatactaagtttgatcgtaatcattgcttacacaggatttggtcacatttatgaaaatgacaatatagccatatttgttaaacaaa

SEQ ID NO: 2345 - DNA, 1500 bp, Oryza sativa
  Os08g13850 location Chr8:8268007-8269506 (reverse complement)
gacctcgccccagcgggcatgccaaaaacctcacacccgacacggcaccactttacttaccaagctcaagagcacccaacgtaacgagcagacgcgcagggcagatcaaatatcaccagtacgaaatcgagatgggatagctcatgcggattatgcgtctaaacagctcaactcgcaacgacaagctgatacgcgagctcagctcatagcgataaccttttttttacggggaataccgatagctgatgcggcgtcgggggctcggggcaacgcaacctgatgcgaacaagcgaccgagaaagagaaacatcgcatatcaaaattacccctaatctgtattaagagattactaatataccctttaaaatatacggttgagattaattctacttgcagtagaatactgcaagtagaaagcactggagcgtcaccctagttgtaaatgggcaccattctttgattctctcgtgatgcatatatacattacgaagaatgtcaaaatataactactggtgtgaacatgaagttatggttgtttggtttcattcatcaaggttcaaatctttatgtccatatacacatctcgcatgtgtattttaattggtgcagagaggcggtcattctatttctcttgttaaaaaaaaaaatcaaactataaccatgtgttcgccatgctttataccttccatacaaaacttgggtcataaatgtgagctgccaaagtgatcttaatggtttagaagtaagttgcttcctaacatggctccattatagaagaagaaaacaatgtttcattcatctcctttaaaccaagatgaaattaagaagccctcttcctagttgcgggccaggaagcgactaaccatttgtggacaagcacagccaagtaaagccccaaatctcatattgttgtaggacaagataaggttgacaacacacccaggttttgtccatgttgatgatcaattagtttggttgttcaactgtcccgattaacatcttcaaagcaaagcttccaacagaccaacagtacattgaatgaaccgaacaaaacagaagagaatagatggtttctttgcatttaagttttattgtaccacttcgactcatttgtattcaagttttacgaaacttcttgattaactgaaaactgggctaggtatacttagcccgaccaatcagatatgacttttcacccttcctttttcaccaattaactaggaaagtatcccgcgcatgcattcgtgtgcggggatgcatatattagtttgtttcaaaaacacatcaaaatctaaattaaaagtaagatgttttcctttattctaattgaatgttcattggcactctttctttccataagcaatctcgatttttaccgctgatgaatgtattttattataatgtcaagctggacatccctctaataggtttaattgcatatagtttacaaaattggaggaaatatcatctcggtgatatttgacaccataaaatatgatg

SEQ ID NO: 2346 - DNA, 1500 bp, Oryza sativa
  Os12g42980 location Chr12:26703270-26704769
ggtttgccagaaggcagcaacgagagagagaggcgatcgaattcagtgagctgtggcgtaattgcccaagccacagctctctctctccctctctctctctgcctataaataagtgtttgcagctacgaaaattcaatcggggaaaaactatatgggattatcctattgatttatttatggtatgcaggatatggaggcttcgcaaattcgtttgttgtcgcctgtgggacatcgatatcagagtagaattgtttaggctcgtactccctatgtcaaaaaaaaaacccacttctataaatgaatctggacatacacggacatagtgtatgtccagattcgttttttttacgaagagagcacaacatatgtctattgtcgatacttttttgagatcagtatataaaataggtggtactagattaacgatgggctagatggttaataatgagcatatatgtgcaatagatgaaacatgtctatacaagtatagtggtatactgctacaggtaatttgttactatgtgtcagttcaattgtacagttttaaatattattactactatatcacaatatgatacttgagtgtttttactatgggagactcccctgctgtgttttggttaagagtgagcccttctcatatgagtgattcttactctcccgtcccaaaaaaaactcaacctaggaggggatgtgagacaacgaatctggataaatggtagtccagattcattgtactaggaggggtcacatcccctcctaagttgagtttttttttatggaggaagtatactactccctccgtttcaggttataagactttctaccattgcctacattcatatatatatatatatatatatatatatatatgggttagaaagtcttataatataaaacgaaggtagtactgtacatatgattgggtatgggtgtttcttataattgtgactttcagataataaaataatatcccatgttttttttaaactaaataatatccgatgtttttattccattatcataaggaaaaaaaatcccatgaatgatatcattgccggcggttgcctgtggcatgcaagcagttggcagattcttctcgtctcacagcatattgtcccttggcccttgggcattccaaatttctaccaataatttcattctaagaactaaagtcgacgtcgccatcccggtgcacgcacgccggccatgctagcttgcagatagaattggaatagttagccaagccaactccaaccaaagaccctacacatcaccatcctatccgttctacacgatgaaatattcactccatttctaatatacgttgtcatcgatttgtagtgcgtgaacagtgattttattaaaaaaatgtaaatataaaagaatatatgtaagtcatacttaaagcagctttaatggtaaaaataaataacaacaaaaaatattattattattacatattttttcagtaaggttaaagataaaacatgtgtacag

SEQ ID NO: 2347 - DNA, 1500 bp, Oryza sativa
  Os03g29280 location Chr3:16670214-16671713 (reverse complement)
cgtggcctgcgaccgcgagtggtcagtgtgtccttctgtgtatagttggaatcttttcgatatacttctgtgtatagttagagtttcgaggggcgagttgaaaccttaaaagacgtaaccagtagaaaaaaaaacaaacacaccaccatcataaagtagaaaaaaaaacaaacacaccaccatcataaactagcaggtcctcgcacaacaccctaaagaaaactctaaagtgttgtgcgaggacttactagtttatgatgataaactagtaattcctcgcacaacaccctaaagaaaactctagggtgatgtgcgagggcctgccgttttatgaaggtggtgtgtttgtttttttttcctactggttacgtcttttcaggttatgatattatagttatttcctgttatatccgtacgaacttcgcgctatctaaatataaatcgtaaaaaaatatatactccctccgtttcaaaatatttgacacgctatttattaccatggctagcaatgattttaaaattgtggcaacatgtatttattgctacaattttagtattgatgccacgatttttttcgtggcaacaaatgatttttctagtagtgattgtcaaatgtaataaataaagggttgtgttgatagttatcaagtggtgttttggtggcaaggtgccagggtgcttgaggttagaccggcgtggtaaggcgggtcagattggaagtgtttgtgcggtcagaccggccggatagctgtggtctaaccataggtgtttgagcggtcagactaggtagcccgacagtgggaacgatatactcctgtttggagtcggtatcttgttgattttatggaacatgttgattgcttaatgtttattacttctagtttgtttctatacgtgagatatattgtacgttgtgtaccattgttgagtcaagttgataaaaaaacttgtgcttggatatagtttcttagtttgttcatgtgtagttgttacttgaggcctcgggagtattgccggtgatgaatcgagactaagcttgggaaaagttgaggtctagatggacaagaagatcatgcatgatactaaggctagagaacaatgcacgtagagataaagtttccatatggcatgcaagaagagttttgtgcgtatgagaagtggagtcaaatttagattggagtccaagtttaggaagattagagattgaagatgtacagggatgtgtatatccttgttttgagaagtttcctatgtaattaggattccttgttctagttggattcgtggcatgtttgtcggtataattagatgaggggtcgaggctcaaagtaaggtgaagtgggcaacttttaggagagaaaagttaggtttctttttgagatttcggttctagttcgtgaattgagaaaggaatgctttatattccctttgtaagtataacttgatacaataaagtttatccacttttagatgccctttgtaagttaggtttgtgttttt

SEQ ID NO: 2348 - DNA, 1500 bp, Oryza sativa
  Os03g20650 location Chr3:11684335-11685834
tgcctgagctcccatccaccccacccccaaccccacgcgcgcgatcaccaccacctgcgacacacacaaccccgagacgcaccccccccccccaaccctcacgatcaaacaatcaaacacctgacctacgccgcagcaacaacaacgacaacaaccacaaaccacccacacaaacagagcccacactgaccctcgtccctcggcggcggcgcatggcaagaagaagcagagaggagagtggaggtggggaggaggcaagaatttaggattccacaaaggggggtggtgcgcttgggccaatgggggcagacaggaggcgatgcccctctctccctctctctctctctctctctctctcgcttgggaagaatccaaaaagcgatcgacgaggcgagaagcgaaagacgagtgcgtgcgcctgtgctgtgcgtctccgcgcgcgcgcggtgctggaaaagaaagaaagaaagaggcgctgcctttctagctctgtgaccaaggttcgctttgcctttgcctttggtgggcagagggagagagagagggggggttttattcgcgggggagatggcagctgcagaatctgcacaagagagacgggggccaatgtgacacaagagatcaggttattcaggtactcccgccacatcagtctaaggccccacgtaacagtcgcagcgtcactgctctctccaccgcggtgattttttttatttaccgctcacgaatctttttgagtactggaattcggataacaaacgcactcaaacgacgagtactatgttattcctcccttcctacatcgtataatacaagagattcggataagatgtaatatttttcagtactagaatgtgtcacctctctaaattctttagtagcatgaatatgtatatactatttgtccatatttatagtaataaaaaatatgatatccggttctggattattgtattttgagacagatgaagtagttaaattttaaggttttataagaatttattaaaaaaggtattgtttgatagcactatagtaaaagcgcaggaatttgagacggaataaagagaaaacatgaggtctgtttttgtaggagatatttctttgtattccatatgcattcggagccatttctttgtttcagagaatatgaagctagggatctttttccaactaaatttcaattatccaaaattcctctttttttgctgttctaaaaggaacctttaattttatagtatttttcatcgcaagaaaaagttataagtgcgttgttatatgttttcgagaataccgaatttgatgcacaacgggttgccacagaagattcaggtcctaggtgtgtcttcagttccgaatctaatacgagtggctgcctgtactactgcctccctttcacaatataagtcattttagcatttttcatattcatattgatgttaatgatcaatatgaatataaaaaatatagtattttctatattaatattgatgttaatgaatt

SEQ ID NO: 2349 - DNA, 1500 bp, Oryza sativa
  Os06g43920 location Chr6:26453545-26455044 (reverse complement)
tatgcaatcaaagaagagatgttgaattgactcattagagttacaaaagctacaaagcaagctacccttccatcttcttttaacaagattatcttttgttagaatcacccccttttcaatataccaaaggaaaattttaatttttaaaggaatccttagcttccaaattaaagatttcctatgtattacaccattaagcataagggctttatacatggagttaacataaaacaacccttttttattgctcttgcaaaagaattggtcttgcttatcattcaaattgacactcaccacctttgaaacaatttcaagccaatcttccaagtttttccctacaattgctcttctaaaagaaacattcaaagggacccttcctaacacatcggccactaccaagtttttccctaccattgttttcatctagttgatcaaaaagatcttgctgatcaactgtgtcatcgagcacagggagaagaatgccatcttcatccccaccattcagcatctgagccggcatctcagggctgtcgagatgaaagtcaggaaatgtagaaccgaagcttgaatcagttggtgttgaagaactgatgttcgagtcactaccaagtgagaagttgtcatgcatcatctctgctgggcttgtgtcgtttcctatgttgaatgaccccatctgatcatcgaaatctgacagtgatatggtgctcatgattggtgacatttgaccatgtagttcatctccaaacatcggttcctggccactggaggctgcaaagcttgagagctggttgatattggcgatgttcgcctgcgacgggcggaaagatgtcccatcattgtgaccaagatcaggaaacatcgatggtgctgtaggttgccagtatttgctacagtttgcaaggtccggaaattggtaatcattgccaattgtgctgaagtggtttgtagaagattgattcatctgaaccaaaggctgattattcacttcagggtactgcactggaaactgatttgttggcgccaaaaactcaccatttgactgcactggaaactggtttgcaggcaccgaaaacccaccatttgactgcacttgatactgatttgcaggcgccgaaaacccacaatttgactgcactggaaactgatttgcaagagctgaaaacccaaactttgactgtacttgaaactgatttgcaggcgccgaaaccccattatttgacttgtttgcagacgagttgccagaatggcaagatggagagccattgcttgtctcccacatactcttacagaacatgccagcatatgagctaccagaatcgtctgtatccaacaccaagccatttgatatgtttgcaaatgagctcccagatgggccagatgggaagcactttcttgcatttgatgagttctgcagtggctgaaacacaggattgttgcccgggcttccaccatggccaactgtccccatggccatgtttctctggctgttcttgagctgaa

SEQ ID NO: 2350 - DNA, 1601 bp, Oryza sativa
  rice_Os03g01700 promoter
aaatgcacacatgtagaaaccaaagaaaacagaaagatatttaaattaacagatataaatatatacagcacatatgtatatatctagctagtttagttaagggcgcggcggtgatgatgcatgatctgaaagagacagtgtgcaagctgattattgtatgttagatttaattaaatagttaaataatggcaacatttaactgctccatatcgatatggatatatctaatcctacatgtcacatgtgcatacgtacttgttattaacgctgagactgaattaatatacgccctccgtttcaaaatgtttgataccgttaacttttcagtacgtgtttgactattcatcttattaaaaaaatcaagtagttatttattcttttcatattatttgatttattgttaaatatattttcatgtacagatatagttttacatatttcataatttttttaataagacgaacggttaaacatgtgctaaaaagccaacggtgtcaaatattttgaaacggagggagtattgcagctagctcgcgattaaccaaggtagctatggccggccgacgcttctaactggcgcgcgtgccaactctcgatcgactgctaatcatgcttgcttaatttggaaggccacgacaatccattttaagtcgtataattaaccttttgtaattttgagtgagaccacaagtagatcgacggagacattctacttggcatgcatgcaatgcagaaacgcgcagagctagcattatgtatgcttgtgaattgtgtgagagagaattagctagattgataatgtacatatatgaatttgtatgcgatatatatgctagtatatataatatgcagttaagtgtacaaattaaatgcactaatttgcattacaaaattaattaatacacatgtggttattaatttgtcccgaagcgagaataataaagccgggttgcagtgtgacgagaggggatgatcgattagtttacattacccttttgatctcatggctttgactcttagggtttgtacgctacctagctagctttgctttcggacagagctagaggtgattattactccctccgtttcaaaatgtttgacaccgttgactttttagtacgtgtttgaccattcgtcttattcaaaaaatttaagtaattatttattcttttcatatcatttgattcattgttaaataaactttcatgtacacatatagttttacatatttcacaattttttttaaataagacaaatggtcaaacatgtgctaaaaagtcaacggtatcaaacatttttaaacggagggagtagtaattagaaatgaataaaaaccctagctagctagctacatgttgatgcgtattagttattcatgacatcagctagctaggcagacgagagtacgtcgagtagtatttatagccggcatggaggaagcgagaggaagcatcagcagcgcatgcactagcagcttagctactgcgcgcgtaccagagagagatcatcagctcaagtagctaagctagctataatctgctagctagctcgatcagacacttaattacctgctaggtggtggtcgatcgaagaagaagaag

SEQ ID NO: 2351 - DNA, 1507 bp, Oryza sativa
  rice_Os02g37190 promoter
acacttgtactggtggtgtttggtttgaaaagctaaaatattctaaacagacatgtgggcttggggtttccacgaattttgctttcatatgacatatatatttgatgcaaatgggcatgcctatggcgtgattagttgttgacattggtggccgggccatcgtaaagttgaccttttatgaataatgtactcctcccactcatttctcgtgtggttctgattttccgcacccaacatttaaccatccgtcttatttaaaaattttattaaaaaaaattaaaaataagttgagcataaagtactatttatattttatcatctaataacaattaaaatactaattataaaaaagtttaataagacaagcgatcaaatgttagacataaaaatttataactgcaattaattaaaatggaacaatggaacggagggagtaatcggcaaccggggattaatgcggtaatcagaatggcaaaacggttagggcacccacaatggttatctataggctctctacaagagatccatgtcagcatattttcctacttgaaaggtattaaatgaagagagagagagagcaaagctatctactaacttaaagatagtctatagagaaaaacgaggcaatgaatgagagagatatagataccaatatagacatactattaaggtggtttactattaatcgagtctattgctgaaatatacatgttttatagagagcaccttactttactattgtggatgctcttatagctggtcgctagtcagcttaattatatatgttctgctatacgtataaccttgaatcggtcgacatgagaagacgcagtgtgtcatcaactagtaactaacgcactactaccagaaccctaaatctcataagaaggcttcatcctgcctataaatacgcttggtttgcacgcataggcttctcaccacactcgagattgtgcgatccagtcctaattaattataccgtgagttgaaaattaattaagatcacttaaggtcttaaagctagcagccatggcggcatcgtccaagttggctttactggtgttcactctcctgctcgccgccgctgctttcatccacgtcgcctccgccgaagaaacacgtacgtgagctagctagctagctagcacacaccctgcatgcatatatatacatacaatttttcgttaaattttctcctgcacatacacatatatactgcttcctccgtttcacaatataaattattctagtatttctcacatttatataaattattctagtatttgttacatttatattgatattaatgaatctagacatatatatctatttagattcattaacaataatattaatatggatattaaaaatactagaatgacttacattatgaaacggagggactacgatacgatatactactacatgtattgtgttcatgcatgccttcttcatagtattcatttagtattaattagtatttgatatgtcgtctatatgcatgcag

SEQ ID NO: 2352 - DNA, 174 bp, Agrobacterium rhizogenes
  rolD promoter
caataatttctgtagcaaatggaaaacgttttacaaacaatgtggccttggagtaataatcggaagaaaagttcataagtcagataatttgcgttgctgacactagtgaccaagcacctttaaatacctctgcttcccatgcattttgccaagttaacctaaactggcagttga

SEQ ID NO: 2353 - DNA, 699 bp, Oryza sativa
  RCc3 promoter
gttgccgggccagcaggaagccacgctgcaatggcatcttcccctgtccttcgcgtacgtgaaaacaaacccaggtaagcttagaatcttcttgcccgttggactgggacacccaccaatcccaccatgccccgatattcctccggtctcggttcatgtgatgtcctctcttgtgtgatcacggagcaagcattcttaaacggcaaaagaaaatcaccaacttgctcacgcagtcacgctgcaccgcgcgaagcgacgcccgataggccaagatcgcgagataaaataacaaccaatgatcataaggaaacaagcccgcgatgtgtcgtgtgcagcaatcttggtcatttgcgggatcgagtgcttcacagctaaccaaatattcggccgatgatttaacacattatcagcgtagatgtacgtacgatttgttaattaatctacgagccttgctagggcaggtgttctgccagccaatccagatcgccctcgtatgcacgctcacatgatggcagggcagggttcacatgagctctaacggtcgattaattaatcccggggctcgactataaatacctccctaatcccatgatcaaaaccatctcaagcagcctaatcatctccagctgatcaagagctcttaattagctagctagtgattagctgcgcttgtgatcgatcgatctcgggtacgtagca

SEQ ID NO: 2354 - DNA, 751 bp, Nicotiana tabacum
  TobRB7 promoter
aaacacccgaaaggaaatgattcgttctttaatatgccctacacaatgtgaatttgaattagtttggtcatacggtatatcatatgattataaataaaaaaaattagcaaaagaatataatttattaaatattttacaccataccaaacacaaccgcattatatataatcttgattatcattatcaccagcatcaacattataatgattcccctatgcgttggaacgtcattatagttattctaaacaagaaagaaatttgttcttgacatcagacatctagtattataactctagtggagcttaccttttcttttccttcttttttttcttcttaaaaaattatcactttctaaatcttgtatattagttaagcttatctaaacaaagttttaaattcatttcttaaacgtccattacaatgtaatataacttagtcgtctcaattaaaccattaatgtgaaatataaatcaaaaaaagccaaagggcggtgggacggcgccaatcatttgtcctagtccactcaaataaggcccatggtcggcaaaaccaaacacaaaatgtgttatttttaattttttcctcttttattgttaaagttgcaaaatgtgttatttttggtaagaccctatggatatataaagacaggttatgtgaaacttggaaaaccatcaagttttaagcaaaaccctcttaagaacttaaattgagcttcttttggggcatttttctagtgagaactaggatccgc

SEQ ID NO: 2355 - DNA, 1604 bp, Arabidopsis thaliana
  Pyk10 promoter
ttgtgagagacaatcggaataattggctagaatcagtctttttttcctagtggatctttaaaaaccattcttttataccaagcatgtacatgctgtggtgtgggtgtaagtaaatcctgccccaatgaaaattgtttttggactcgccactgcaacgaagtgtaccaacaacttgactaggattctaagttcttttatgtataggatgtctatattaaactaccatgactaacatatatatagtagttccatatgctcgataaactatgatagatcaacaattttaaacatatagtttaacactatttatttgttcaacgtcaatagtttatagttacgcatgcgctcggcttagatttggtccccaacagtcgaaattgtcaaataatataaaataaaagtttcattgttaggattcatttattcttcgggtggttattgtaataaaaggcaaaagaaaaagaagaacaaaattcacaagtaaaaaaaaagataacatcattcttttagtcgacaaaaaaaaaaaaaaatcaaaaagatttattcagtactacagtttaatattgttttgacttttttctttttctttatattatctgaaaattctagactgcagctgaaacatgtgatatggattaaaggcgtatccagtatccacataaagaggagtggtgtcgctcacccagtcacccttgttacttgttagatagcattaatacatttgtaagcaacagcttatctgatagacatgtcttaattgggaaatatgctctaagatgatacaaccatggttccaactgttgaccaccatagctgataacatgttgattacattttttcttttcagttataacgattacttttttggggaaattattgatataatatgattcattggatgatccgatatcatgcatataaagttgtatctcgtgaaacacgagatagtattatactccattctttcattatcggagtatgtttaaaatttgaaaacaaatacagacacggaccgtggtctttaccttcagaaaaaaaaagagaaaaaaaaaacaatccactgtttattataggagttgtagaaaatcgggcaacgatattcgatatgagttattattagggccttattattatatggtattactggatattactaaataaaataatcatataaatttcacattttaatatacactcgttggacacgcggaatattatatgttctaaatgttaaaaaaatcaaaagaaatacaacgatcgacggatctagagtctagaccatgcaaataaatcatcctatttaaatataataactgtgcatatagtttagtcaaataaaaaggtaaagaaacaatatacaacctataacgtcaatatccatgtacgtagtaataattaggatatgacagaaaacacgatatcttgatatatacaaaatgaaaacttaaaaattgattaatatggcctggctgggtatattattataaaaacataaagagagatcaataattgattcgaagatcactatataaagaacgtcttcgatatgtaaaagaaccatcctaaacattttttcttgaataaaatcagaattacaaacaaaa

SEQ ID NO: 2356 - DNA, 624 bp, Hordeum vulgare
  HvPht1.1 promoter
  misc_feature (308)..(407): n is a, c, g, or t
tgtatgatgtgcaactttcactgtgagtgatatatttgagcatgacagaagacgaactccctaagactcggaggcggacctcaaggcatgggggcaaactgatttcaggtttctagcagaagcatctatccgactatcaccaagaaactaattgaaatgtggaaacacagaagctacagcagtgagagagttgaagcaggcacaccgatccgcgacacgaggtagggggatccgctcggccggcgccggcgccggcactgtctttggggatgcagcggctgcgaagggttggttttacggcagcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaaagagtagcggccaagctgaaagccaagggggagacaaggaggacgaggtgtccagtccttgacgactgggctagccgcgtacgcattgcttgcaccgatcattggtcacaagcagcggcatggatggatcaaaaccgccatgatagacggggcaccaccagtaccagtaccacaggacagtgtgcgtcgactgaccgc

SEQ ID NO: 2357 - DNA, 1304 bp, Hordeum vulgare
  HvPht1.2 promoter
ggacagtgtgcgtcgactgaccgcatgggttgactcggccgagattttattgcctggcctggccgggccggaaactacggcgagccgtcgtcgtcttggttgactgacgtggagcggatattcctcccggcgatcccttccgtgcgcaatgcaatccatgcgcgtggcctccataaatagggccttcccgccgccggcctcctccaacaaccgtcctcctccgctagctagcaactcttcttctcatctactacatctcttcctgcctcgactggctgttgatgaggttgcagccagcccccgacctatctctctagctgcttcgtcggcgacggtgagtaccgactgtctcctgctcactcgatcgccggacttgtgttggcgttatctattttctttctcggtttgcgatcgatcttcagcttggcgagagcagtggattcctcactgaaacacatgcatgcatgattccgaccggtgttttatcacctgcttgaactgctgcagcgcatcacttcttgctaccaccttaaactgctagctcttcaaaagaaaagagatttctagcaagctctgctgacacacatagcaatccaaaccatctttgcgcatgagtaggtcgagagaagccaaagggatcttccaaatttcgtctttcgaaccagcaagttgtggtgagtggaggcagtatccggaactgaaaaaaggcggatcaaccaaatcccctgcctgcagcgagtcaccttttgatctgggctgtcacgtcaccttattgtttgccccctttttttctttttttcatgcctccttgatcgtgacaaccttcatttgtttcctcttttccatccccaccttaccaacataccacaaaatacattatagttttcatttgggattgcctacgtcttctcagtcgactgagacttcaccaagtctcagtcaagtaatatagcatgcgaaaagaaacaaaattagaattttttttatttacacgaatcttgatgcaaaataaacggactacaatatcgactgagacttcgcgaagtctcagtcgactgatttttagcaaagccgttttcacttactagaaaataaaaaaaatagtaacattttccttttcaccaacaaaatcggaacaagataacttattagggtgcgaatattccctttcaggaggaggagccgcagtatttatcttgtccaaccctcgcggctcgtcccaccctaaaatctctgatcttgtctatctctcagcacaaccaacagcgatccccggcggcggcgagagatcaaggctcgcggcc

SEQ ID NO: 2358 - DNA, 1505 bp, Arabidopsis thaliana
  PHT1 promoter
ataaagctaaaagaaattaaagtttcaaagttaaattttctttgccactagagcatatacctctaatttgttttgttttttttgtaagatgaaaaaaaaatgtaagcaaagaaaaaaggacagtggtgggtgactctggatgaaaaatgttagtgcaaaatcatgatacacatagtaataattaagggggtcgtaaagttaaaataaacaaaatgcgcggcttgaaaataatataaagcagagttttagtggcgaaatccaatccaagtcaattataagagcatctccatgagtagtctctcacatagtttttcattaactaaaaaatataaaataataataaagtaggagagagatatgagagagattgagaatagtttctctgcagagaaactttagaataatgattgagagactatgtgtatatatgtgtgtttattattggacataaactaaatcatagtaaaatattattatattttttttttgagagactatgtgtatatatgtgtgtttattattggacataaactaaatcatagtaaaatattttttttttttttttgagaaacttttaaagtatcttaccaatggaaatggcctaaacttcctaaaaaaatatattatattcttaaaactatttccaagtttctaatttgaccccacaaaggagaaaaaccaacaaaagggccctttctggtggcatctttatcccaaattacacagtggttttcatattttatatattatctttacatcagagttttttttttcccatcaacatgtatacgtaaaagaaaacaacaaaaattatagcaaaataacccttcttgaatggtaaaatatctcgcagattttatatcataattttatatagtttacgataataaagaaatgtgagactaaataaattcaacgaataggatatacacagaatccagactttggcatccacgcggcataaagaaatagatcgagtgtgatatacaacaaatcacaaatgtgctctcattaattttaaaaaacccaaatctttaatgtattcgtaacgagtctgtcactacattaataataagtcattgaaattgaaatccaccaatagttgcacagaagaattaatatatatttccataactctcataacacaaacttcaccttttaacgaagaagaagatatgttcccaaaacaaacgttttgactttttttttgttttctcatattcttttatttcacaacttgttatttccgccgacttcaccagtcaccaccaccttcatttattcataaatacgtctctgttctgtttttgtttctgtttcattttcatacataattaagccaacacgagacgcaagagagagatagggaaagagataagagcgactctgttttgttgatcaaaatcctttttttttgtttgagggctgaatttgtttgttgatggtcatctaaatttgtaacctttatctgttttattgagttgtgaaattcagagaaaaaataa

SEQ ID NO: 2359 - DNA, 421 bp, Arabidopsis thaliana
  At1g73160 promoter
gatccgtggttcatgaacattgactgtgtttgcaacgacgaaaccctaggaagcacagcgtcgcaagaatagcgtagacacacgcgcattatctcacgcgcctaaagaaacccgataaattaggggaattacacatgtgtaaagtgtgacggagtaatcacacgcctacgtgtacaaaacaaaatatcaaaccgggaaaactaattaggtgtgatatcccggtttagttacaaatctcagttggttaagagagatttgactttcaattgaatgtaaaaaccatataaaaattagctaagccatgtgcaatgtcattgagaaatgaactttgatataataactcgagaaagatccgaaatttaagcaaagaatcaacatcaatagttgcactcaattcacaaaaatcaaataaaccaaaaca

SEQ ID NO: 2360 - DNA, 1400 bp, Arabidopsis thaliana
  AtCel5 promoter
tccagaaaagaatcattgattactcgttgtacataatatctccttctaaattgatgatttatagttatgtataacatgttttgcaagagatttgaaatcttcttatgtatcaattcaatgcttgtaccctttttttatccctcgagttcttaaggtacttagtccctagtgattaaccaaattagccagcatatttcttttagaacatatatcattttagaaaatatgttactaaacgatatgtttgggcctttgatgatgaaaaagctaagaacgattttcttttggtatgaaatgtttgttattactattccctttagtatttaccaaagacttcgcagggggtgaaaaaaaggatcaacctgatgttatcatattacacgtgaatctcccagatcgagattttgctacaagaatcaagaaatattatgtagggattcgttgtggaacgagagaaagtgtgttttgtttgcttaactttaaatctcagttttcttataaactttttatagccgtcttttatgcaaaaccccttgagtttttcatgccttaacttgtgaatcgtgatagagtaagaagattatggatattgttaagtgttaattaagatcaatttcatcttctacgagatggtattcctgtacgttttccaatcaaataacttcattttaccattgttattatttaagaatatgtatatatataagaaagtgagttcgatattttcatttgtatgtatataatgtaaaagattatacaataagacaataataaagagattaaggaatcatttacgtgttaatcacacttgacttgagaaactcttttaaattgaagtcctcctatagacccgtcgccgttatcttggcgccatttacgtaccctccttttttctaaatcataatccccaaaatccctaacctaactaaactaaatactacctaactaactaccctattatcaagatttaagacattgtttatctatcccctaatcgtacgtattacgcaatgccactatctaaaatacacttcattacagtttactgtggtaaaaaagataagtatcaaacatcaaaactaccaagaaattaccaatttgtgtcggtgaactcatatagacaaacctatgtggtaatcaaactattagttaaaaaaaaattgaacatattaagaagattacagaataatacatgtaatcctccacttgtcagttctataaaatattaattaaaaaggaaattcaaattgaagtaactaagaacagtttttttagcagttaagctgaatttcaaaaagccataatcttcgctctgaatctcatcagccccggtctccttctctagctatatatatacgtgtgtgataaagtcgtaccctcaagccaacacaataacaaga

SEQ ID NO: 2361 - DNA, 1541 bp, Arabidopsis thaliana
  ARSK1 promoter
tacaaaatcgcccaagtcacccattaattaatttagaagtgaaaaacaaaatcttaattatatggacgatcttgtctaccatatttcaagggctacaggcctacagccgccgaataaatcttaccagccttaaaccagaacaacggcaaataagttcatgtggcggctggtgatgattcacaatttccccgacagttctatgataatgaaactatataattattgtacgtacatacatgcatgcgacgaacaacacttcaatttaattgttagtattaaattacatttatagtgaagtatgttgggacgattagacggatacaatgcacttatgttctccggaaaatgaatcatttgtgttcagagcatgactccaagagtcaaaaaagttattaaatttatttgaatttaaaacttaaaaatagtgtaatttttaaccacccgctgccgcaaacgttggcggaagaatacgcggtgttaaacaatttttgtgatcgttgtcaaacatttgtaaccgcaatctctactgcacaatctgttacgtttacaatttacaagttagtatagaagaacgttcgtacctgaagaccaaccgacctttagttattgaataaatgattatttagttaagagtaacaaaatcaatggttcaaatttgtttctcttccttacttcttaaattttaatcatggaagaaacaaagtcaacggacatccaattatggcctaatcatctcattctcctttcaacaaggcgaatcaaatcttctttatacgtaatatttatttgccagcctgaaatgtataccaaatcatttttaaattaattgcctaaattattagaacaaaaactattagtaaataactaattagtcttatgaaactagaaatcgagatagtggaatatagagagacaccattaaattcacaaaatcatttttaaattacctaaattattacaacaaaaactattagacagaactaagtctataatgaaacgagagatcgtatttggaatgtagagcgagagacaattttcaattcattgaatatataagcaaaattatatagcccgtagactttggtgagatgaagtctaagtacaaacaactgaatgaatttataatcaataatattgattatattgtgattagaaaaagaaaacaacttgcgttatttttcaatattattgtgaggattaatgtgaacatggaatcgtgtttctcctgaaaaaaatatcagcatagagcttagaacaatataaatatatccaccaaaaataacttcaacatttttatacaactaatacaaaaaaaaaaaagcaaactttttgtatatataaataaatttgaaaactcaaaggtcggtcagtacgaataagacacaacaactactataaattagaggactttgaagacaagtaggttaactagaacatccttaatttctaaacctacgcactctacaaaagattcatcaaaaggagtaaaagactaactttctccattttttccccaaataacacaaaagaagaagttgaaa

SEQ ID NO: 2362 - DNA, 600 bp, Solanum lycopersicum
  RSI1 promoter
ttattctcagttatggagtgatatttaaaatcaatatagtatatcgataatcagatagtttaattcttattttctccatccaatttatataatgatattataatcaattttacgaatgagatggatattttgaaatttttagtttaaaataaattttaaattttttgtgggtctataaattatctaattaagaggtaaaatagaaagtttgaaattaattattacttactaaatatataaatatgtcattttttcttaaactgatttagaagaaaagagtgtcatatacatggacagaacgaatataatttgataattaaatttgtaaagattcatagttaatagggatcaaaattgcacgtatccattactataaggtcatatttgcttcataaaaatcatcaggatcaaaaatcagaatttatattatatttgagggactaaaaatgctaatatcacaaattaaaattagtctataaatattcacactttactcttctaattccatcaaatatttccatttatcttctcttcttcttaaatattttattttccttcaaactatatagtaatttcactttccatttgaagagaagaaaa

SEQ ID NO: 2363 - DNA, 1530 bp, Arabidopsis thaliana
  SUC2, AT1G22710 promoter
agatacttgatcggcattttttttggtaaaaaatatatgcatgaaaaactcaagtgtttcttttttaaggaatttttaaatggtgattatatgaatataatcatatgtatatccgtatatatatgtagccagatagttaattatttgggggatatttgaattattaatgttataatattctttcttttgactcgtctggttaaattaaagaacaaaaaaaacacatacttttactgttttaaaaggttaaattaacataatttattgattacaagtgtcaagtccatgacattgcatgtaggttcgagacttcagagataacggaagagatcgataattgtgatcgtaacatccagatatgtatgtttaattttcatttagatgtggatcagagaagataagtcaaactgtcttcataatttaagacaacctcttttaatattttcccaaaacatgttttatgtaactactttgcttatgtgattgcctgaggatactattattctctgtctttattctcttcacaccacatttaaatagtttaagagcatagaaattaattattttcaaaaaggtgattatatgcatgcaaaatagcacaccatttatgtttatattttcaaattatttaatacatttcaatatttcataagtgtgattttttttttttttgtcaatttcataagtgtgatttgtcatttgtattaaacaattgtatcgcgcagtacaaataaacagtgggagaggtgaaaatgcagttataaaactgtccaataatttactaacacatttaaatatctaaaaagagtgtttcaaaaaaaattcttttgaaataagaaaagtgatagatatttttacgctttcgtctgaaaataaaacaataatagtttattagaaaaatgttatcaccgaaaattattctagtgccactcgctcggatcgaaattcgaaagttatattctttctctttacctaatataaaaatcacaagaaaaatcaatccgaatatatctatcaacatagtatatgcccttacatattgtttctgacttttctctatccgaatttctcgcttcatggtttttttttaacatattctcatttaattttcattactattatataactaaaagatggaaataaaataaagtgtctttgagaatcgaacgtccatatcagtaagatagtttgtgtgaaggtaaaatctaaaagatttaagttccaaaaacagaaaataatatattacgctaaaaaagaagaaaataattaaatacaaaacagaaaaaaataatatacgacagacacgtgtcacgaagataccctacgctatagacacagctctgttttctcttttctatgcctcaaggctctcttaacttcactgtctcctcttcggataatcctatccttctcttcctataaatacctctccactcttcctcttcctccaccactacaaccaccgcaacaaccaccaaaaaccctctcaaagaaatttcttttttttcttactttcttggtttgtcaaat

SEQ ID NO: 2364 - DNA, 689 bp, Zea mays
  Sucrose synthase promoter
ccccctaatccaatggcggggaggaaatagggtggggtggggtggggggagggaaatatctcgctactttttaatccggacaagctcatttgcgtttgcgtctgaatgatgatgactgcaatgctgatcgcacctcgggtgtcggatcaccagcttttggctgctctcaccaaatcagctgcaagaagattagagctcaaaagaattacagaaagagagcctttttcttttcttccttgtggggttcctttcatttcgtgctctcctttctctgccagccagtccgtccttgcgtccactgcacctgcacacaggtcaccccgacccgcactgttctagactccattagaaaaaaaaaggtctgaacctttccgaaaccagccagccattggtctggcaggccagcatatgctaattggatttttttgccgcatcattgagtgcgccatcaggatttggaaatcctggttttgagtaatacagtaatttggcattatccattgccgaattcccaagctccgtcagcttgaacgtggacccctaccatctgcaccagctcggcacctcacgctcgcagcgctaggagcctaggagcagctgcccgtctatttattggtccctctcccgtcccagagaaaccctccctccctcctccattggactgcttgctccctgttgaccattggggt

SEQ ID NO: 2365 - DNA, 602 bp, Glycine max
  GmSBP2 promoter
ttaaatgacttttaaaaatgatcagacctaaaatttgagtcttctgattgagatgcaaacttatttctttttatattttatattttatactcatttgtttctctttctattatatttcttttttttcttctctttatgcaaaaacgtatgacgttgattggtgtctttggcaatctttttatgacgctcaaaagtgaaaataaatattgttcactttcacctcacgctggccttccgctgatggtggttgtacgcacttatttgatttttttttcttccacatttaatgaggtgaatcagttagagaaatattaaaaaaaataaataaataaaagaagacgactaatacaataaagaatacgaaactcacaatgaatagacccaattggaaccatttattttccttacaaattaaagaaaacatttttttaacaatatatcacattatcatctattatatttttatttatattttttataactttctctatctaggtgtagattgacatgagtatacgcacgcacacccagctctacttagcagcaattacccgttttacttgctacttaagagacacgtacattaacacttgtccttgtgc

SEQ ID NO: 2366 - DNA, 72 bp, Robinia pseudoacacia
  Rplec2 promoter
aatatctatctacacattaggtgggtgatcatcgctagtataaatatgtaaggttgtgctccctcattgtgc

SEQ ID NO: 2367 - DNA, 85 bp, Agrobacterium rhizogenes
  rolC promoter
caaatcatataagcaaaagcatctataaaaggaatgatgcttccagttctgggtgcacgccactattatttcctactttgctaac

SEQ ID NO: 2368 - DNA, 1505 bp, Oryza sativa
  DX1, Os12g33120 promoter
ctcaaccgtgacagaaggacaagcgacatgctctggggctcaccagctcaaacatgaggatcacacattcaatcttgacttgttctagatacgtgcaatagtaattcatacccatgagcctatttcctatgcttaaggtatggaccagtcattacaccccacgagggccaccgactgagtacttgtgccagttgagactcagataccacctttatttcactatgccccatgagagataaagataaaccattcggatcagaagacactcagatgagatgcacttggtccatatcaccgaagagatatgtcattcgagagctgacgaaaggagcgatacacgtgtcattttatcttgattttatcgggcatggtgggcctagaggctagtgtgttcgtgacccaataactaccatgcattgtgaattaagcatgtcctactattcattaggtggtgttgttccaacaacccacgtgctatttaccgctttttataaaactcagatgttgattggaaaagacccgattatataatcaatatatcactcgagtcatgttactctagtattcacatcgtatatactgcatcaaggtttaagccactcggctagcgggggtattacatagtcgggagctacaccttttaggttcatctattcgatgcacttgtttattcatttatcgacggagccctccacagtctctttgcaagatatcaaaaaagagaactcaagaaagaagcacttaagaagccttcatagcaaatatgcagtactcagtattggtcataaaccatggaaaaactacaattcgactgtgaaggtctcggggacaaccgtagaagatatgggtactaggtacccacacagcctgtatatccgactacagataagaagtgaactgcatccatgtaataagatatagaataggactcaatcgtcatgctaccttatgccataaggcagggtatagaatcccatctgaatactaccttatatagattaggaaactgaagacttgtctggctaggttttcctctttgtaaccctagcctccaacttaaataaggtgggcagggagccccctcaggggttgaccagacaaaagatccatgagatcaacacaaccaagatcaccatgatcaatacaatccgaaatatccaatccatcaaacataaataaagtattatctctcattgagggggttaatttgaacgtgtctaaactctcgtgtgctacccctttattctccacaacatcgatctttctccacaagcatatatatcgggttaaacatattctccaaagaagaaaataaagccatataatcttatatatatatatatatcttcaggacatattctctacaccatagtgatagactagtttccacactataaaagcacggcaaatatcaccaccatgaactcaaagagccaatagcgccaccaacaaattattgacactacatttgagacaaaaaaaaacacttagacacataattaacc

SEQ ID NO: 2369 - DNA, 1504 bp, Zea mays
  PEPC promoter
tttaaaacttaaaagtacaaatgaggtgccggattgatggagtgatatataagtttgatgtgtttttcacataagtgacaagtattattgaaagagaacatttgcattgctactgtttgcatatgggaaaattgagaattgtatcatgccatggccgatcagttctttacttagctcgatgtaatgcacaatgttgatagtatgtcgaggatctagcgatgtaatggtgttaggacacgtggttagctactaatataaatgtaaggtcattcgatggtttttctattttcaattacctagcattatctcatttctaattgtgataacaaatgcattagaccataattctgtaaatatgtacatttaagcacacagtctatattttaaaattcttctttttgtgtggatatcccaacccaaatccacctctctcttcaatccgtgcatgttcaccgctgccaagtgccaacaacacatcgcatcgtgcatatctttgttggcttgtgcacggtcggcgccaatggaggagacacctgtacggtgcccttggtagaacaacatccttatccctatatgtatggtgcccttcgtagaatgacaccccttatccctacaatagccatgtatgcataccaagaattaaatatactttttcttgaaccacaataatttattatagcggcacttcttgttcaggttgaacacttatttggaacaataaaatgccgagttcctaaccacaggttcacttttttttttccttatcctcctaggaaactaaattttaaaatcataaatttaatttaaatgttaatggaaacaaaaaattatctacaaagacgactcttagccacagccgcctcactgcaccctcaaccacatcctgcaaacagacaccctcgccacatccctccagattcttcactccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaaggagcctcagccgcagccggttccgttgcggttaccgccgatcacatgcccaaggccgcgcctttccgaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccatctcgcttccgtgcttagcttcccgccgcgcc

SEQ ID NO: 2370 - DNA, 263 bp, Arabidopsis thaliana
  gapb promoter
taatatcctgatgaaaactatatgacatgaaaagaaggattaaaaaaatgagtctcttgagaaacttgtgatcactggctcacagaatcttatccccatatgtatcttacctacataatagccacatattactttgcttcactttgaaccattggttggttttgatcaaaaccaaaggatgtgtgtatgtatgtatatattctaacgctcaaaactgatcactagcattcctagatttttccttcttgtgatcacttgcagct

SEQ ID NO: 2371 - DNA, 1504 bp, Zea mays
  ppdk promoter
gtgaaatacagtagccattttcctattttaggtattcacatgtacaacttttcttgtcatatgtatgccatggcgcttttgtaaatgttgcttcctttgaacaatttggtgtcaccttgatagaggtcagaactattgaaatcaagaattcatttatgtatctcaccattttcacgcccttactacctatctgctctttttgtgagcgatctgtcatgcacaggttgcctgttattgcaacaaaaattctggtgtaacactttttcagaatccatccatttatgttccattaactgcttattaatgctcaaattgaagttctcacaagttgttatttattcgttaccacccggacatagaaccatatgtaacactttgtgttcctgaacactatgctgactcgtagcatgcagttgcttctcgcaatgggcttcacctacaaccaggtcatggaagcctacaacatattcgacgaggatgtggattgtcctgtgtgggctctcttcctttgaaaaccaacttggcgattgggaattagcatgaaacaaatctttacacaattattacttgcatggacgaagtatggacgaaaagaatgaaatataggagaatcatattgttggggaggtagatctgaggcatttgataaaggccaattcgatacatgagcatgcttcaaatgaagggccaattgctaccggttaaacataccatttgcagtgtttttccttagtgttttttgatattttgatcgattttggctgcaaaggtctactaattggtttccagcttactaattgattgtttttgcatatcatttttttatcaaattggtttcgtagcaacgcacgggtatatatatatatccagatatttttatatggaaaaataatgcaattgaaactaataaaattttgtttagtgttaggaaattcagataaattgtgttttaccttaaaaattatgaaactggtttaatttttttcctcttcaaaattaagcactatcttattgtgtctagtttaaaattgattgaattttaatagattttgttcttgttgcttcgttaccaatttgcatacaataaagtctactcagaaacactagtggggtcatgcgaccaggagcccggatggagctggaaaggagtcgtgcgactgtacactgtagccactcgcgcgctagaggccggagctggaaggatcaggagggtgtgcgtgttcccgaatcgcctggaggcaggagcctcgtcgtccggagccacagccaacaggcctcgagacactggcgggtaggcggggcccgaccgggataaggtgaggagccgctgcgatggcggcccgtgtgacccccgtcgcaacgcacggacggtatataagcataaaggcatttccgcgaactcgcttcctcgcgcgctcccgccacgtgagccagcagcactccacactgtatgatcgagcagctacgcgcctggacagactcggcgcaggaggggatcgggagg

SEQ ID NO: 2372 - DNA, 1699 bp, Nicotiana tabacum
  lhcb1.2 promoter
ggtagaagatgccattgtagaagtagaatgataactcttgaatgcacaaaaagaagagttgatttgaggcttgagttttatgggctttgtactaagtgtatataaatgaatttacaggcccaaagactaccttatccttgaatatctatatctgcttttccattggtggatgacaatttgtaaccttttgcattcttttccatttggcaaagttctgcaccgttaaagatgactagatttttgtagatactttatacgtttaaaaaatctaagccaatgaagatttccttcttatagccaatccaaatttgccacgtctgattgtggattattgcaatataatatcaacttagccagagcataagagtaactcctggccatgcattgttcatacacttctgtatatttagctgacctgtaaaataggaccacttgtatgcagtggcggacccgtaaacttcggcagaaatcttgtatatgtatatgtgtataccttgaaaatgattaatttaaatcacttgacacccttaacgctaaaagcctttagggggcacggatcagaggcggagccaggatttcaaactttgggttcgggattctaatcgttttaagttactgtgttctaaattaataattgatacatattcaatggatttttttaagacaaatacaggatttgaaccaaagctactggttcggccgaacccgctggcggcactctagctccgcccctgacactgattgaacagaatattgtgccctcatcgcattaaattcctgaaagaaagggtaaggggtaggaatcaactttttttaggtgttgctctactaaagtagtcggcctaaccttcggttcccgtgaccaagtttttctttctcatgagtctgtctctgcttgtattgtatgagtggcaaattgacaatgagacaatttaaaaaaaaaaattgaaatcaaggtaatgcatttatacgtgtccctacatctaagctccacaattaattttgatgagtcaattgaaagtttgatactacaagtccaacagctcgatcatacgtatacaataacttttaaatattaagttatattctgatggtgtaaaatttatttacactgtgcatataacttatgttctgactattctatagttgaaatgaaataaaaattgcttttggggtaggtttatcggagtgttataatcacttataagcaaaggcgaatacaatctactagttacgagtttattcgaacccaataactttggcttaaattctgtatatatgattaaaaaattacgggtcttgcatccttcattttcacaaaaactaagttcatgtattattttagttgtggctttacagacttgaagcaaattttagagattaaaatcagaaaatttccagacttcagaaaatcctactgccagcatataggacagtttgcaatttaagaccacatattttggttggaccacagtagtaaaaatcttggaaaattgatggattacaaagtgccatgtcaacaagaactaatgctaataaaatcttgaaacccaatgaaattgtagatagagatatcataagataagaactctttcaatcaatccctatataaatatttaagcccaacagactacatcaccacaactaacttctctattacttcagccatcaaaaaacacttctttctccttattaaacc

What is claimed is:

1. A method of altering architecture or physiology of a green tissue in a plant, comprising:
    (a) introducing into a plant cell a nucleic acid construct comprising a tissue-enhanced promoter consisting of the nucleic acid sequence set forth in SEQ ID NO: 2324, that preferentially regulates expression of a polypeptide having the amino acid sequence set forth in SEQ ID NO: 76 in a green tissue,
    wherein regulation of expression of the polypeptide increases nitrogen uptake, assimilation, nitrogen uptake efficiency (NUpE), nitrogen usage index (UI), and/or seed yield in a transgenic plant comprising the plant cell as compared to a control or reference plant that does not comprise the nucleic acid construct; and
    (b) optionally, identifying the transgenic plant comprising the plant cell.

2. A method for producing a plant that has enhanced nitrogen uptake, assimilation, nitrogen uptake efficiency (NUpE), nitrogen usage index (UI), and/or seed yield, the method comprising:
    (a) providing a plant with a nucleic acid construct comprising a tissue-enhanced promote consisting of the nucleic acid sequence set forth in SEQ ID NO: 2324, that preferentially regulates expression of a polypeptide having the amino acid sequence set forth in SEQ ID NO: 76 in a green tissue,
    wherein regulation of expression of the polypeptide increases nitrogen uptake in a transgenic plant comprising the plant cell as compared to a control or reference plant that does not comprise the nucleic acid construct; and
    (b) optionally, identifying the transgenic plant comprising the plant cell.

3. The method of claim 2, wherein the providing a plant with a nucleic acid construct comprises transforming the plant with the nucleic acid construct.

4. The method of claim 2, wherein the providing a plant with a nucleic acid construct comprises crossing the plant with a second plant that comprises the nucleic acid construct.

* * * * *